United States Patent 12,508,308 (INFLUENZA mRNA VACCINES) - sequence listing, part 36

SEQ ID NO: 136189 - RNA, 1410 nt, Artificial Sequence
  derived and/or modified sequence opt3 from neuraminidase__InfluenzaA__AAX56593
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccggcaaucauagagagaaauaucacugaaauuguauauuuaaccaacacaaccaucgagaaggaaauuugucccaaacuggccgaguacaggaauuggucaaagccucagugcaacaucacuggguucgcgccauuuaguaaagacaauagcauacggcuauccgcuggaggugauauuugggugacacgcgagcccuaugucucuugugacccugauaagugcuaccaauucgcccucggccaggggaccacgcugaacaauggacauucgaacgacacugugcacgaucgaaccccauaucguacacuucugaugaaugaauugggcguucccuuucaucucgguacuagacagguguguaucgcauggucaagcaguuccugccacgacgggaaggccuggcugcaugucugugugaccggagaugacgagaacgcuacagcaucuuucauuuacaauggcaggcugguagauagcaucggcuccuggaguaaaaagauccuccggacccaggaaucagagugcguuuguauuaacgggacgugcacuguggucaugacagacggaagcgccucugguaaagcugauaccaagauauuauuuaucgaggaaggcaaaauugugaacaucuccacucugucagggagcgcccaacacguggaggaaugcaguuguuauccucgcuacccaggagucagaugcguuuguagggacaauuggaagggcucuaaccggccgauaguggauauuaauguaaaggacuacuccaucgugagcucguaugucugcucuggucuugugggggacacaccccgcaaaaacgauuccuucucaaguagccacuguuuggacccuaauaacgaggaaggaggccauggcguuaaggggugggcguuugaugacggaaaugauguguggaugggucgaaccaucuccgagaaauucagaucuggcuacgagacguuuaaggucauugaaggguggagcaaaccaaacucaaagcugcagaucaauaggcaagugauuguagagcggggaaaccguaguggcuauuccgguauauucagcguugaagggaaaucuugcaucaaucgcuguuuuuacguggagcuaauuagaggcaggaaggaagagaccgaggucugguggacaucaaacaguaucguggucuucugcggaacuagcggcaccuaugggacaggauccuggcccgacggugcagauaucaaucucaugccuauuuga

SEQ ID NO: 136190 - RNA, 1410 nt, Artificial Sequence
  derived and/or modified sequence opt3 from neuraminidase__InfluenzaA__AAX56603
augaaccccaaucagaagaucauuaccauaggcagcgugucccugacaaucgccgcuauuugcuuccucaugcaaaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugcacaugaucgaaccccauaccguacacuucugaugaaugaauugggcgugcccuuucaccucgguacuagacagguuuguaucgccuggucaagcaguuccugccaugacgggaaggcuuggcugcacgugugugucaccggagaugacaaaaacgcaacagccucuuucauuuauaauggcaggcugguggauagcaucggcuccuggucaaagaaaauccuccggacccaggagagugaaugcguauguauuaacgggacgugcacuguugugaugacagacggaagcgcuucugguaaggccgauaccaaaauauuauuuaucgaggagggcaagauuguccacaucuccacucugucagggagcgcgcaacauguggaagagugcaguuguuacccucgcuauccaggagugagaugcgucuguagggacaacuggaagggcucuaaucggccgauaguugauauuaacgugaaagacuacuccaucguaagcucguacgugugcucuggucuugucggggacacaccccgcaagaaugauuccuucucaaguagccacuguuuggacccuaacaaugaagagggaggccauggcgugaaagggugggcauuugaugacggaaacgauguuuggaugggucgaaccaucuccgaaaagcugagaucuggcuaugagacguucaaagugauugagggguggagcaagccaaauucaaaacuacagaucaacaggcaggucauuguggaacggggaaaucguaguggcuacuccgguauauuuagcguagaggggaagucuugcaucaaccgcuguuucuauguugaacucauuagaggcaggaaggaggaaaccgaggugugguggacaucaaauaguaucgucguguuuugcggaacuagcggcaccuacgggacaggauccuggcccgacggugccgauaucaaccugaugccuauuuga

SEQ ID NO: 136191 - RNA, 1410 nt, Artificial Sequence; identical to SEQ ID NO: 136161
  derived and/or modified sequence opt3 from neuraminidase__InfluenzaA__AAX57647

SEQ ID NO: 136192 - RNA, 1410 nt, Artificial Sequence; identical to SEQ ID NO: 136151
  derived and/or modified sequence opt3 from neuraminidase__InfluenzaA__AAX57657

SEQ ID NO: 136193 - RNA, 1410 nt, Artificial Sequence; identical to SEQ ID NO: 136189
  derived and/or modified sequence opt3 from neuraminidase__InfluenzaA__AAX57667

SEQ ID NO: 136194 - RNA, 1410 nt, Artificial Sequence; identical to SEQ ID NO: 136170
  derived and/or modified sequence opt3 from neuraminidase__InfluenzaA__AAX57677

SEQ ID NO: 136195 - RNA, 1410 nt, Artificial Sequence
  derived and/or modified sequence opt3 from neuraminidase__InfluenzaA__AAX57687
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccggcaaucauagagagaaauaucacugaaauuguauauuuaaccaacacaaccaucgagaaggaaauuugucccaaacuggccgaguacaggaauuggucaaagccucagugcaacaucacuggguucgcgccauuuaguaaagacaauagcauacggcuauccgcuggaggugauauuugggugacacgcgagcccuaugucucuugugacccugauaagugcuaccaauucgcccucggccaggggaccacgcugaacaauggacauucgaacgacacugugcacgaucgaaccccauaucguacacuucugaugaaugaauugggcguucccuuucaucucgguacuagacagguguguaucgcauggucaagcaguuccugccacgacgggaaggccuggcugcaugucugugugaccggagaugacgagaacgcuacagcaucuuucauuuacgauggcaggcugguagacagcaucggcuccuggaguaaaaagauccuccggacccaggaaucagagugcguuuguauuaaugggacgugcacuguggucaugacagauggaagcgccucugguaaagcugacaccaagauauuauuuaucgaggaaggcaaaauugugaacaucuccacucugucagggagcgcccaacacguggaggaaugcaguuguuauccucgcuacccaggagucagaugcguuuguagggauaacuggaagggcucuaaucggccgauaguggacauuaacguaaaggacuacuccaucgugagcucguaugucugcucuggucuugugggggauacaccccgcaaaaaugacuccuucucaaguagccacuguuuggauccuaacaaugaggaaggaggccauggcguuaaggggugggcguuugacgauggaaacgacguguggaugggucgaaccaucuccgagaaacugagaucuggcuacgagacguucaaggucauugaaggguggagcaaaccaaauucaaagcuacagaucaacaggcaagugauuguagagcggggaaaucguaguggcuauuccgguauauuuagcguugaagggaaaucuugcaucaaccgcuguuucuacguggagcucauuagaggcaggaaggaagagaccgaggucugguggacaucaaauaguaucguggucuuuugcggaacuagcggcaccuaugggacaggauccuggcccgauggugcagacaucaaccugaugccuauuuga

SEQ ID NO: 136196 - RNA, 1410 nt, Artificial Sequence
  derived and/or modified sequence opt3 from neuraminidase__InfluenzaA__AAX57697
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggaccauuccaucgugagcucguacgucugcucuggucuugugggggacacccccaggaaaaaugauuccuucucaaguagccacuguuuggacccuaacaaugaggaaggaggccauggcguuaaggggugggccuuugaugacggaaacgauguguggaugggucgaacgaucuccgagaaacugagaucuggcuaugagaccuucaaggucauugaaggguggagcaaaccaaauucaaagcuacagaucaaccgccaggugauuguagagcggggaaaucguaguggcuacuccgguauauuuagcguugaagggaaaucuugcaucaaccgcuguuucuauguggagcucauuagaggcaggaaggaagagacagaggucugguggacuucaaauaguaucguggucuuuugcggaaccagcggcacauacgggacuggauccuggcccgacggugcggauaucaaccugaugccuauuuga

SEQ ID NO: 136197 - RNA, 1410 nt, Artificial Sequence
  derived and/or modified sequence opt3 from neuraminidase__InfluenzaA__AAX57707
augaaccccaaucagaagaucauuaccauaggcagcgugucccugacaaucgccgcuauuugcuuccucaugcaaaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacaccccgcaagaaugaucgauucuccucaagucacuguuuggacccuaacaaugaagagggaggccauggcguuaaagggugggcguuugaugacggaaacgauguguggauggguagaaccaucagcgaaaagcugagguccggcuaugagacguucaaagucauugagggguggucuaagccaaauagcaaacuacagaucaaccgucaggugauuguagaacggggaaaucgcucaggcuacagugguauauuuuccguugaggggaagaguugcaucaacagauguuucuauguggaacucauuaggggccggaaggaggaaaccgaggucugguggacaucuaauucaaucguggucuuuugcggaacuagcggcaccuacgggacaggaagcuggcccgacggugcagauaucaaccugaugccuauuuga

SEQ ID NO: 136198 - RNA, 1410 nt, Artificial Sequence; identical to SEQ ID NO: 136170
  derived and/or modified sequence opt3 from neuraminidase__InfluenzaA__AAX57717

SEQ ID NO: 136199 - RNA, 1410 nt, Artificial Sequence; identical to SEQ ID NO: 136189
  derived and/or modified sequence opt3 from neuraminidase__InfluenzaA__AAX57726

SEQ ID NO: 136200 - RNA, 1410 nt, Artificial Sequence; identical to SEQ ID NO: 136189
  derived and/or modified sequence opt3 from neuraminidase__InfluenzaA__AAX57737

SEQ ID NO: 136201 - RNA, 1410 nt, Artificial Sequence; identical to SEQ ID NO: 136077
  derived and/or modified sequence opt3 from neuraminidase__InfluenzaA__AAX57747

SEQ ID NO: 136202 - RNA, 1410 nt, Artificial Sequence; identical to SEQ ID NO: 136077
  derived and/or modified sequence opt3 from neuraminidase__InfluenzaA__AAX57757

SEQ ID NO: 136203 - RNA, 1410 nt, Artificial Sequence
  derived and/or modified sequence opt3 from neuraminidase__InfluenzaA__AAX57767
augaaccccaaucagaagaucauuaccauaggcagcgugucccugacaaucgccacuauuugcuuccucaugcaaaucgcuauucuugucacgaccguuacacugcacuuuaaacaguacgaguguaacccuccaccgaauaaccaggugauguugugcgaacccacuaucauagagagaaauaucaccgaaauuguauauuuaacaaacaccacuaucgagaaggaaauuuguccuaaacuggcagaguacaggaauuggucuaagccacagugcaacaucacaggguucgcccccuuuucaaaagacaauaguauacggcuaagcgcgggaggugauauuugggugacccgcgagccuuaugucuccugugacccagauaagugcuaccaauucgcucucggccaggggacgacucugaacaauggacauucuaacgacaccgugcacgaucgaacacccuaucguacucuucugaugaaugaauugggcguuccuuuucaucucgguaccaaacagguguguaucgccuggucgucaagcaguugccacgacgggaaggcauggcugcaugucugugugacaggagaugacgagaacgccaccgcuuccuucauuuacaauggcagacugguagauucuaucggcagcugguccaagaaaauccucaggacgcaggaaucagagugcguuuguauuaacgggacuugcacaguggucaugaccgacggaagugcaagcgguaaggccgauacuaaaauauuauuuaucgaggaaggcaagauugugcacacaucucugcuuuccgggucagcucaacacguggaggaaugcagcuguuauccacgguacccgggaguccgcugcguuuguagagacaacuggaagggcaguaauaggcccaucguggauauaaacguaaaagacuacucuauuguguccagcuaugucugcucggguuuggugggggacaccccucggaagaaugauucuuccucaaguagccauugucuggacccaaacaaugaggaaggaggccacggcguuaaagggugggccuucgaugacggaaacgauguguggaugggucgcacgaucuccgagaagcuacgaucuggcuacgagaccuuuaaagucaucgaaggguggagcaagcccaauucaaaacuccagauuaacagacaggugaucguagacaggggaaaucggaguggcuauuccgguauuuucagcguugaggggaagucuugcauaaaccguuguuuuuacguggaacugauccgcggcagaaagcaggagacagaaguccuuuggacuucaaauaguauuguggucuucugcggaaccagcggcacauaugggacuggauccuggccugauggugcggacaucaaccugaugccaaucuga

SEQ ID NO: 136204 - RNA, 1410 nt, Artificial Sequence
  derived and/or modified sequence opt3 from neuraminidase__InfluenzaA__AAX57777
augaaccccaaucagaagaucauuaccauaggcagcgugucccugaucauugccacaaucugcuuccucaugcaaauugcuauccuugucacuacgguuacccugcacuuuaaacaguacgaguguaacucuccuccaaauaaccaggugauguugugcgaaccgacaauaaucgagagaaauauuacugaaaucguauauuuaaccaacacaaccauugagaaggaaaucugucccaaacuggcagaguacaggaauuggucaaagccucagugcaacauaacuggguucgccccauuuaguaaagacaauagcauucggcuauccgcgggaggugauaucugggugacacgcgagcccuaugucucuugugacccugauaagugcuaccaauucgcucucggccaggggaccacgcugaacaauggacauucgaacgacacugugcacgaucgaaccccauaucguacacuucugaugaaugaauugggcguucccuuucaucucgguacuaaacagguguguauugccuggucaagcaguuccugccacgacgggaaggcauggcugcaugucugugugaccggagaugacgagaacgccacagcuucuuucaucuacaauggcagacugguagauagcaucggcuccuggucaaagaaaauucucaggacccaggaaagugagugcguuuguauaaacgggacgugcacuguggucaugacagacggaagcgcaucugguaaggccgauaccaaaaucuuauuuauugaggaaggcaagaucgugcacacuuccucacugagcgggagugcucaacacguggaggaaugcucuuguuauccucgguacccaggaguccgcugcguuuguagagacaacuggaagggcuccaauaggccgauaguggauauuaacguaaaagacuacagcaucgugucgucuuaugucugcuccggucuugugggggacacaccccggaagaaugauucaaguagcuccucucauuguuuggacccuaacaaugaggaaggaggccacggcguuaaagggugggccuucgaugacggaaacgauguguggaugggucgcaccaucagcgagaagcugcgaucaggcuacgagacguuuaaagucauugaaggguggaguaagccaaauuccaaacuacagaucaacagacaggugauuguagacaggggaaaucggagcggcuauucugguauauucucaguugaggggaagaguugcaucaaccguuguuuuuacguggaacucauucgcggcagaaagcaggagaccgaaguccuguggacaagcaauuccaucguggucuucugcggaacuucuggcaccuaugggacaggaucguggcccgauggugcggacaucaaccuuaugccuauuuga

SEQ ID NO: 136205 - RNA, 1410 nt, Artificial Sequence
  derived and/or modified sequence opt3 from neuraminidase__InfluenzaA__AAX57787
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccggcaaucauagagagaaauaucacugaaauuguauauuuaaccaacacaaccaucgagaaggaaauuugucccaaacuggccgaguacaggaauuggucaaagccucagugcaacaucacuggguucgcgccauuuaguaaagacaauagcauacggcuauccgcuggaggugauauuugggugacacgcgagcccuaugucucuugugacccugauaagugcuaccaauucgcccucggccaggggaccacgcugaacaauggacauucgaacgacacugugcacgaucgaaccccauaucguacacuucugaugaaugaauugggcguucccuuucaucucgguacuagacagguguguaucgcauggucaagcaguuccugccacgacgggaaggccuggcugcaugucugugugaccggagaugacgagaacgcuacagcaucuuucauuuacaauggcaggcugguagauagcaucggcuccuggaguaaaaagauccuccggacccaggaaucagagugcguuuguauuaacgggacgugcacuguggucaugacagacggaagcgccucugguaaagcuaacaccaagauauuauuuaucgaggaaggcaaaauugugaauaucuccacucugucagggagcgcccaacacguggaggaaugcaguuguuauccucgcuacccaggagucagaugcguuuguagggauaacuggaagggcucuaaucggccgauaguggacauuaacguaaaggauuacuccaucgugagcucguaugucugcucuggucuugugggggacacaccccgcaaaaaugacuccuucucaaguagccacuguuuggauccuaacaaugaggaaggaggccauggcguuaaggggugggcguuugacgauggaaacgacguguggaugggucgaaccaucuccgagaaauucagaucuggcuacgagacguuuaaggucauugaaggguggagcaaaccaaauucaaagcugcagaucaacaggcaagugauuguagagcggggaaaucguaguggcuauuccgguauauucagcguugaagggaaaucuugcaucaaccgcuguuuuuacguggagcuaauuagaggcaggaaggaagagaccgaggucugguggacaucaaauaguaucguggucuucugcggaacuagcggcaccuaugggacaggauccuggcccgauggugcagacaucaaccucaugccuauuuga

SEQ ID NO: 136206 - RNA, 1410 nt, Artificial Sequence; identical to SEQ ID NO: 136077
  derived and/or modified sequence opt3 from neuraminidase__InfluenzaA__AAX57797

SEQ ID NO: 136207 - RNA, 1410 nt, Artificial Sequence; identical to SEQ ID NO: 136077
  derived and/or modified sequence opt3 from neuraminidase__InfluenzaA__AAX57807

SEQ ID NO: 136208 - RNA, 1410 nt, Artificial Sequence
  derived and/or modified sequence opt3 from neuraminidase__InfluenzaA__AAX57817
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucuccucauggaguaagaaaauccucaggacgcaggaaagcgagugcguuuguauuaacggcacuugcacaguggucaugaccgacgggucugcauccggaaaggccgauacuaaaauauuauuuaucgaggaagguaagauugugcacacaucaagccugaguggcucugcucaacacguggaggaaugcuccuguuauccucgguacccagggguccgcugcguuuguagagacaacuggaagggaagcaauaggccgaucguggauauaaacguaaaagacuacucgauugugucuuccuaugucugcucaggccuugugggugacacgccccggaagaaugauaguagcuccucuagccauuguuuggacccuaacaaugaggaagggggacacggcguuaaaggcugggccuucgaugacgggaacgauguguggaugggacgcaccaucucagagaagcugcgaagugguuacgagaccuuuaaagucaucgaaggcugguccaagccaaauagcaaacuacagauuaacagacaggugaucguagacagggggaaucggucuggauauucaggcauuuucaguguugaggguaagagcugcauaaaccguuguuuuuacguggaacucauccgcgggagaaagcaggagacagaaguccuguggacuuccaauucuauuguggucuucugcggcaccucgggaacauauggcacugggagcuggcccgauggagcggacaucaaccuuaugccuaucuga

SEQ ID NO: 136209 - RNA, 1410 nt, Artificial Sequence; identical to SEQ ID NO: 136077
  derived and/or modified sequence opt3 from neuraminidase__InfluenzaA__AAX57837

SEQ ID NO: 136210 - RNA, 1410 nt, Artificial Sequence
  derived and/or modified sequence opt3 from neuraminidase__InfluenzaA__AAX57847
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacaucccugcuuucagggagcgcucaacacguggaggaaugcaguuguuauccucgguacccaggaguccgcugcguuuguagagacaacuggaagggcucuaauaggccgaucguggauauaaacguaaaagacuacuccauugugagcucguaugucugcucugguuuggugggggacacgccccggaagaaugauuccucaaguagcucccauugucuggacccuaacaaugaggaaggaggccacggcguuaaagggugggccuucgaugacggaaacgauguguggaugggucgcaccaucucugagaagcuacgaagcggcuacgagaccuuuaaagucaucgaaggguggucaaagccaaauaguaaacuccagauuaacagacaggugaucguagacaggggaaaucgguccggcuauagcgguauuuucucuguugagucaaagaguugcauaaaccguuguuuuuacguggaacugauccgcgggagaaagcaggagacagaaguccuuuggacuagcaauuccauuguggucuucugcggcaccucuggaacauauggcacugggucguggcccgauggagcggacaucaaccugaugccuaucuga

SEQ ID NO: 136211 - RNA, 1410 nt, Artificial Sequence
  derived and/or modified sequence opt3 from neuraminidase__InfluenzaA__AAX57857
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaccaucgagagaaauauaacagaaaucguauauuuaaccaacacuacaauugagaaggaaaucugucccaaacuggcagaguacaggaauuggucaaagccucagugcaacauuaccggguucgccccauuuaguaaagacaauagcauccggcuauccgcgggaggugauauaugggugacgcgcgagcccuaugucucuugugacccugauaagugcuaccaauucgcucucggccaggggacuacccugaacaauggacauucgaacgacacagugcacgaucgaacuccauaucguacccuucugaugaaugaauugggcguucccuuucaucucgguacaaaacagguguguauugccuggucaagcaguuccugccacgacgggaaggcauggcugcaugucugugugaccggagaugacgagaacgccacggcuucuuucaucuacaauggcagacugguagauagcauuggcuccuggucaaagaaaauccucaggacucaggaaagugagugcguuuguaucaacgggacaugcaccguggucaugacugacggaagcgcaucugguaaggccgauacaaaaauuuuauuuauagaggaaggcaagaucgugcacaccuccucacugagcgggagugcucaacacguggaggaaugcucuuguuauccucgguacccaggaguccgcugcguuuguagagacaacuggaagggcuccaauaggccgauuguggauaucaacguaaaagacuacagcauagugucgucuuaugucugcuccggucuugugggggacacgccccggaagaaugauucaaguagcuccucucauuguuuggacccuaacaaugaggaaggaggccacggcguuaaagggugggccuucgaugacggaaacgauguguggaugggucgcaccauuagcgagaagcugcgaucaggcuacgagacauuuaaagucaucgaaggguggaguaagccaaauuccaaacuacagaucaacagacaggugauuguagacaggggaaaucggagcggcuauucugguaucuucucaguugaggggaagaguugcauuaaccguuguuuuuacguggaacucauacgcggcagaaagcaggagacugaaguccuguggaccagcaauuccaucguggucuucugcggaacaucuggcacuuaugggaccggaucguggcccgauggugcggacauuaaccuuaugccuaucuga

SEQ ID NO: 136212 - RNA, 1410 nt, Artificial Sequence; identical to SEQ ID NO: 136077
  derived and/or modified sequence opt3 from neuraminidase__InfluenzaA__AAX57867

SEQ ID NO: 136213 - RNA, 1410 nt, Artificial Sequence
  derived and/or modified sequence opt3 from neuraminidase__InfluenzaA__AAX57877
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacguaaaagacuacagcauugugucgucuuaugucugcuccggucuugugggggacacgccccggaagaaugauucaaguagcuccucucauuguuuggacccuaacaaugaggaaggaggccacggcguuaaagggugggccuucgaugacggaaacgauguguggaugggucgcaccaucagcgagaagcugcgaucaggcuacgagaccuuuaaagucaucgaaggguggaguaagccaaauuccaaacuacagauuaacagacaggugaucguagacaggggaaaucggagcggcuauucugguauuuucucaguugaggggaagaguugcauaaaccguuguuuuuacguggaacucauccgcggcagaaagcaggagacagaaguccuguggacuagcaauuccauuguggucuucugcggaaccucuggcacauaugggacuggaucguggcccgauggugcggacaucaaccuuaugcauaucuga

SEQ ID NO: 136214 - RNA, 1410 nt, Artificial Sequence; identical to SEQ ID NO: 136077
  derived and/or modified sequence opt3 from neuraminidase__InfluenzaA__AAX57887

SEQ ID NO: 136215 - RNA, 1410 nt, Artificial Sequence
  derived and/or modified sequence opt3 from neuraminidase__InfluenzaA__AAX57897
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacguaaaagacuacagcauugugucgucuuaugucugcuccggucuugugggggacacgccccggaagaaugauucaaguagcuccucucauuguuuggacccuaacaaugaggaaggaggccacggcguuaaagggugggccuucgauagcggaaacgacguguggaugggucgcaccaucucagagaagcugcgaaguggcuacgagaccuuuaaagucaucgaagggugguccaagccaaauagcaaacuacagauuaacagacaggugaucguagauaggggaaaucggucuggcuauucagguauuuucaguguugagggcaagagcugcauaaaccguuguuuuuacguggaacucauccgcgggagaaagcaggagacagaaguccuguggacuuccaauucuauuguggucuucugcggaaccucgggcacauaugggacuggaagcuggcccgacggugcggauaucaaccuuaugccuaucuga

SEQ ID NO: 136216 - RNA, 1410 nt, Artificial Sequence
  derived and/or modified sequence opt3 from neuraminidase__InfluenzaA__AAX57907
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacguaaaagacuacagcauugugucgucuuaugucugcuccggucuugugggggacacgccccggaagaaugauucaaguagcuccucucauuguuuggacccuaacaaugaggaaggaggccacggcguuaaagggugggccuucgaugacggaaacgauguguggaugggucgcaccaucagcgagaagcugcgaucaggcuacgagaccuuuaaagucaucgaaggguggaguaagccaaauuccaaacuacagaugaacagacaggugauuguagacaggggaaaucggagcggcuauucugguaucuucucaguugaggggaagaguugcauuaaccguuguuuuuacguggaacucauacgcggcagaaagcaggagacagaaguccuguggacuagcaauuccaucguggucuucugcggaaccucuggcacauaugggacuggaucguggcccgauggugcggacauuaaccuuaugccuaucuga

SEQ ID NO: 136217 - RNA, 1410 nt, Artificial Sequence; identical to SEQ ID NO: 136077
  derived and/or modified sequence opt3 from neuraminidase__InfluenzaA__AAX57917

SEQ ID NO: 136218 - RNA, 1410 nt, Artificial Sequence; identical to SEQ ID NO: 136077
  derived and/or modified sequence opt3 from neuraminidase__InfluenzaA__AAX57927

SEQ ID NO: 136219 - RNA, 1410 nt, Artificial Sequence
  derived and/or modified sequence opt3 from neuraminidase__InfluenzaA__AAX57937
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaaugguauauuuaacaaacaccacuauugagaaggaaaucugucccaaacuggcagaguacaggaauuggucaaagccucagugcaacauuacaggguucgccccauuuaguaaagacaauagcauccggcuauccgcgggaggugauauaugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguauugccuggucaagcaguuccugccacgacgggaaggcauggcugcaugucugugugacaggagaugacgagaacgccaccgcuucuuucaucuacaauggcagacugguagauagcauuggcuccuggucaaagaaaauccucaggacgcaggaaagugagugcguuuguaucaacgggacuugcacaguggucaugaccgacggaagcgcaucugguaaggccgauacuaaaauuuuauuuauagaggaaggcaagaucgugcacacaucccugcuuucagggagcgcucaacacguggaggaaugcaguuguuauccucgguacccaggaguccgcugcguuuguagagacaacuggaagggcucuaauaggccgauuguggauaucaacguaaaagacuacuccauagugagcucguaugucugcucugguuuggugggggacacuccccggaagaaugauuccucaaguagcucccauugucuggacccuaacaaugaggaaggaggccacggcguuaaagggugggccuucgaugacggaaacgauguguggaugggucgcacgauuucugagaagcuacgaagcggcuacgagaccuuuaaagucaucgaaggguggucaaagccaaauaguaaacuccagaucaacagacaggugauuguagacaggggaaaucgguccggcuauagcgguaucuucucuguugaggggaagucaugcauuaaccguuguuuuuacguggaacugauacgcggcagaaagcaggagacagaaguccuuuggaccaguaauagcaucguggucuucugcggaaccuccggcacauaugggacuggaucuuggcccgauggugcggacauuaaccugaugaggaucuga

SEQ ID NO: 136220 - RNA, 1410 nt, Artificial Sequence
  derived and/or modified sequence opt3 from neuraminidase__InfluenzaA__AAX57947
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggucacggaaaauccuccgcacgcaggaaagugagugcguuuguauuaacgggacuugcacaguggucaugaccgacggaagcgcaucugguaaggccgauacuaaaauauuauuuaucgaggaaggcaagauugugcacaucuccacacugucagggagcgcucaacacguggaggaaugcaguuguuauccuagauacccaggagucaggugcguuugucgggacaacuggaaaggcucuaaucgcccgauaguggauauuaacguaaaggacuacuccaucgccagcucguauaugugcucuggucuugugggggacacgccccgaaagaaugauuccuucucaaguagccauuguuuggacccuaacaaugaggaaggaggccacggcgucaaagggugggcguuugaugacggaaacgauguguggauggguagaaccaucuccgagaagcugaggucuggcuacgagaccuucaaaguuauugaaggguggagcaagccaaauucaaaacuacagaucaaccgucaggugauugucgagcggggaaaucgcaguggcuauuccgguauauuuagcguggaagggaagucuugcaucaacagauguuucuacguagagcucauuaggggccggaaagaagagacagagguuugguggacuucaaauaguaucguggucuuuugcggaaccagcggcacauaugggacuggauccuggcccgacggugcagauaucaaccugaugccuauuuga

SEQ ID NO: 136221 - RNA, 1410 nt, Artificial Sequence; identical to SEQ ID NO: 136161
  derived and/or modified sequence opt3 from neuraminidase__InfluenzaA__AAX76626

SEQ ID NO: 136222 - RNA, 1410 nt, Artificial Sequence
  derived and/or modified sequence opt3 from neuraminidase__InfluenzaA__AAX76646
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacaauaccgugcaugaccgaacaccauaccguacucuucugaugaacgaauugggcguucccuuucaccucgguaccagacagguguguaucgccuggucaagcagugggugccaugauggaaaggcauggcugcacgucugugugacaggcgacgauaaaaaugccaccgcuuccuucauuuauaacggcaggcugguagacucuaucgggagcugguccaagaaaauccuccggacgcaggagucagaaugcguuuguauuaacggaacuugcacaguggucaugaccgaugguagugcaagcggcaaggccgacacuaaaauauuauuuaucgaggaggggaagauugugcacaucucuacacuguccggaucagcucaacauguggaagagugcagcuguuacccucgcuauccaggcgucagaugcguuuguagggauaauuggaaggguaguaaccggccgauaguggacauuaauguaaaagauuacucuaucguguccagcuacgucugcucggggcuugugggagacacccccaggaagaacgacucuuucuccucaagucacuguuuggauccuaauaacgaagagggcggccaugggguuaaaggaugggccuuugacgaugguaaugacguguggaugggccgaacgaucagcgaaaagcugagauccggguaugagaccuucaaagucauugagggauggucuaagccaaacagcaaacuacagaucaaucgccaggugauuguagaacggggcaaccguucagguuacagugggauauuuuccguugagggcaagagcugcaucaaucgcuguuucuauguggaacucauuagaggaaggaaggaggaaacagaggucugguggacuucuaacucaaucguggucuuuugcggcaccagugggacauacggaacugguagcuggcccgauggcgcggacaucaaucugaugccuauuuga

SEQ ID NO: 136223 - RNA, 1410 nt, Artificial Sequence; identical to SEQ ID NO: 136151
  derived and/or modified sequence opt3 from neuraminidase__InfluenzaA__AAX76656

SEQ ID NO: 136224 - RNA, 1410 nt, Artificial Sequence; identical to SEQ ID NO: 136196
  derived and/or modified sequence opt3 from neuraminidase__InfluenzaA__AAX76666

SEQ ID NO: 136225 - RNA, 1410 nt, Artificial Sequence; identical to SEQ ID NO: 136077
  derived and/or modified sequence opt3 from neuraminidase__InfluenzaA__AAX76696

SEQ ID NO: 136226 - RNA, 1410 nt, Artificial Sequence
  derived and/or modified sequence opt3 from neuraminidase__InfluenzaA__AAX76736
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacugucagaguacaggaauuggaguaagccucagugcaacaucacaggguucgcaccauuuagcaaagacaauuccauacggcuaucugccggaggugauauuugggugacccgcgagcccuaugucucgugugacccugauaagugcuaccaauucgcgcucggccaggggacgacucugaacaauggacauucaaacgacaccgugcacgaucgaacaccauaucguacucuucugaugaaugaauugggcguucccuuucaucucgguaccaaacagguguguaucgcuuggagcaguuccucuugccacgacgggaaggccuggcugcaugucugugugacaggagaugacgagaacgcaaccgccagcuucauuuacaauggcagacugguagauuccaucggcucauggaguaagaaaauccucaggacgcaggaaagcgagugcguuuguauuaacgggacuugcacaguggucaugaccgacggaucugcuuccgguaaggcagauacuaaaauauuauuuaucgaggaaggcaagauugugcacaucucaacacugagccggagugcccaacacguggaggaaugcucuuguuauccucgcuacccaggggucagaugcguuuguagggacaacuggaagggauccaaucggccgauaguggauauuaacguaaaagaccauagcaucgugucgucuuacgucugcuccggccuugugggugacacccccaggaagaaugauucauucaguagcucccacuguuuggacccuaacaaugaggaagggggacauggcguuaaaggcugggcuuuugaugacgggaacgauguguggaugggacgaacgaucucugagaagcugagaagcgguuaugagaccuucaaagucauugaaggcuggucaaagccaaauaguaaacuacagaucaaccgccaggugauuguagagcgggggaaucguuccggauacagcggcauauuuucuguugaagguaagucaugcaucaaccgcuguuucuauguggagcucauuagagggaggaaggaagagacagaggucugguggaccaguaauagcaucguggucuuuugcggcacuuccggaacauacggcacugggucuuggcccgacggagccgauaucaaccugaugccuauuuga

SEQ ID NO: 136227 - RNA, 1410 nt, Artificial Sequence
  derived and/or modified sequence opt3 from neuraminidase__InfluenzaA__AAX76766
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgugggaggugauauuugggucacccgcgagcccuacgugucuugugacccugauaagugcuaucaauucgcgcucggccaggggacgacucugaacaauggacacucgaacgacaccguucaugaucgaacaccauaccguacucuucugaugaaugaauugggcgugcccuuucaccucgguaccagacaggucuguaucgcuuggucaagcaguuccugccaugacgggaaggccuggcugcacguguguguaacaggagaugacaaaaacgcaaccgccucuuucauuuauaauggcaggcugguugauagcaucggcuccuggucaaagaaaauccuccggacgcaggagagugaaugcguguguauuaacgggacuugcacagucgugaugaccgacggaagcgcuucugguaaggcagauacuaaaauauuauuuaucgaggagggcaagauugugcacaucuccacacugucagggagcgcccaacaugucgaagagugcaguuguuacccucgcuauccaggaguuagaugcguguguagggacaacuggaagggcucuaaucggccgauaguagauauuaacgugaaagacuacuccaucgucagcucguacgugugcucuggucuuguuggggacacgccccgcaagaaugauuccuucucaaguagccacuguuuggacccuaacaaugaagagggaggccauggcgugaaagggugggcuuuugaugacggaaacgaugucuggaugggucgaaccaucuccgaaaagcugagaucuggcuaugagaccuucaaagugauugagggguggagcaagccaaauucaaaacuacagaucaacaggcagguaauuguugaacggggaaaucguaguggcuacuccgguauauuuagcguggaggggaagucuugcaucaaccgcuguuucuaugucgaacucauuagaggcaggaaggaggaaacagaggugugguggacuucaaauaguaucgucguguuuugcggaaccagcggcacauacgggacuggauccuggcccgacggugccgauaucaaccugaugccuauuuga

SEQ ID NO: 136228 - RNA, 1410 nt, Artificial Sequence; identical to SEQ ID NO: 136153
  derived and/or modified sequence opt3 from neuraminidase__InfluenzaA__AAY18089

SEQ ID NO: 136229 - RNA, 1410 nt, Artificial Sequence
  derived and/or modified sequence opt3 from neuraminidase__InfluenzaA__AAY18099
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacaauaccgugcaugaccgaacaccauaccguacucuucugaugaacgaauugggcguucccuuucaccucgguaccagacagguguguaucgccuggucaagcaguuccugccaugaugggaaggcauggcugcacgucugugugacaggagacgauaaaaaugccaccgcuucuuucauuuauaacggcaggcugguagacagcaucggcuccuggucaaagaaaauccuccggacgcaggagagugaaugcguuuguauuaacgggacuugcacaguggucaugaccgauggaagcgcaucugguaaggccgacacuaaaauauuauuuguggaggagggcaagaucgugcacauuuccacacugucagggagcgcucaacaugucgaagagugcaguuguuacccucgcuauccaggaguuagaugcguguguagggauaauuggaagggcucuaaccggccgaucguagacauaaaugugaaagauuacuccauugucagcucguacgugugcucuggucuuguuggggacacgccccgcaagaacgacuccuucucaaguagccacuguuuggauccuaauaacgaagagggaggccauggcgugaaagggugggccuuugacgauggaaaugacgucuggaugggucgaaccaucuccgaaaagcugagaucuggcuaugagaccuucaaagugaucgagggguggagcaagccaaacucaaaacuacagauuaauaggcagguaaucguugaacggggaaaccguaguggcuacuccgguauuuuuagcguggaggggaagucuugcauaaaucgcuguuucuaugucgaacucaucagaggcaggaaggaggaaacagaggugugguggacuucaaacaguauugucguguuuugcggaaccagcggcacauacgggacuggauccuggcccgauggugcggacaucaaucugaugccuaucuga

SEQ ID NO: 136230 - RNA, 1410 nt, Artificial Sequence
  derived and/or modified sequence opt3 from neuraminidase__InfluenzaA__AAY18109
augaaccccaaucagaagaucauuaccauaggcagcgugucccugacaaucgccacuauuugcuuccucaugcaaaucgcuauucuugucacgacccugacauugcacuuuaaacaguacgaguguaacucuccuccaaauaaccagguuauguuaugcgaaccggcaaucauagagagaaauaucacugaaauuguguaucugaccaacacaaccaucgagaaggaaaaaugucccaagcuagccgaguacaggaauuggucaaaaccucagugcaacauuacuggguucgcgccauuuaguaaggacaauagcauccggcucuccgcuggaggugauauauggguaacacgcgagcccuaugugucuugugacccugauaagugcuaccaauucgcccugggccaggggaccacgcuuaacaauggacauucgaacgacacuguccacgaucgaaccccauaucguacacuguugaugaaugaacucggcgugcccuuucaucuggguacuagacagguuuguauugcauggucaagcaguuccugccacgacgggaaagccuggcugcaugugugugucaccggagaugacgagaacgcuacagcaucuuucaucuacaauggcaggcucguggauagcauuggcuccuggucaaagaaaaucuuacggacccaggaaagugagugcguauguaucaacgggacgugcacuguugugaugacagacggaagcgccucugguaaggcugauaccaaaauucuguuuauagaggaaggcaagaucgucaacauuuccacucuuucagggagcgcccaacacguggaggaaugcaguuguuauccucgcuacccaggagugagaugcgucuguagggacaauuggaagggcucuaaccggccgaucguugauauaaaugugaaagacuacuccauuguaagcucguaugugugcucugguuuggucggggacacaccccgcaagaacgauuccuucucaaguagccacugucuggacccuaauaacgaggaaggaggccauggcgugaaagggugggcguuugaugacggaaaugauguuuggaugggucgaaccaucuccgagaagcuaagaucuggcuacgagacguucaaagugaucgaaggguggagcaagccaaacucaaaacuccagauuaauaggcaggucaucguggagcggggaaaccguaguggcuauuccgguauuuuuagcguagaagggaagucuugcauaaaucgcuguuucuacguugagcugaucagaggcaggaaggaagagaccgaggugugguggacaucaaacaguauugucguguuuugcggaacuagcggcaccuaugggacaggauccuggcccgacggugcagauaucaaucuuaugccuaucuga

SEQ ID NO: 136231 - RNA, 1410 nt, Artificial Sequence; identical to SEQ ID NO: 136189
  derived and/or modified sequence opt3 from neuraminidase__InfluenzaA__AAY18119

SEQ ID NO: 136232 - RNA, 1410 nt, Artificial Sequence
  derived and/or modified sequence opt3 from neuraminidase__InfluenzaA__AAY18129
augaaccccaaucagaagaucauuaccauaggcagcgugucccugacaaucgccacuauuugcuuccucaugcaaaucacgauucuugucaccacaguuacucugcacuuuaaacaguacgaguguaacucuccuccaaauaaccaggugauguugugcgaaccgaccaucauagagagaaauaucacagaaauuguauauuuaaccaacacuacaaucgagaaggaaauuugucccaaacuggcugaguacaggaauuggucaaagccucagugcaacaucaccggguucgcaccauuuaguaaagacaauagcauacggcuauccgccggaggugauauuugggugacgcgcgagcccuaugucucuugugacccugauaagugcuaccaauucgcgcucggccaggggacuacccugaacaauggacauucgaacgacacagugcacgaucgaacuccauaucguacccuucugaugaaugaauugggcguucccuuucaucucgguacaagacagguguguaucgcuuggucaagcaguuccugccacgacgggaaggccuggcugcaugucugugugaccggagaugacaaaaacgcaacggccucuuucauuuacaauggcaggcugguagauagcaucggcuccuggucaaagaaaauccuccggacucaggagagugaaugcguuuguauuaacgggacaugcaccguggucaugacugacggaagcgcuucugguaaggcagauacaaaaauauuauuuaucgaggagggcaagauuauccacauauccacccugucagggagcgcccaacacguggaagagugcaguuguuauccucgcuacccaggagugagaugcgucuguagggacaacuggaagggcucuaaucggccgauuguugauaucaacgugaaagacuacuccaucguaagcucguaugugugcucuggucuugucggggacacgccccgcaagaaugauuccucaaguagcucccauuguuuggacccuaacaaugaagagggaggccacggcgugaaagggugggcuuucgaugacggaaacgauguuuggaugggucgaaccauuucugaaaagcugagaagcggcuacgagacauuuaaagugaucgagggguggucaaagaguaauuccaaacuacagauuaacaggcaggucauaguggaacggggaaaucguagcggcuauucugguaucuucucaguagaggggaagaguugcauuaaccgcuguuuuuacguugaacucaucagaggcaggaaggaggaaacugaggugugguggaccagcaauuccaucgucguguucugcggaacaucuggcacuuaugggaccggaucguggccagacggugccgauauuaaccugaugcccauauga

SEQ ID NO: 136233 - RNA, 1410 nt, Artificial Sequence
  derived and/or modified sequence opt3 from neuraminidase__InfluenzaA__AAY18139
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagagggaaauuugucccaagcuggcagaguaucggaauuggucaaaaccucagugcaacaucacaggguucgccccauuuaguaaggacaauagcauacgccuauccgcgggaggugauauuugggugacccgagagcccuacgucucuugugacccugauaaaugcuaucaauucgcucucggccaggggacgacucugaacaaucgucacucgaacgacaccgugcaugauagaacaccauacaggacucuucugaugaaugaauugggaguucccuuucaccucggcacccgccagguguguaucgccuggucaagcaguuccugccaugacgguaaggcauggcugcacgucugugugacaggggaugacaagaacgccaccgcuucuuucauuuauaauggacggcugguagauagcaucggcuccuggaguaaaaagauccucagaacgcaggagagugaaugcguuuguauuaacggcacuugcacaguggucaugaccgacgggagcgcaucuggaaaagccgauacuaagauauuauuuaucgaggaggguaaaauugugcacaucuccacacugucaggcagcgcucaacauguggaagagugcaguuguuacccuagguauccagggguccggugcguuugucgcgacaacuggaagggaucuaaucgaccgauaguggauauuaacguaaaggacuacuccaucgugagcucguacgucugcucuggccuugugggugacacccccagaaagaaugauuccucaaguagcucccacuguuuggacccuaacaaugaagaagggggacauggcguuaaaggcugggccuucgaugacgggaacgauguguggaugggaaggacgaucucugagaaacugcggagcgguuaugagaccuuuaaggucauugagggcuggucaaaaccaaauaguaagcuacagaucaaccgucaggugauuguagaacgcgggaauagauccggauacagcggcauauucucuguugaggguaaaucaugcaucaacagguguuuuuauguggaacucauucgggggcgaaaggaggaaacagaggucugguggacuucaaauagcaucguggucuucugcggcaccuccggaacauacggcacugggucuuggcccgacggagcggauaucaaccugaugccuauuuga

SEQ ID NO: 136234 - RNA, 1410 nt, Artificial Sequence
  derived and/or modified sequence opt3 from neuraminidase__InfluenzaA__AAY18149
augaaccccaaucagaagaucauuaccauaggcagcgugucccugacaaucgccacuauuugcuuccucaugcagaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacaaaaacgccaccgcuucuuucauuuauaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauugugcacaucuccacacugucagggagcgcucaacauguggaagagugcaguuguuacccucgcuauccaggagucagaugcguuuguagggacaacuggaagggcucuaaucggccgaccguggauauaaacguaaaagacuacuccauugugagcucguacgucugcucuggucuugugggggacacgccccgcaagaaugauuccucaaguagcucccacuguuuggacccuaacaaugaagagggaggccauggcguuaaagggugggccuucgaugacggaaacgauguguggaugggucgaaccaucucugaaaagcugagaagcggcuaugagacauuuaaagucaucgagggguggucaaagccaaauaguaaacuacagauuaacaggcaagugaucguagaacggggaaaucguuccggcuacagcgguauuuucucuguugaggggaagucaugcauaaaccgcuguuuuuauguggaacucaucagaggcaggaaggaggaaacugaggucugguggaccaguaauagcauuguggucuucugcggaacauccggcacuuacgggaccggaucuuggcccgacggugcggauaucaaccugaugccuaucuga

SEQ ID NO: 136235 - RNA, 1410 nt, Artificial Sequence
  derived and/or modified sequence opt3 from neuraminidase__InfluenzaA__AAY18159
augaaccccaaucagaagaucauuaccauaggcagcgugucccugaucauugccacaaucugcuuccucaugcaaauugcuauccuugucacuacgguuacccugcacuuuaaacaguacgaguguaacucuccuccaaauaaccaggugauguugugcgaaccgacaauaaucgagagaaauauuacugaaaucguauauuuaaccaacacaaccauugagaaggaaaucugucccaaacuggcagaguacaggaauuggucaaagccucagugcaacauaacuggguucgccccauuuaguaaagacaauagcauucggcuauccgcgggaggugauaucugggugacacgcgagcccuaugucucuugugacccugauaagugcuaccaauucgcucucggccaggggaccacgcugaacaauggacauucgaacgacacugugcacgaucgaaccccauaucguacacuucugaugaaugaauugggcguucccuuucaucucgguacuaaacagguguguauugccuggucaagcaguuccugccacgacgggaaggcauggcugcaugucugugugaccggagaugacgagaacgccacagcuucuuucaucuacaauggcagacugguagauagcaucggcuccuggucaaagaaaauucucaggacccaggaaagugagugcguuuguauaaacgggacgugcacuguggucaugacagacggaagcgcaucugguaaggccgauaccaaaaucuuauuuauugaggaaggcaagaucgugcacacuuccucacugagcgggagugcucaacacguggaggaaugcucuuguuauccucgguacccaggaguccgcugcguuuguagagacaacuggaagggcuccaauaggccgauaguggauauuaacguaaaagacuacagcaucgugucgucuuaugucugcuccggucuugugggggacacaccccggaagaaugauucaaguagcuccucucauuguuuggacccuaacaaugaggaaggaggccacggcguuaaagggugggccuucgaugacggaaacgauguguggaugggucgcaccaucagcgagaagcugcgaucaggcuacgagacguuuaaagucauugaaggguggaguaagccaaauuccaaacuacagaucaacagacaggugauuguagacaggggaaaucggagcggcuauucugguauauucucaguugaggggaagaacugcaucaaucguuguuuuuacguggaacucauucgcggcagaaagcaggagaccgaaguccuguggacaaguaacagcaucguggucuucugcggaacuuccggcaccuaugggacaggaucuuggcccgauggugcggacaucaaucuuaugccuauuuga

SEQ ID NO: 136236 - RNA, 1410 nt, Artificial Sequence; identical to SEQ ID NO: 136077
  derived and/or modified sequence opt3 from neuraminidase__InfluenzaA__AAY18179

SEQ ID NO: 136237 - RNA, 1410 nt, Artificial Sequence; identical to SEQ ID NO: 136077
  derived and/or modified sequence opt3 from neuraminidase__InfluenzaA__AAY18189

SEQ ID NO: 136238 - RNA, 1410 nt, Artificial Sequence
  derived and/or modified sequence opt3 from neuraminidase__InfluenzaA__AAY18199
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaagaaaauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcagggaguuaaaggcugggcuuucgaugacggcaacgauguguggauggggcgcaccauuagcgagaaguugcacucaggauacgagacauuuaaagucaucgaagguuggaguaauccaaacuccaagcugcagauuaaucgacaggugauaguagacagaggcaacaggagcggguauucuggaaucuucucaguugagggcaaaaguuguauuaaucggugcuuuuacguggaacuaauccguggucgcaagcaagagacugaaguccucuggaccagcaacuccaucguggucuucugugggacaucuggcacuuauggaaccggcucguggcccgauggggccgacauuaaucugaugccuauauga

SEQ ID NO: 136239 - RNA, 1410 nt, Artificial Sequence; identical to SEQ ID NO: 136180
  derived and/or modified sequence opt3 from neuraminidase__InfluenzaA__AAY18588

SEQ ID NO: 136240 - RNA, 1410 nt, Artificial Sequence; identical to SEQ ID NO: 136161
  derived and/or modified sequence opt3 from neuraminidase__InfluenzaA__AAY18614

SEQ ID NO: 136241 - RNA, 1410 nt, Artificial Sequence
  derived and/or modified sequence opt3 from neuraminidase__InfluenzaA__AAY27846
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacaccccgcaagaaugauuccuucucaaguagccacuguuuggacccuaacaaugaagagggaggccauggcguuaaagggugggcguuugaugacggaaacgauguguggaugggucgaaccaucuccgaaaagcugagaucuggcuaugagacguucaaagucauugagggguggagcaagccaaauucaaaacuacagaucaacaggcaagugauuguagaacggggaaaucguaguggcuacuccgguauauuuagcguugaggggaagucuugcaucaaccgcuguuucuauguggaacucauuagaggcaggaaggaggaaaccgaggucugguggacaucaaauaguaucguggucuuuugcggaacuagcggcaccuacgggacaggauccuggcccgacggugcagauaucaaccugaugccuauuuga

SEQ ID NO: 136242 - RNA, 1410 nt, Artificial Sequence
  derived and/or modified sequence opt3 from neuraminidase__InfluenzaA__AAY27856
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccuggcaagugcuaucaauucgcucucgggcagggaacgacucugaacaauggccacucgaacgauaccgugcaugaccgaacaccauaccguacucuucugaugaaugaauuggguguucccuuucaccucgggaccagacagguguguaucgccuggucaagcaguuccugccaugauggaaaggcauggcugcacgucugugugacaggcgacgauaaaaacgccaccgcuucuuucauuuauaauggcaggcugguagacagcaucggguccuggucaaagaaaauccuccggacgcaggagagugaaugcguuuguauuaacggaacuugcacaguggucaugaccgaugguagcgcaucuggcaaggccgacacuaaaauauuauuuaucgaggaggggaagauugugcacaucuccacacugucaggaagcgcucaacauguggaagagugcaguuguuacccucgcuauccaggcgucagaugcguuuguagggauaacuggaaggguucuaaucggccgauaguggacauuaacguaaaagauuacuccaucgugagcucguacgucugcucugggcuugugggagacacccccaggaagaaugacuccucaaguagcucccacuguuuggauccuaacaaugaagagggcggccaugggguuaaaggaugggccuucgacgaugguaacgacguguggaugggccgaacgaucucugaaaagcugagaagcggguaugagaccuuuaaagucauugagggauggucaaagccaaauaguaaacuacagaucaaccgccaggugauuguagaacggggcaaucguuccgguuacagcgggauauucucuguugagggcaagucaugcaucaaccgcuguuuuuauguggaacucauuagaggaaggaaggaggaaacagaggucugguggaccaguaauagcaucguggucuucugcggcacuuccgggacauacggaacugguucuuggcccgauggcgcggacaucaaccugaugccuauuuga

SEQ ID NO: 136243 - RNA, 1410 nt, Artificial Sequence; identical to SEQ ID NO: 136153
  derived and/or modified sequence opt3 from neuraminidase__InfluenzaA__AAY27866

SEQ ID NO: 136244 - RNA, 1410 nt, Artificial Sequence
  derived and/or modified sequence opt3 from neuraminidase__InfluenzaA__AAY27962
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacccccaggaaaaaugauuccuucucaaguagccauuguuuggacccuaacaaugaggaaggaggccacggcguuaaggggugggccuuugaugacggaaacaauguguggaugggucgaacgaucuccgagaaacugagaucuggcuacgagaccuucaaggucauugaaggguggagcaaaccaaacucaaagcuacagacaaaucgccaggugaucguagagcggggaaaccguaguggcuauuccgguauuuuuagcguugaagggaaaucuugcauaaaucgcuguuucuacguggagcucaucagaggcaggaaggaagagacugaggucugguggaccucaaacaguauuguggucuuuugcggaacaagcggcacuuaugggaccggauccuggcccgauggugcggacaucaaucugaugccuaucuga

SEQ ID NO: 136245 - RNA, 1410 nt, Artificial Sequence
  derived and/or modified sequence opt3 from neuraminidase__InfluenzaA__AAY27997
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacaauaccgugcaugaccgaacaccauaccguacucuucugaugaacgaaaugggcguucccuuucacuuggguaccagacagguguguaucgccuggucaagcaguuccugccaugaugggaaggcauggcuccacgucugugugacaggagacgauaaaaaugccaccgcuucuuucauuuauaacggcaggcugguagacagcaucggcuccuggucaaagaaaauccugcggacgcaggagagugaaugcguuuguauuaacgggacuugcacaguggucaugaccgauggaagcgcaucugguaaggccgacacuaaaauacucuuuaucgaggagggcaagauugugcacaucuccacauuaucagggagcgcucaacauguggaagagugcaguuguuacccucgcuauccaggagucagaugcguuuguagggauaauuggaagggcucuaaccggccgauaguggacauuaauguaaaagauuacuccaucgugagcucguacgucugcucuggucuggugggggacacccccaggaagaacgacuccuucucaaguagccacugucuugauccuaauaacgaagagggaggccauggcguuaaagggugggccuuugacgauggaaaugacguguggaugggucgaacgaucuccgaaaaguugagaucuggcuaugagaccuucaaagucauugagggguggagcaagccaaacucaaaacugcagaucaaucgccaggugauuguagaacggggaaaccguaguggcuacuccgguauauuuagcguugaggggaagucuugcaucaaucgcuguuucuauguggaacuaauuagaggcaggaaggaggaaacagaggucugguggacuucaaacaguaucguggucuuuugcggaaccagcggcacauacgggacuggauccuggcccgauggugcggacaucaaucucaugccuauuuga

SEQ ID NO: 136246 - RNA, 1410 nt, Artificial Sequence; identical to SEQ ID NO: 136151
  derived and/or modified sequence opt3 from neuraminidase__InfluenzaA__AAY28007

SEQ ID NO: 136247 - RNA, 1410 nt, Artificial Sequence; identical to SEQ ID NO: 136196
  derived and/or modified sequence opt3 from neuraminidase__InfluenzaA__AAY28017

SEQ ID NO: 136248 - RNA, 1410 nt, Artificial Sequence; identical to SEQ ID NO: 136151
  derived and/or modified sequence opt3 from neuraminidase__InfluenzaA__AAY28268

SEQ ID NO: 136249 - RNA, 1410 nt, Artificial Sequence
  derived and/or modified sequence opt3 from neuraminidase__InfluenzaA__AAY28278
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauugugcacacauccaagcugucaggcagcgcucaacauguggaggaaugcaguuguuauccuagauacccaggggucaggugcguuugucgggacaauuggaaaggaucuaaccgcccgaucguggauauaaacguaaaggacuacuccauugugagcucguaugucugcucuggccuugugggugacacgccccggaaaaaugauuccucaaguagcucccacuguuuggacccuaacaaugaggaagggggacauggcguuaagggcugggccuucgaugacgggaacgauguguggaugggaagaaccaucucugagaaaagcaggucagguuacgagaccuuuaaggucaucgaaggcuggaguaaaccaaauuccaagcugcagauuaaccgacaggugaucguagagcgugggaaucgcagcggauauucuggcauuuucucaguugaagguaagaguugcauaaacagauguuuuuacguggagcuaaucagggggcggaaacccgaaacagaggucugguggacuagcaauuccauuguggucuucugcggcaccucuggaacauauggcacugggucguggccugacggagcggauaucaaccucaugccaaucuga

SEQ ID NO: 136250 - RNA, 1410 nt, Artificial Sequence; identical to SEQ ID NO: 136165
  derived and/or modified sequence opt3 from neuraminidase__InfluenzaA__AAY28288

SEQ ID NO: 136251 - RNA, 1410 nt, Artificial Sequence
  derived and/or modified sequence opt3 from neuraminidase__InfluenzaA__AAY28298
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacaaaaacgccaccgcuucuuucauuuauaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauugugcacaucuccacacugucagggagcgcucaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacuccccgcaagaaugauuccucaaguagcucccacuguuuggacccuaacaaugaagagggaggccauggcguuaaagggugggccuucgaugacggaaacgauguguggaugggucgaacgaucucugaaaagcugagaagcggcuaugagaccuuuaaagucauugagggguggucaaggccaaauaguaagcuacagaucaaccgucaggugauuguagaacggggaaaucgcuccggcuacagcgguauauucucuguugaggggaaaucaugcaucaacagauguuuuuauguggaacucauuaggggccggaaggaggaaacagaggucugguggaccaguaauagcaucguggucuucugcggaaccuccggcacauacgggacuggaucuuggcccgacggugcggauaucaaccugaugccuauuuga

SEQ ID NO: 136252 - RNA, 1410 nt, Artificial Sequence; identical to SEQ ID NO: 136182
  derived and/or modified sequence opt3 from neuraminidase__InfluenzaA__AAY28308

SEQ ID NO: 136253 - RNA, 1410 nt, Artificial Sequence
  derived and/or modified sequence opt3 from neuraminidase__InfluenzaA__AAY28318
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcgcaguggucaugacagacggaagcgccucugguaaagcugauaccaagauauuauuuaucgaggaaggcaaaauugugcacaucuccacucugucagggagcgcccaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacaccccgcaaaaaugauuccuucucaaguagccauuguuuggacccuaacaaugaggaaggaggccacggcguuaaggggugggcguuugaugacggaaacgauguguggaugggucgaaccaucuccgagaaacugagaucuggcuacgagacguucaaggucauugaaggguggagcaaaccaaauucaaagcuacagaccaacaggcaagugaucguagagcggggaaaucguaguggcuauuccgguauuuuuagcguugaagggaaaucuugcauaaaccgcuguuucuacguggagcucaucagaggcaggaaggaagagacagaggucugguggacuucaaauaguauuguggucuuuugcggaaccagcggcacauaugggacuggauccuggcccgacggugcagauaucaaccugaugccuaucuga

SEQ ID NO: 136254 - RNA, 1410 nt, Artificial Sequence
  derived and/or modified sequence opt3 from neuraminidase__InfluenzaA__AAY28338
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccggcaaucauagagagaaauaucacugaaauuguauauuuaaccaacacaaccaucgagaaggaaauuaggcccaaacuggccgaguaccggaauuggucaaagccucaguguaacaucacuggguucgcgccauuuaguaaagacaauagcauacgccuauccgcuggaggugauauuugggugacacgagagcccuaugucucuugcgacccugauaaguguuaccaauucgcccucggccaggggaccacgcugaacaauggacauucgaacgacacugugcacgaucguaccccauauagaacacuucugaugaaugaauugggcguucccuuucaucucgguacucgacaggugugcaucgcauggucaagcaguuccugucacgacgggaaggccuggcugcaugucugcgugaccggagaugacgagaacgcuacagcaucuuucauuuacaauggccggcugguagauagcaucggcuccuggaguaaaaagauccuccgcacccaggaaucagaguguguuugcauuaacgggacguguacuguggucaugacagacggaagcgccucugguaaagcugauaccaagauauuauuuaucgaggaaggcaaaauugugaacaucuccacucugucagggagcgcccaacacguggaggaaugcaguugcuauccuagauacccaggagucagguguguuugccgggacaauuggaagggcucuaaccgcccgauaguggauauuaauguaaaggacuacuccaucgugagcucguaugucuguucuggucuugugggggacacacccaggaaaaacgauuccuucucaaguagccacugcuuggacccuaauaacgaggaaggaggccauggcguuaaggggugggcguuugaugacggaaaugauguguggauggguagaaccaucuccgagaaacugaggucuggcuacgagacguucaaggucauugaaggguggagcaaaccaaacucaaagcuacagaucaaucgucaggugauuguagagcggggaaaccgcaguggcuauuccgguauauuuagcguugaagggaaaucuuguaucaauagaugcuucuacguggagcucauuaggggccggaaggaagagaccgaggucugguggacaucaaacaguaucguggucuuuuguggaacuagcggcaccuaugggacaggauccuggcccgacggugcagauaucaaucugaugccuauuuga

SEQ ID NO: 136255 - RNA, 1410 nt, Artificial Sequence; identical to SEQ ID NO: 136161
  derived and/or modified sequence opt3 from neuraminidase__InfluenzaA__AAY28348

SEQ ID NO: 136256 - RNA, 1410 nt, Artificial Sequence; identical to SEQ ID NO: 136077
  derived and/or modified sequence opt3 from neuraminidase__InfluenzaA__AAY28358

SEQ ID NO: 136257 - RNA, 1410 nt, Artificial Sequence; identical to SEQ ID NO: 136161
  derived and/or modified sequence opt3 from neuraminidase__InfluenzaA__AAY28388

SEQ ID NO: 136258 - RNA, 1410 nt, Artificial Sequence; identical to SEQ ID NO: 136166
  derived and/or modified sequence opt3 from neuraminidase__InfluenzaA__AAY28398

SEQ ID NO: 136259 - RNA, 1410 nt, Artificial Sequence; identical to SEQ ID NO: 136180
  derived and/or modified sequence opt3 from neuraminidase__InfluenzaA__AAY28408

SEQ ID NO: 136260 - RNA, 1410 nt, Artificial Sequence; identical to SEQ ID NO: 136153
  derived and/or modified sequence opt3 from neuraminidase__InfluenzaA__AAY28505

SEQ ID NO: 136261 - RNA, 1410 nt, Artificial Sequence
  derived and/or modified sequence opt3 from neuraminidase__InfluenzaA__AAY28524
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacuacaccgugcaugaccgaacaccauaucguacucuucugaugaaugaauugggcguucccuuucaccucgguaccagacagguguguaucgccuggucaagcaguuccugccaugaugggaaggcauggcugcacgucugugugacaggagacgauaaaaacgccaccgcuucuuucauuuacaauggcaggcugguagacagcaucggcuccuggucaaagaaaauccuccggacgcaggagagugaaugcguuuguauuaacgggacuugcacaguggucaugaccgauggaagcgcaucugguaaggccgacacuaaaauauuauuuaucgaggagggcaagauugugcacaucuccacacugucagggagcgcucaacauguggaagagugcaguuguuauccucgcuacccaggagucagaugcguuuguagggauaacuggaagggcucuaaucggccgauaguggacauuaacguaaaagauuacuccaucgugagcucguaugucugcucuggucuugugggggacacccccaggaagaaugacuccucaaguagcucccacuguuuggauccuaacaaugaagagggaggccauggcguuaaagggugggccuucgacgauggaaacgacguguggaugggucgaacgaucucugaaaagcugagaagcggcuacgagaccuuuaaagucauugagggguggucaaagccaaauaguaaacuacagaucaaccgccaggugauuguagaacggggaaaucguuccggcuauagcgguauauucucuguugaggggaagucaugcaucaaccgcuguuuuuacguggaacucauuagaggcaggaaggaggaaacagaggucugguggaccaguaauagcaucguggucuucugcggaacuuccggcacauaugggacuggaucuuggcccgauggugcggacaucaaccugaugccuauuuga

SEQ ID NO: 136262 - RNA, 1410 nt, Artificial Sequence; identical to SEQ ID NO: 136151
  derived and/or modified sequence opt3 from neuraminidase__InfluenzaA__AAY28534

SEQ ID NO: 136263 - RNA, 1410 nt, Artificial Sequence
  derived and/or modified sequence opt3 from neuraminidase__InfluenzaA__AAY28544
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccuaacaagugcuaucaauucgcucucggccaggggacgacucugaauaacggacacucgaaugauaccgugcaugaccgaacaccauaccguacucuucugaugaacgaauugggcguucccuuucaccucgguaccagacagguguguaucgccuggucaagcaguuccugccaugaugggaaggcauggcugcacgucugugugacaggagacgauaaaaaugccaccgcuucuuucauuuauaacggcaggcugguagacagcaucggcuccuggucaaagaaaauccuccggacgcaggagagugaaugcguuuguauuaacgggacuugcacaguggucaugaccgauggaagcgcaucugguaaggccgacacuaaaauauuauuuaucgaggagggcaagauugugcacaucuccacacugucagggagcgcucaacauguggaagagugcaguuguuacccucgcuauccaggagucagaugcguuuguagggauaauuggaagggcucuaaccggccgauaguggacauuaauguaaaagauuacuccaucgugagcucguacgucugcucuggucuugugggggacacccccaggaagaacgacuccuucucaaguagccacuguuuggauccuaauaacgaagagggaggccauggcguuaaagggugggccuuugacgauggaaaugacguguggaugggucgaacgaucuccgaaaagcugagaucuggcuaugagaccuucaaagucauugagggguggagcaagccaaacucaaaacuacagaucaaucgccaggugauuguagaacggggaaaccguaguggcuacuccgguauauuuagcguugaggggaagucuugcaucaaucgcuguuucuauguggaacucauuagaggcaggaaggaggaaacagaggucugguggacuucaaacaguaucguggucuuuugcggaaccagcggcacauacgggacuggauccuggcccgauggugcggacaucaaucugaugccuauuuga

SEQ ID NO: 136264 - RNA, 1410 nt, Artificial Sequence; identical to SEQ ID NO: 136077
  derived and/or modified sequence opt3 from neuraminidase__InfluenzaA__AAY28554

SEQ ID NO: 136265 - RNA, 1410 nt, Artificial Sequence
  derived and/or modified sequence opt3 from neuraminidase__InfluenzaA__AAY28564
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacaaaaacgccaccgcuucuuucauuuauaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauugugcacaucuccacacugucagggagcgcucaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacgccccgcaagaaugauuccucaaguagcucccacuguuuggacccuaacaaugaagagggaggccauggcguuaaagggugggccuucgaugacggaaacgauguguggaugggucgaaccaucucugaaaagcugagaagcggcuaugagaccuuuaaagucauugagggguggucaaggccaaauaguaagcuacagaucaaccgucaggugauuguagaacggggaaaucgcuccggcuacagcgguauauucucuguugagucaaaaaguugcaucaacagauguuuuuauguggaacucauuagggggcggaaggaggaaacagaggucugguggacuagcaauuccaucguggucuucugcggcaccucuggaacauacggcacugggucguggcccgacggagcggauaucaaccugaugccuauuuga

SEQ ID NO: 136266 - RNA, 1410 nt, Artificial Sequence; identical to SEQ ID NO: 136151
  derived and/or modified sequence opt3 from neuraminidase__InfluenzaA__AAY28574

SEQ ID NO: 136267 - RNA, 1410 nt, Artificial Sequence; identical to SEQ ID NO: 136165
  derived and/or modified sequence opt3 from neuraminidase__InfluenzaA__AAY28584

SEQ ID NO: 136268 - RNA, 1410 nt, Artificial Sequence; identical to SEQ ID NO: 136077
  derived and/or modified sequence opt3 from neuraminidase__InfluenzaA__AAY28594

SEQ ID NO: 136269 - RNA, 1410 nt, Artificial Sequence
  derived and/or modified sequence opt3 from neuraminidase__InfluenzaA__AAY28611
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacguaaaagacuacagcauugugucgucuuaugucugcuccggucuugugggggacacgccccggaagaaugauucaaguagcuccucucauuguuuggacccuaacaaugaggaaggaggccacggcguuaaagggugggccuucgaugacggaaacgauguguggaugggucgcaccaucagcgagaagcugcgaucaggcuacgagaccuuuaaagucaucgaaggguggaguaagccaaauuccaaacuacagauuaacagacaggugaucguagacaggggaaaucggagcggcuauucugguauuuucucaguugaggggaagaguugcauaaaccguuguuuuuacguggaacucauccgcggcagaaagcaggagacagaaguccuguggacuagcaauuccauuguggucuucugcggaaccucuggcacauaugggacuggaucguggcccgauggugcggacaucaaccuuaugccuaucuga

SEQ ID NO: 136270 - RNA, 1410 nt, Artificial Sequence; identical to SEQ ID NO: 136182
  derived and/or modified sequence opt3 from neuraminidase__InfluenzaA__AAY28651

SEQ ID NO: 136271 - RNA, 1410 nt, Artificial Sequence
  derived and/or modified sequence opt3 from neuraminidase__InfluenzaA__AAY44613
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaaaucgcagaguauaggaauuggucaaagccucagugcaacauaacaggguucgccccauuuaguaaagacaauagcauucggcuguccgcgggaggugauaucugggugacccgcgagcccuacgucucuugugacccugauaagugcuaucaauucgcucuaggccaggggacgacucucaacaauggacacucgaacgacaccgugcaugaucgaacaccauaccguacucugcuuaugaaugaacugggcguucccuuucacuuggguaccagacagguguguauugccuggucaagcaguuccugccaugacgggaaggcauggcuccacgucugugugacaggagaugacaaaaacgccaccgcuucuuucaucuauaauggcaggcugguagauagcaucggcuccuggucaaagaaaauucugcggacgcaggagagugaaugcguuuguauaaacgggacuugcacaguggucaugaccgacggaagcgcaucugguaaggccgauacuaaaauccucuuuauugaggagggcaagaucgugcacauauccacauuaucagggagcgcucaacauguggaagagugcaguuguuacccucgcuauccaggagucagaugcguuuguagggacaacuggaagggcucuaaucggccgauuguggauaucaacguaaaagacuacuccaucgugagcucguacgucugcucuggucuggugggggacacccccaggaagaaugauuccucaaguagcucccacugucuugacccuaacaaugaagagggaggccauggcguuaaagggugggccuucgaugacggaaacgauguguggaugggucgaacgauuucugaaaaguugagaagcggcuaugagaccuuuaaagucaucgagggguggucaaagccaaauaguaaacugcagauuaaccgccaggugauaguagaacggggaaaucguuccggcuacagcgguaucuucucuguugaggggaagucaugcauuaaccgcuguuuuuauguggaacuaaucagaggcaggaaggaggaaacagaggucugguggaccaguaauagcaucguggucuucugcggaacuuccggcacauacgggacuggaucuuggcccgacggugcggauauuaaccucaugccuauauga

SEQ ID NO: 136272 - RNA, 1410 nt, Artificial Sequence; identical to SEQ ID NO: 136165
  derived and/or modified sequence opt3 from neuraminidase__InfluenzaA__AAY44624

SEQ ID NO: 136273 - RNA, 1410 nt, Artificial Sequence; identical to SEQ ID NO: 136187
  derived and/or modified sequence opt3 from neuraminidase__InfluenzaA__AAY44634

SEQ ID NO: 136274 - RNA, 1410 nt, Artificial Sequence; identical to SEQ ID NO: 136180
  derived and/or modified sequence opt3 from neuraminidase__InfluenzaA__AAY44644

SEQ ID NO: 136275 - RNA, 1410 nt, Artificial Sequence
  derived and/or modified sequence opt3 from neuraminidase__InfluenzaA__AAY44654
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacguaaaagacuacagcauugugucgucuuaugucugcuccggucuugugggggacacgccccggaagaaugauucaaguagcuccucucauuguuuggacccuaacaaugaggaaggaggccacggcguuaaagggugggccuucgaugacggaaacgauguguggaugggucgcaccaucagcgagaagcugcgaucaggcuacgagaccuuuaaagucaucgaaggguggaguaagccaaauuccaaacuacagauucauagacaggugaucguagacaggggaaaccggagcggcuauucugguauuuucucaguugaggggaagaguugcauaaaucguuguuuuuacguggaacucauccgcggcagaaagcaggagacagaaguccuguggacuagcaacuccauuguggucuucugcggaaccucuggcacauaugggacuggaucguggcccgauggugcggacaucaaucuuaugccuaucuga

SEQ ID NO: 136276 - RNA, 1410 nt, Artificial Sequence
  derived and/or modified sequence opt3 from neuraminidase__InfluenzaA__AAY44758
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuucaaauaaccaggugauguugugcgaaccaacuaucauagagagaaauaucaccgaaauuguauauuuaacaaacaccacuaucgagaaggaaauuuguccgaaacuggcagaguacaggaauuggaguaagccccagugcaaaaucacaggguucgccccuuuuagcaaggacaacuccauacggcuaucugcgggaggugauauuugggugacccgcgagccauaugucucgugugaccccgauaagugcuaccaauucgcucucggccaggggacgacucugaauaaccgacauucaaaugacaccgugcacgaucguacaccuuauagaacucuucugaugaacgaauugggaguuccauuucaucucggcaccaaacagguguguaucgccuggagcaguuccucuugccacgacgguaaggcauggcugcaugucugugugacagggcacgaugagaaugccaccgcuagcuucauuuacgacggaaggcugguagauuccaucggcucauggaguaaaaagauccuccggacgcaggaaagcgagugcguuuguauuaacggcacuugcacaguggucaugaccgacgggucugcauccggacgcgccgauacuaaaauauuauuuaucgaggaagguaagauugugcacacaucaaagcugagcggcagugcucaacauguggaggaaugcucuuguuaucccagauacccuggggucaggugcguuugucgggacaauuggaaaggauccaaccgcccaaucguggauauaaacguaaaggacuacagcauugugucgucuuaugucugcuccggccuugugggugacaccccgcggaaaaaugauucaaguagcuccucucacuguuuggaccccaacaaugaggaagggggacauggcguuaagggcugggccuucgaugacgggaacgauguguggaugggaagaacgaucagcgagaaaucaaggagugguuacgagaccuuuaaggucaucgaaggcugguccaaaccuaauagcaagcugcagauuaaccgacaggugaucguagagcgugggaaucgcucuggauauucaggcauuuucaguguugaagguaagagcugcauaaacagauguuuuuacguggagcuaaucagggggcggaaaccagaaacagaggucugguggacuuccaauucuauuguggucuucugcggcaccucgggaacauauggcacugggagcuggcccgacggagcggauaucaaccucaugccuaucuga

SEQ ID NO: 136277 - RNA, 1410 nt, Artificial Sequence; identical to SEQ ID NO: 136077
  derived and/or modified sequence opt3 from neuraminidase__InfluenzaA__AAY44778

SEQ ID NO: 136278 - RNA, 1410 nt, Artificial Sequence
  derived and/or modified sequence opt3 from neuraminidase__InfluenzaA__AAY44788
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacaucccugcuuucagggagcgcucaacacguggaggaaugcaguuguuauccucgguacccaggaguccgcugcguuuguagagacaacuggaagggcucuaauaggccgaucguggauauaaacguaaaagacuacuccauugugagcucguaugucugcucugguuuggugggggacacgccccggaagaaugauuccucaaguagcucccauugucuggacccuaacaaugaggaaggaggccacggcguuaaagggugggccuucgaugacggaaacgauguguggaugggucgcaccaucucugagaagcuacgaagcggcuacgagaucuuuaaagucauugaaggguggucaaagccaaauaguaaacuccagaucaacagacaggugauuguagacaggggaaaucgguccggcuauagcgguauauucucuguugaggggaagucaugcaucaaccguuguuuuuacguggaacugauucgcggcagaaagcaggagaccgaaguccuuuggacaaguaauagcaucguggucuucugcggaacuuccggcaccuaugggacaggaucuuggcccgauggugcggacaucaaccugaugccuauuuga

SEQ ID NO: 136279 - RNA, 1410 nt, Artificial Sequence; identical to SEQ ID NO: 136153
  derived and/or modified sequence opt3 from neuraminidase__InfluenzaA__AAY44909

SEQ ID NO: 136280 - RNA, 1410 nt, Artificial Sequence; identical to SEQ ID NO: 136180
  derived and/or modified sequence opt3 from neuraminidase__InfluenzaA__AAY45649

SEQ ID NO: 136281 - RNA, 1410 nt, Artificial Sequence
  derived and/or modified sequence opt3 from neuraminidase__InfluenzaA__AAY46374
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuuacaagugcuaucaauucgcucucggccaggggacgacucugaauaaccgacauucgaaugauaccgugcacgaccguacaccauacagaacucuucugaugaacgaauugggaguucccuuucaucucggcaccaaacagguguguaucgccuggucaagcaguuccugccacgaugguaaggcauggcugcaugucugugugacagggcacgacgagaaugccaccgcuucuuucauuuaugauggaaggcugguagacagcaucggcuccuggaguaaaaagauccuccggacgcaggaaucagagugcguuuguauuaacggcacuugcacaguggucaugaccgaugggagcgcaucuggacgcgccgacacuaaaauauuauuuaucgaggaagguaagauugugcacacauccaagcugucaggcagcgcucaacauguggaggaaugcaguuguuacccuagauacccaggggucaggugcguuugucgggauaauuggaaaggaucuaaccgcccgaucguggacauaaacguaaaggauuauuccauugugagcucguacgucugcucuggccuugugggugacacgccccggaaaaaugacuccucaaguagcucccacuguuuggauccuaacaaugaggaagggggacauggcguuaagggcugggccuucgacgaugggaacgacguguggaugggaagaaccaucucugagaaaagcaggucagguuaugagaccuuuaaggucaucgaaggcuggaguaaaccaaauuccaagcugcagauuaaccgacaggugaucguagagcgugggaauaugagcggauacucuggcauuuucucaguugaagguaagaguugcauaaaccgcuguuuuuauguggagcuaaucagagggaggaaacaggaaacagaggucugguggacuagcaauuccauuguggucuucugcggcaccucuggaacauacggcacugggucguggcccgauggagcggacaucaaccucaugccuaucuga

SEQ ID NO: 136282 - RNA, 1410 nt, Artificial Sequence
  derived and/or modified sequence opt3 from neuraminidase__InfluenzaA__AAY46384
augaaccccaaucagaagaucauuaccauaggcagcgugucccugacaaucgccacuauuugcuuccucaugcagaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacgccgugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacaccccgcaagaaugauuccuucucaaguagccacuguuuggacccuaacaaugaagagggaggccauggcguuaaagggugggcguuugaugacggaaacgauguguggaugggucgaaccaucuccgaaaagcugagaucuggcuaugagacguucaaagucauugagggguggagcaagccaaauucaaaacuacagaucaacaggcaagugauuguagaacggggaaaucguaguggcuacuccgguauauuuagcguugaggggaagucuugcaucaaccgcuguuucuauguggaacucauuagaggcaggaaggaggaaaccgaggucugguggacaucaaauaguaucguggucuuuugcggaacuagcggcaccuacgggacaggauccuggcccgacggugcagauaucaaccugaugccuauuuga

SEQ ID NO: 136283 - RNA, 1410 nt, Artificial Sequence
  derived and/or modified sequence opt3 from neuraminidase__InfluenzaA__AAY46394
augaaccccaaucagaagaucauuaccauaggcagcgugucccugacaaucgccacuauuugcuuccucaugcaaaucgcuauucuuaucacgaccgucacacugcacuuuaaacaguacgaguguaacucuccuccaaauaaccagguuauguugugcgaaccgacuauaaucgagagaaauauuaccgaaaucguguauuuaacaaacaccacuauugagaaggaaaucugucccaaacuggcagaguacaggaauuggucaaagccucagugcaacauaacaggguucgccccauuuaguaaagacaauagcauucggcuauccgcgggaggugauaucuggguaacccgcgagcccuaugugucuugugacccugauaagugcuaccaauucgcucucggccaggggacgacucugaacaauggacauucgaacgacaccguccacgaucgaacaccauaucguacucuucugaugaaugaauugggcgugcccuuucaucucgguaccaagcagguuuguauugccuggucaagcaguuccugccacgacgggaaagcauggcugcaugugugugucacaggagaugacgagaacgccaccgcuucuuucaucuacaauggcagacugguggauagcaucggcuccuggucaaagaaaauucucaggacgcaggaaagugagugcguauguauaaacgggacuugcacaguugugaugaccgacggaagcgcaucugguaaggccgauacuaaaaucuuauuuauugaggaaggcaagaucguccacacauccucacugagcgggagugcucaacacguggaggaaugcucuuguuauccucgguacccaggagugcgcugcgucuguagagacaacuggaagggcuccaauaggccgauaguugauauuaacgugaaagacuacagcaucguaucgucuuaugugugcuccggucuugucggggacacgccccggaagaaugauucaaguagcuccucucauuguuuggacccuaacaaugaggaaggaggccacggcgugaaagggugggccuucgaugacggaaacgauguuuggaugggucgcaccaucagcgagaagcugcgaucaggcuacgagaccuuuaaagugauugaaggguggaguaagccaaauuccaaacuacagaucaacagacaggucauuguggacaggggaaaucggagcggcuauucugguauauucucaguagaggggaagaguugcaucaaccguuguuuuuacguugaacucauucgcggcagaaagcaggagacagaagugcuguggacuagcaauuccaucgucguguucugcggaaccucuggcacauaugggacuggaucguggcccgauggugcggacaucgaucuuaugccuauuuga

SEQ ID NO: 136284 - RNA, 1410 nt, Artificial Sequence
  derived and/or modified sequence opt3 from neuraminidase__InfluenzaA__AAY46419
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuauccuggagagaaauauaaccgaaaucguauaucuaacaaacaccacuauugagaaggaaaucuguccgaaacucgcagaguacaggaauuggucaaagccccagugcaaaauuacaggguucgccccuuuuaguaaggacaacagcauccggcuguccgcgggaggugauauaugggugacccgcgagccauaugucucuugugaccccgauaagugcuaccaauucgcucuuggccaggggacgacucugaauaaccgacauucgaaugacaccgugcacgaucguacaccuuauagaacuuugcucaugaacgaacugggaguuccauuucaucugggcaccaaacagguguguauugccuggucaagcaguuccugccacgacgguaaggcauggcuccaugucugugugacagggcacaaugagaacgccaccgcuucuuucaucuacggaggcagguuaguagauagcauuggcuccuggaguaaaaagauccugcggacgcaggaaucagagugcguuuguaucaaugggacuugcacaguggucaugaccgacggaagcgcaucuggucgcgccgauacuaaaauucuuuuuauagaggaaggcaagaucauucacaucucccaauugucagggagcgcucagcauguggaggaaugcaguuguuaucccagauacccuggagugaggugcgucugucgggacaacuggaagggcucuaaccgcccaauaguugauauuaaugugaaagacuacuccaucguaagcucguaugugugcucuggucuggucggggauacaccgcgaaagaacgacuccucaaguagcucccacugucuaaaucccaacaaugaggaaggaggccauggcgugaaagggugggccuucgacgauggaaacgacguuuggauggguagaaccaucucugagaaguuuaggagcggcuacgagacguucaaagugauugaaggguggucaaagccuaauaguaaacuccagaucaaccggcaggucauuguggaucgugacaaucgcuccggauauagcggcauauuuucuguagaggguaagucaugcaucaacagauguuucuacguugaacugauuagggggcggaagcaagagaccgaagugugguggacaaguaauagcaucgucguguuuugcggcacuuccggaaccuauggcacagggucuuggccagauggagcggacaucaaccuuaugcccauuuga

SEQ ID NO: 136285 - RNA, 1410 nt, Artificial Sequence
  derived and/or modified sequence opt3 from neuraminidase__InfluenzaA__AAY47016
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggaacgcucaacacguggaggaaugcagcuguuauccucgcuacccaggagucagaugcguuuguagggacaauuggaagggcaguaaccggccgauaguggauauuaauguaaaggacuacucuaucguguccagcuaugucugcucgggucuugugggggacacccccaggaaaaacgauucuuucuccucaagucauuguuuggacccuaauagcgaggaaggaggccacggcguuaaggggugggccuuugaugacggaaacgauguguggaugggucgaacgaucuccgagaaacugagaucuggcuacgagaccuucaaggucauugaaggguggagcaaaccaaauucaaagcuacagaucaaccgccaggugauuguagagcggggaaaucguaguggcuauuccgguauauuuagcguugaagggaaaucuugcaucaaccgcuguuucuacguggagcucauuagaggcaggaaggaagagacagaggucugguggacuucaaauaguaucguggucuuuugcggaaccagcggcacauaugggacuggauccuggcccgacggugcggauaucaaccugaugccuauuuga

SEQ ID NO: 136286 - RNA, 1410 nt, Artificial Sequence
  derived and/or modified sequence opt3 from neuraminidase__InfluenzaA__AAY47055
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacaucccugcuuucagggagcgcucaacacguggaggaaugcaguuguuauccucgguacccaggaguccgcugcguuuguagagacaacuggaagggcucuaauaggccgaucguggauauaaacguaaaagacuacuccauugugagcucguaugucugcucugguuuggugggggacacuccccggaagaaugauuccucaaguagcucccauugucuggacccuaacaaugaggaaggaggccacggcguuaaagggugggccuucgaugacggaaacgauguguggaugggucgcacgaucucugagaagcuacgaagcggcuacgagaccuuuaaagucaucgaaggguggucaaagccaaauaguaaacuccagauuaacagacaggugaucguagacaggggaaaucgguccggcuauagcgguauuuucucuguugaggggaagucaugcauaaaccguuguuuuuacguggaacugauccgcggcagaaagcaggagacagaaguccuuuggaccaguaauagcauuguggucuucugcggaaccuccggcacauaugggacuggaucuuggcccgauggugcggacaucaaccuguuuccuaucuga

SEQ ID NO: 136287 - RNA, 1410 nt, Artificial Sequence
  derived and/or modified sequence opt3 from neuraminidase__InfluenzaA__AAY47078
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugaccaugauaagugcuaccaauucgcucucggccaggggacgacucugaacaauggacacucgaacgacaccgugcaugaucgaacaccuuaucguacucuucugaugaaugaauugggcguuccauuucaccucgguaccaaacagguguguaucgccuggucaagcaguuccugccaugacgggaaggcauggcugcacgucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacaucuccacacugucagggagcgcucaacauguggaggaaugcaguuguuauccccgguacccuggaguccgcugcguuuguagagacaacuggaagggcucuaauaggccaauaguggauauuaacguaaaagacuacuccaucgugagcucguaugucugcucuggucuugugggggacaccccgcggaagaaugauuccuucucaaguagccacuguuuggaccccaacaaugaggaaggaggccauggcguuaaagggugggccuuugaugacggaaacgauguguggaugggucgcacgaucuccgagaagcugcgaucuggcuacgagaccuucaaagucauugaaggguggagcaagccuaauucaaaacuacagaucaacagacaggugauuguagagaggggaaaucggaguggcuauuccgguauauuuagcguugaagggaagucuugcaucaaccguuguuucuacguggagcucauucgcggcagaaaggaagagacagaggucugguggacuucaaauaguaucguggucuuuugcggaaccagcggcacauaugggacuggauccuggccagacggugcggauaucaaccugaugcccauuuga

SEQ ID NO: 136288 - RNA, 1410 nt, Artificial Sequence
  derived and/or modified sequence opt3 from neuraminidase__InfluenzaA__AAY47088
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaagaaaauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagaccauagcaucgugucgucuuacgucuguuccggacuggugggcgacacgccccggaagaaugauucaaguagcuccucucacugccuugacccuaacaaugaggaaggugggcauggaguuaaaggcugggcuuucgaugacggcaacgauguguggauggggcgcaccauuagcgagaaguugcgaucaggauaugagacauuuaaagucaucgaagguuggaguaauccaaacuccaagcugcagauuaauagacaggugauaguagacaggggcaaccggagcggguacucuggaaucuucucaguugagggcaaaaguuguauuaaucguugcuuuuauguggaacuaauccgcgguagaaagcaggagacugaaguccucuggaccagcaacuccaucguggucuucugugggacaucuggcacuuacggaaccggcucguggcccgauggggccgacauuaaucugaugccuauauga

SEQ ID NO: 136289 - RNA, 1410 nt, Artificial Sequence; identical to SEQ ID NO: 136153
  derived and/or modified sequence opt3 from neuraminidase__InfluenzaA__AAY58319

SEQ ID NO: 136290 - RNA, 1392 nt, Artificial Sequence
  derived and/or modified sequence opt3 from neuraminidase__InfluenzaA__AAY59038
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacuaacgacaccgugcaugaucgaacaccauaucguacucugcuuaugaaugaacugggaguucccuuucacuugggcaccaaacagguguguaucgccuggucgucaagcaguugccaugacgguaaggcauggcuccacgucugugugacaggggaugacgagaacgccaccgcuuccuucauuuacaauggaagacugguagauucuaucggcagcugguccaagaaaauccugaggacgcaggaaucagagugcguuuguauuaacggcacuugcacaguggucaugaccgacgggagugcaagcggaaaggccgauacuaaaauacucuuuaucgaggaagguaagauugugcauacaucuccuuuauccggcucagcucaacacguggaggaaugcagcuguuauccacgguacccggggguccgcugcguuuguagagacaauuggaagggaaguaacaggcccaucguggauauaaacguaaaagacuacucuauuguguccagcuaugucugcucgggccuggugggugacaccccucggaagaaugauucuuccucaaguagccacugucuugacccaaacaaugaggaagggggacauggcguuaaaggcugggccuucgaugacgggaacgauguguggaugggacgcacgaucuccgagaaguugcgaucugguuacgagaccuuuaaagucaucgaaggcuggagcaagcccaauucaaaacugcagauuaacagacaggugaucguagacagggggaaucggaguggauauuccggcauuuucagcguugaggguaagucuugcauaaaccguuguuuuuacguggaacuaauccgcgggagaaagcaggagacagaaguccucuggacuucaaauaguauuguggucuucugcggcaccagcggaacauauggcacuggguccuggccugauggagcggacaucaaccugaugccaaucuga

SEQ ID NO: 136291 - RNA, 1410 nt, Artificial Sequence
  derived and/or modified sequence opt3 from neuraminidase__InfluenzaA__AAY64195
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuaucauagagagaaauaucaccgaaauuguauaucugacaaacaccacuaucgagaaggaaauuuguccgaaacuagcagaguacaggaauuggucaaagccccagugcaaaaucacaggguucgccccuuuuaguaaggacaacagcauacggcucuccgcgggaggugauauuugggugacccgcgagccauaugucucuugugaccccgauaagugcuaccaauucgcucugggccaggggacgacucuuaauaaccgacauucgaaugacaccgugcacgaucguacaccuuauagaacucuguugaugaacgaacucggaguuccauuucaucugggcaccaaacagguguguaucgccuggucaagcaguuccugccacgacgguaaggcauggcugcaugucugugugacagggcacgaugagaaugccaccgcuucuuucauuuacgacggaaggcucguagauagcaucggcuccuggaguaaaaagaucuuacggacgcaggaaucagagugcguuuguauuaacggcacuugcacaguggucaugaccgacgggagcgcaucuggacgcgccgauacuaaaauacuguuuaucgaggaagguaagauuauccacauaucccaacuuucaggcagcgcucagcauguggaggaaugcaguuguuaucccagauacccuggggugaggugcgucugucgggacaauuggaagggaucuaaccgcccaauuguugauaucaacgugaaagacuacuccaucguaagcucguaugugugcucuggcuuggucggugacacaccgcgaaagaaugauuccucaaguagcucccacugucugaaccccaauaacgaggaagggggacauggcgugaaaggcugggccuucgacgaugggaaugacguuuggaugggaagaaccauuucugagaaguuuaggagcgguuacgagacguucaaagugaucgaaggcuggucaaagccuaacaguaaacuacagauuaaucggcaggucauaguggaucgugacaaccgcuccggguauagcggaaucuuuucuguagagggcaagucaugcauuaauagauguuucuacguugaacucaucaggggucggaagcaagaggcggaagugugguggaccaguaacagcaucgucguguuuugcgggacauccggcacuuauggaaccggcucuuggccagauggggcagacauuaaucugaugcccauauga

SEQ ID NO: 136292 - RNA, 1410 nt, Artificial Sequence; identical to SEQ ID NO: 136151
  derived and/or modified sequence opt3 from neuraminidase__InfluenzaA__AAY64205

SEQ ID NO: 136293 - RNA, 1410 nt, Artificial Sequence; identical to SEQ ID NO: 136077
  derived and/or modified sequence opt3 from neuraminidase__InfluenzaA__AAY64215

SEQ ID NO: 136294 - RNA, 1410 nt, Artificial Sequence
  derived and/or modified sequence opt3 from neuraminidase__InfluenzaA__AAY64225
augaaccccaaucagaagaucauuaccauaggcagcgugucccugacaaucgccacuauuugcuuccucaugcagaucacgauucuugucaccacaguuacucugcacuuuaaacaguacgaguguaacccuccaccgaauaaccaggugauguugugcgaacccaccaucauagagagaaauaucacagaaauuguauauuuaaccaacacuacaaucgagaaggaaauuuguccuaaacuggcugaguacaggaauuggucuaagccacagugcaacaucaccggguucgcacccuuuucaaaagacaauaguauacggcuaagcgccggaggugauauuugggugacgcgcgagccuuaugucuccugugacccagauaagugcuaccaauucgcgcucggccaggggacuacccugaacaauggacauucuaacgacacagugcacgaucgaacucccuaucguacccuucugaugaaugaauugggcguuccuuuucaucucgguacaagacagguguguaucgcuuggucgucaagcaguugccacgacgggaaggccuggcugcaugucugugugaccggagaugacgagaacgcaacggccuccuucauuuacaauggcaggcugguagauucuaucggcagcugguccaaaaagauccuccggacucaggaaucagagugcguuuguauuaacgggacaugcaccguggucaugacugacggaagugcuagcgguaaagcagauacaaagauauuauuuaucgaggaaggcaaaauugugcacaucucuacccuguccgggucagcccaacacguggaggaaugcagcuguuauccacgcuacccgggagucagaugcguuuguagggacaacuggaagggcaguaaucggcccauaguggauauuaacguaaaggacuacucuaucguguccagcuaugucugcucgggucuugugggggacacgccucgcaaaaaugauucuuucuccucaagucauuguuuggacccaaacaaugaggaaggaggccacggcguuaaggggugggcuuuugaugacggaaacgauguguggaugggucgaaccaucagcgagaaacugagauccggcuacgagacauucaaggucauugaaggguggucuaaacccaauagcaagcuacagaucaacaggcaagugauuguagagcggggaaaucguucaggcuauagugguauauuuuccguugaagggaaaagcugcaucaaccgcuguuucuacguggagcucauuagaggcaggaaggaagagaaugaggucugguggacuucuaacucaaucguggucuuuugcggaaccaguggcacauaugggacuggaagcuggccugacggugccgauaucaaucugaugccaauuuga

SEQ ID NO: 136295 - RNA, 1410 nt, Artificial Sequence
  derived and/or modified sequence opt3 from neuraminidase__InfluenzaA__AAY64245
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuauccuggagagaaauauaaccgaaaucguauaucuaacaaacaccacuauugagaaggaaaucuguccgaaacucgcagaguacaggaauuggucaaagccccagugcaaaauuacaggguucgccccuuuuaguaaggacaacagcauccggcuguccgcgggaggugauauaugggugacccgcgagccauaugucucuugugaccccgauaagugcuaccaauucgcucuuggccaggggacgacucugaauaaccgacauucgaaugacaccgugcacgaucguacaccuuauagaacuuugcucaugaacgaacugggaguuccauuucaucugggcaccaaacagguguguauugccuggucaagcaguuccugccacgacgguaaggcauggcuccaugucugugugacagggcacgaugagaaugccaccgcuucuuucaucuacggaggcagguuaguagacagcauuggcuccuggaguaaaaagauccugcggacgcaggaaucagagugcguuuguaucaacgggacuugcacaguggucaugaccgauggaagcgcaucuggucgcgccgacacuaaaauucuuuuuauagaggaaggcaagaucauucacaucucccaauugucagggagcgcucagcauguggaggaaugcaguuguuaucccagauacccuggagugaggugcgucugucgggauaauuggaagggcucuaaccgcccaauaguugacauuaacgugaaagauuacuccaucguaagcucguaugugugcucuggucuggucggggacacaccgcgaaagaaugacuccucaaguagcucccacugucuaaaccccaauaacgaggaaggaggccauggcgugaaagggugggccuucgaugacggaaaugauguuuggauggguagaaccaucucugagaaguuuaggagcggcuacgagacguucaaagugauugaaggguggucaaagccuaacaguaaacuccagaucaaucggcaggucauuguggaccgugauaaccgcuccggauauagcggcauauuuucuguagaggguaagucaugcaucaauagauguuucuacguugaacugauuagggggcggaagcaagagaccgaagugugguggacaaguaacagcaucgucguguuuugcggcacuuccggaaccuauggcacagggucuuggccagacggagcggauaucaaucuuaugcccauuuga

SEQ ID NO: 136296 - RNA, 1410 nt, Artificial Sequence; identical to SEQ ID NO: 136077
  derived and/or modified sequence opt3 from neuraminidase__InfluenzaA__AAY64255

SEQ ID NO: 136297 - RNA, 1410 nt, Artificial Sequence; identical to SEQ ID NO: 136295
  derived and/or modified sequence opt3 from neuraminidase__InfluenzaA__AAY64265

SEQ ID NO: 136298 - RNA, 1410 nt, Artificial Sequence; identical to SEQ ID NO: 136295
  derived and/or modified sequence opt3 from neuraminidase__InfluenzaA__AAY64285

SEQ ID NO: 136299 - RNA, 1410 nt, Artificial Sequence
  derived and/or modified sequence opt3 from neuraminidase__InfluenzaA__AAY64295
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacugucagaguacaggaauuggaguaagccucagugcaacaucacaggguucgcaccauuuagcaaagacaauuccauacggcuaucugccggaggugauauuugggugacccgcgagcccuaugucucgugugacccugauaagugcuaccaauucgcgcucggccaggggacgacucugaacaauggacauucaaacgacaccgugcacgaucgaacaccauaucguacucuucugaugaaugaauugggcguucccuuucaucucgguaccaaacagguguguaucgcuuggagcaguuccucuugccacgacgggaaggccuggcugcaugucugugugacaggagaugacgagaacgcaaccgccagcuucauuuacaauggcagacugguagauuccaucggcucauggaguaagaaaauccucaggacgcaggaaagcgagugcguuuguauuaacgggacuugcacaguggucaugaccgacggaucugcuuccgguaaggcagauacuaaaauauuauuuaucgaggaaggcaagauugugcacaucucaacacugagcgggagugcccaacacguggaggaaugcucuuguuauccucgguacccaggaguccgcugcguuuguagagacaacuggaagggcuccaauaggccgauaguggauauuaacguaaaagaccauagcaucgugucgucuuacgucugcuccggucuugugggggacacuccccggaagaaugauucauucaguagcucccacuguuuggacccuaacaaugaggaaggaggccauggcguuaaagggugggcuuuugaugacggaaacgauguguggaugggucgcacgaucucugagaagcugcgaagcggcuaugagaccuucaaagucauugaaggguggucaaagccaaauaguaaacuacagaucaacagacaggugauuguagagaggggaaaucgguccggcuacagcgguauauuuucuguugaagggaagucaugcaucaaccguuguuucuauguggagcucauucgcggcagaaaggaagagacagaggucugguggaccaguaauagcaucguggucuuuugcggaaccuccggcacauacgggacuggaucuuggcccgacggugccgauaucaaccugaugccuauuuga

SEQ ID NO: 136300 - RNA, 1410 nt, Artificial Sequence
  derived and/or modified sequence opt3 from neuraminidase__InfluenzaA__AAY64305
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauugugcacacauccaagcugucaggcagcgcucaacauguggaggaaugcaguuguuauccuagauacccaggggucaggugcguuugucgggacaauuggaaaggaucuaaccgcccgaucguggauauaaacguaaaggacuacuccauugugagcucguaugucugcucuggccuugugggugacacgccccggaaaaaugauuccucaaguagcucccacuguuuggacccuaacaaugaggaagggggacauggcguuaagggcugggccuucgaugacgggaacgauguguggaugggaagaaccaucucugagaaaagcaggucagguuacgagaccuuuaaggucaucgaaggcuggaguaaaccaaauuccaagcugcagauuaaccgacaggugaucguagagcgugggaauaugagcggauauucuggcauuuucucaguugaagguaagaguugcauaaaccgcuguuuuuacguggagcuaaucagagggaggaaacaggaaacagaggucugguggacuagcaauuccauuguggucuucugcggcaccucuggaacauauggcacugggucguggcccgacggagcggauaucaaccucaugccuaucuga

SEQ ID NO: 136301 - RNA, 1410 nt, Artificial Sequence; identical to SEQ ID NO: 136151
  derived and/or modified sequence opt3 from neuraminidase__InfluenzaA__AAY64335

SEQ ID NO: 136302 - RNA, 1410 nt, Artificial Sequence; identical to SEQ ID NO: 136166
  derived and/or modified sequence opt3 from neuraminidase__InfluenzaA__AAY64365

SEQ ID NO: 136303 - RNA, 1410 nt, Artificial Sequence
  derived and/or modified sequence opt3 from neuraminidase__InfluenzaA__AAY64385
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuauccuggagagaaauauaaccgaaaucguauaucuaacaaacaccacuauugagaaggaaaucuguccgaaacucgcagaguacaggaauuggucaaagccccagugcaaaauuacaggguucgccccuuuuaguaaggacaacagcauccggcuguccgcgggaggugauauaugggugacccgcgagccauaugucucuugugaccccgauaagugcuaccaauucgcucuuggccaggggacgacucugaauaaccgacauucgaaugacaccgugcacgaucguacaccuuauagaacuuugcucaugaacgaacugggaguuccauuucaucugggcaccaaacagguguguauugccuggucaagcaguuccugccacgacgguaaggcauggcuccaugucugugugacagggcacgaugagaaugccaccgcuucuuucaucuacggaggcagguuaguagacagcauuggcuccuggucaaagaagauccugcggacgcaggaaagugagugcguuuguaucaacgggacuugcacaguggucaugaccgauggaagcgcaucuggucgcgccgacacuaaaauucuuuuuauagaggaaggcaagaucauucacaucucccaauugucagggagcgcucagcauguggaggaaugcaguuguuaucccagauacccuggagugaggugcgucugucgggauaauuggaagggcucuaaccgcccaauaguugacauuaacgugaaagauuacuccaucguaagcucguaugugugcucuggucuggucggggacacaccgcgaaagaaugacuccucaaguagcucccacugucuaaaccccaauaacgaggaaggaggccauggcgugaaagggugggccuucgaugacggaaaugauguuuggauggguagaaccaucucugagaaaagcaggucaggcuacgagacguuuaaagugauugaaggguggaguaagccuaacuccaaacuccagaucaaucggcaggucauuguggaccgugauaaccgcagcggauauucuggcauauucucaguagaggguaagaguugcaucaauagauguuuuuacguugaacugauuagggggcggaagcaagagaccgaagugugguggacaagcaacuccaucgucguguucugcggcacuucuggaaccuauggcacagggucguggccagacggagcggauaucaaucuuaugcccauuuga

SEQ ID NO: 136304 - RNA, 1410 nt, Artificial Sequence
  derived and/or modified sequence opt3 from neuraminidase__InfluenzaA__AAY64395
augaaccccaaucagaagaucauuaccauaggcagcgugucccugaucauuucuacaaucugcuucuuuaugcaaauugccauccucauaacuacggucacccuucacuucaaacaguacgaguuuaacucaccuccaaauaaccagguuaugcugugugaaccgacaaucauugagagaaauaucacugaaauuguguauuugaccaacacaaccaucgagaaggaaauaugccccaaauuagcugaguacaggaauuggaguaagccucagugugacauuacuggguucgcaccauuuagcaaagauaacuccauccggcugucugccggaggugacauuuggguaacacgcgagcccuaugugucgugcgauccugacaaguguuaccaauucgcgcuaggccaggggaccacgcucaauaacguccauucaaaugauacugugcacgaccgaaccccauaucguacacugcuuaugaacgaacugggaguucccuuucauuugggcacuaaacaggugugcaucgcuuggagcaguuccucuugucacgaugguaaggccuggcuccaugucugcgugaccggggacgaugagaaugcaacagccagcuucaucuacaacggaagacugguagacuccauuguuucauggaguaagaaaauacugaggacccaggaaagcgagugugugugcaucaauggcacguguacugucgugaugacagauggcucugcuuccgggaaggcagacaccaaaauucucuuuaucaaggagggaaagauagugcacacuucaacauuaagcgguagugcccaacacgucgaagagugcucuugcuauccucgguacccaggcguucgcugugugugcagagauaacuggaaaggguccaacaggccgauuguagacaucaauaucaaggacuacagcauugugucgucuuaugucuguuccggacuggugggcgauacgccccggaaaaacgacucaaguagcuccucucauugccuugauccuaauaacgaagagggugggcacggaguuaagggcugggcuuucgacgauggcaaugacguguggauggggcgcaccaucagcgaaaaauugcgaucaggauacgagaccuuuaaggucauugaggguuggaguaacuccaauagcaaacugcagauaaacagacaggugaucguagauaggggcaaucggucuggguauucaggaauuuucaguguugaaggcaagagcuguaucaaccguugcuuuuacguggagcuaauccgcgguagaaaggaagagacagaaguccucuggacuuccaauucuauuguggucuucugugggaccucgggcacauauggaacuggcagcuggccagacggggccgauauaaaccugaugcccaucuga

SEQ ID NO: 136305 - RNA, 1410 nt, Artificial Sequence; identical to SEQ ID NO: 136300
  derived and/or modified sequence opt3 from neuraminidase__InfluenzaA__AAY64405

SEQ ID NO: 136306 - RNA, 1410 nt, Artificial Sequence; identical to SEQ ID NO: 136295
  derived and/or modified sequence opt3 from neuraminidase__InfluenzaA__AAY98040

SEQ ID NO: 136307 - RNA, 1410 nt, Artificial Sequence; identical to SEQ ID NO: 136295
  derived and/or modified sequence opt3 from neuraminidase__InfluenzaA__AAY98050

SEQ ID NO: 136308 - RNA, 1410 nt, Artificial Sequence; identical to SEQ ID NO: 136187
  derived and/or modified sequence opt3 from neuraminidase__InfluenzaA__AAY98060

SEQ ID NO: 136309 - RNA, 1410 nt, Artificial Sequence
  derived and/or modified sequence opt3 from neuraminidase__InfluenzaA__AAY98070
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggaccauuccaucgugagcucguacgucugcucuggucuugugggggacacccccaggaaaaaugauuccuucucaaguagccacuguuuggacccuaacaaugaggaaggaggccauggcguuaaggggugggccuuugaugacggaaacgauguguggaugggucgaacgaucuccgagaaacugagaucuggcuaugagauuuucaaggucaucgaaggguggagcaaaccaaauucaaagcuacagauuaaccgccaggugauaguagagcggggaaaucguaguggcuacuccgguaucuuuagcguugaagggaaaucuugcauuaaccgcuguuucuauguggagcucaucagaggcaggaaggaagagaccgaggucugguggacaucaaauaguaucguggucuuuugcggaacuagcggcaccuacgggacaggauccuggcccgacggugcggauauuaaccugaugccuauauga

SEQ ID NO: 136310 - RNA, 1410 nt, Artificial Sequence; identical to SEQ ID NO: 136195
  derived and/or modified sequence opt3 from neuraminidase__InfluenzaA__AAY98080

SEQ ID NO: 136311 - RNA, 1410 nt, Artificial Sequence
  derived and/or modified sequence opt3 from neuraminidase__InfluenzaA__AAY98090
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuaucauagagagaaauaucaccgaaauuguauaucugacaaacaccacuaucgagaaggaaauuuguccgaaacuagcagaguacaggaauuggucaaagccccagugcaaaaucacaggguucgccccuuuuaguaaggacaacagcauacggcucuccgcgggaggugauauuugggugacccgcgagccauaugucucuugugaccccgauaagugcuaccaauucgcucugggccaggggacgacucuuaauaaccgacauucgaaugacaccgugcacgaucguacaccuuauagaacucuguugaugaacgaacucggaguuccauuucaucugggcaccaaacagguguguaucgccuggucaagcaguuccugccacgacgguaaggcauggcugcaugucugugugacagggcacgaugagaaugccaccgcuucuuucauuuacgacggaaggcucguagauagcaucggcuccuggaguaaaaagaucuuacggacgcaggaaucagagugcguuuguauuaacggcacuugcacaguggucaugaccgacgggagcgcaucuggaaaagccgauacuaagauacuguuuaucgaggaagguaagauuauccacauaucccaacuuucaggcagcgcucagcauguggaggaaugcaguuguuauccccgcuacccuggggugagaugcgucuguagggacaauuggaaaggaucuaaccggccaauuguugauaucaacgugaaggacuacuccaucguaagcucguaugugugcucuggcuuggucggugacacaccgcgcaaaaaugauuccucaaguagcucccacugucugaaccccaauaacgaggaagggggacauggcgugaagggcugggccuucgacgaugggaaugacguuuggaugggacgaaccauuucugagaaauuuagaagcgguuacgagacguucaaggugaucgaaggcuggucaaaaccuaacaguaagcuacagauuaauaggcaggucauaguggaucgggacaaccguuccggguauagcggaaucuuuucuguagagggcaagucaugcauuaaucgcuguuucuacguugaacucaucagagguaggaaacaagagaccgaagugugguggacaaguaacagcaucgucguguuuugcgggacuuccggcaccuauggaacaggcucuuggccagauggggcggacauuaaucugaugcccauauga

SEQ ID NO: 136312 - RNA, 1410 nt, Artificial Sequence; identical to SEQ ID NO: 136295
  derived and/or modified sequence opt3 from neuraminidase__InfluenzaA__AAY98100

SEQ ID NO: 136313 - RNA, 1410 nt, Artificial Sequence; identical to SEQ ID NO: 136295
  derived and/or modified sequence opt3 from neuraminidase__InfluenzaA__AAY98110

SEQ ID NO: 136314 - RNA, 1410 nt, Artificial Sequence; identical to SEQ ID NO: 136295
  derived and/or modified sequence opt3 from neuraminidase__InfluenzaA__AAY98120

SEQ ID NO: 136315 - RNA, 1410 nt, Artificial Sequence; identical to SEQ ID NO: 136295
  derived and/or modified sequence opt3 from neuraminidase__InfluenzaA__AAY98130

SEQ ID NO: 136316 - RNA, 1410 nt, Artificial Sequence; identical to SEQ ID NO: 136295
  derived and/or modified sequence opt3 from neuraminidase__InfluenzaA__AAY98150

SEQ ID NO: 136317 - RNA, 1410 nt, Artificial Sequence
  derived and/or modified sequence opt3 from neuraminidase__InfluenzaA__AAY98160
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuauccuggagagaaauauaaccgaaaucguauaucuaacaaacaccacuauugagaaggaaaucuguccgaaacucgcagaguacaggaauuggucaaagccccagugcaaaauuacaggguucgccccuuuuaguaaggacaacagcauccggcuguccgcgggaggugauauaugggugacccgcgagccauaugucucuugugaccccgauaagugcuaccaauucgcucuuggccaggggacgacucugaauaaccgacauucgaaugacaccgugcacgaucguacaccuuauagaacuuugcucaugaacgaacugggaguuccauuucaucugggcaccaaacagguguguauugccuggucaagcaguuccugccacgacgguaaggcauggcuccaugucugugugacagggcacgaugagaaugccaccgcuucuuucaucuacggaggcagguuaguagacagcauuggcuccuggaguaaaaagauccugcggacgcaggaaucagagugcguuuguaucaacgggacuugcacaguggucaugaccgauggaagcgcaucuggucgcgccgacacuaaaauucuuuuuauagaggaaggcaagaucauucacaucucccaauugucagggaaugcucagcauguggaggaaugcagcuguuaucccagauacccuggagugaggugcgucugucgggauaacuggaagggcaguaaccgcccaauaguugacauuaaugugaaagauuacucuaucguauccagcuaugugugcucgggucuggucggggacacaccgcgaaagaacgacucuuccucaaguagcaauugucuaaaccccaauaacgaggaaggaggccacggcgugaaagggugggccuucgaugacggaaaugauguuuggauggguagaaccaucuccgagaaguuuaggucuggcuacgagacguucaaagugauugaaggguggagcaagccuaacucaaaacuccagaucaaucggcaggucauuguggaccgugauaaccgcaguggauauuccggcauauuuagcguagaggguaagucuugcaucaauagauguuucuacguugaacugauuagggggcggaagcaagagaccgaagugugguggacaucaaacaguaucgucguguuuugcggcacuagcggaaccuauggcacaggguccuggccagacggagcggauaucaaucuuaugcccauuuga

SEQ ID NO: 136318 - RNA, 1410 nt, Artificial Sequence; identical to SEQ ID NO: 136295
  derived and/or modified sequence opt3 from neuraminidase__InfluenzaA__AAY98170

SEQ ID NO: 136319 - RNA, 1410 nt, Artificial Sequence; identical to SEQ ID NO: 136295
  derived and/or modified sequence opt3 from neuraminidase__InfluenzaA__AAY98180

SEQ ID NO: 136320 - RNA, 1410 nt, Artificial Sequence; identical to SEQ ID NO: 136295
  derived and/or modified sequence opt3 from neuraminidase__InfluenzaA__AAY98200

SEQ ID NO: 136321 - RNA, 1410 nt, Artificial Sequence; identical to SEQ ID NO: 136295
  derived and/or modified sequence opt3 from neuraminidase__InfluenzaA__AAY98210

SEQ ID NO: 136322 - RNA, 1410 nt, Artificial Sequence; identical to SEQ ID NO: 136300
  derived and/or modified sequence opt3 from neuraminidase__InfluenzaA__AAY98220

SEQ ID NO: 136323 - RNA, 1410 nt, Artificial Sequence; identical to SEQ ID NO: 136295
  derived and/or modified sequence opt3 from neuraminidase__InfluenzaA__AAY98230

SEQ ID NO: 136324 - RNA, 1410 nt, Artificial Sequence
  derived and/or modified sequence opt3 from neuraminidase__InfluenzaA__AAY98250
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuauccuggagagaaauauaaccgaaaucguauaucuaacaaacaccacuauugagaaggaaaucuguccgaaacucgcagaguacaggaauuggucaaagccccagugcaaaauuacaggguucgccccuuuuaguaaggacaacagcauccggcuguccgcgggaggugauauaugggugacccgcgagccauaugucucuugugaccccgauaagugcuaccaauucgcucuuggccaggggacgacucugaauaaccgacauucgaaugacaccgugcacgaucguacaccuuauagaacuuugcucaugaacgaacugggaguuccauuucaucugggcaccaaacagguguguauugccuggucaagcaguuccugccacgacgguaaggcauggcuccaugucugugugacagggcacgaugagaaugccaccgcuucuuucaucuacggaggcagguuaguagacagcauuggcuccuggaguaaaaagauccugcggacgcaggaaucagagugcguuuguaucaacgggacuugcacaguggucaugaccgauggaagcgcaucuggucgcgccgacacuaaaauucuuuuuauagaggaaggcaagaucauucacaucucccaauugucagggagcgcucagcauguggaggaaugcaguuguuaucccagauacccuggagugaggugcgucugucgggauaauuggaagggcucuaaccgcccaauaguugacauuaacgugaaagauuacuccaucguaagcucguaugugugcucuggucuggucggggacacaccgcgaaagaaugacuccucaaguagcucccacugucuaaaccccaauaacgaggaaggaggccauggcgugaaagggugggccuucgaugacggaaaugauguuuggauggguagaaccaucucugagaaguuuaggagcggcuacgagacguucaaagugauugaaggguggucaaagccuaacaguaaacuccagaucaaucggcaggucauuguggaccgugauaaccgcuccggauauagcggcauauuuucuguagaggacaagucaugcaucaauagauguuucuacguugaacugauuaggggucggaagcaagagaccgaagugugguggacaaguaacagcaucgucguguuuugcgggacuuccggcaccuauggaacaggcucuuggccagauggggcggacaucaaucuuaugcccauuuga

SEQ ID NO: 136325 - RNA, 1410 nt, Artificial Sequence; identical to SEQ ID NO: 136295
  derived and/or modified sequence opt3 from neuraminidase__InfluenzaA__AAY98322

SEQ ID NO: 136326 - RNA, 1410 nt, Artificial Sequence; identical to SEQ ID NO: 136300
  derived and/or modified sequence opt3 from neuraminidase__InfluenzaA__AAY98332

SEQ ID NO: 136327 - RNA, 1410 nt, Artificial Sequence; identical to SEQ ID NO: 136295
  derived and/or modified sequence opt3 from neuraminidase__InfluenzaA__AAY98342

SEQ ID NO: 136328 - RNA, 1410 nt, Artificial Sequence; identical to SEQ ID NO: 136295
  derived and/or modified sequence opt3 from neuraminidase__InfluenzaA__AAY98359

SEQ ID NO: 136329 - RNA, 1410 nt, Artificial Sequence; identical to SEQ ID NO: 136300
  derived and/or modified sequence opt3 from neuraminidase__InfluenzaA__AAY98369

SEQ ID NO: 136330 - RNA, 1410 nt, Artificial Sequence
  derived and/or modified sequence opt3 from neuraminidase__InfluenzaA__AAY98379
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuaucauagagagaaauaucaccgaaauuguauaucugacaaacaccacuaucgagaaggaaauuuguccgaaacuagcagaguacaggaauuggucaaagccccagugcaaaaucacaggguucgccccuuuuaguaaggacaacagcauacggcucuccgcgggaggugauauuugggugacccgcgagccauaugucucuugugaccccgauaagugcuaccaauucgcucugggccaggggacgacucuuaauaaccgacauucgaaugacaccgugcacgaucguacaccuuauagaacucuguugaugaacgaacucggaguuccauuucaucugggcaccaaacagguguguaucgccuggucaagcaguuccugccacgacgguaaggcauggcugcaugucugugugacagggcacgaugagaaugccaccgcuucuuucauuuacggaggcaggcucguagacagcaucggcuccuggaguaaaaagaucuuacggacgcaggaaucagagugcguuuguauuaacgggacuugcacaguggucaugaccgauggaagcgcaucuggucgcgccgacacuaaaauacuguuuaucgaggaaggcaagauuauccacauaucccaacuuucagggagcgcucagcauguggaggaaugcaguuguuaucccagauacccuggagugaggugcgucugucgggauaauuggaagggcucuaaccgcccaauuguugacaucaacgugaaagauuacuccaucguaagcucguaugugugcucugguuuggucggggacacaccgcgaaagaaugacuccucaaguagcucccacugucugaaccccaauaacgaggaaggaggccauggcgugaaagggugggccuucgaugacggaaaugauguuuggauggguagaaccauuucugagaaguuuaggagcggcuacgagacguucaaagugaucgaaggguggucaaagccuaacaguaaacuacagauuaaucggcaggucauaguggaccguaacaaucgcuccggauauagcggcaucuuuucuguagaggguaagucaugcauuaacagauguuucuacguugaacucaucagggggcggaagcaagagaccgaagugugguggacaaguaauagcaucgucguguuuugcggcacuuccggaaccuauggcacagggucuuggccagauggagcggacauuaaccugaugcccauauga

SEQ ID NO: 136331 - RNA, 1410 nt, Artificial Sequence
  derived and/or modified sequence opt3 from neuraminidase__InfluenzaA__AAY98389
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuaucauagagagaaauaucaccgaaauuguauaucugacaaacaccacuaucgagaaggaaauuuguccgaaacuagcagaguacaggaauuggucaaagccccagugcaaaaucacaggguucgccccuuuuaguaaggacaacagcauacggcucuccgcgggaggugauauuugggugacccgcgagccauaugucucuugugaccccgauaagugcuaccaauucgcucugggccaggggacgacucuuaauaaccgacauucgaaugacaccgugcacgaucguacaccuuauagaacucuguugaugaacgaacucggaguuccauuucaucugggcaccaaacagguguguaucgccuggucaagcaguuccugccacgacgguaaggcauggcugcaugucugugugacagggcacgaugagaaugccaccgcuucuuucauuuacggaggcaggcucguagacagcaucggcuccuggaguaaaaagaucuuacggacgcaggaaucagagugcguuuguauuaacgggacuugcacaguggucaugaccgauggaagcgcaucuggucgcgccgacacuaaaauacuguuuaucgaggaaggcaagauuauccacauaucccaacuuucagggagcgcucagcauguggaggaaugcaguuguuaucccagauacccuggagugaggugcgucugucgggauaauuggaagggcucuaaccgcccaauuguugacaucaacgugaaagauuacuccaucguaagcucguaugugugcucugguuuggucggggacacaccgcgaaagaaugacuccucaaguagcucccacugucugaaccccaauaacgaggaaggaggccauggcgugaaagggugggccuucgaugacggaaaugauguuuggauggguagaaccauuucugagaaguuuaggagcggcuacgagacguucaaagugaucgaaggguggucaaagccuaacaguaaacuacagauuaaucggcaggucauaguggaccgugauaaccgcuccggauauagcggcaucuuuucuguagaggguaagucaugcauuaauagauguuucuacguugaacucaucagggggcggaagcaagagaccgaagugugguggacaaguaacagcaucgucguguuuugcggcacuuccggaaccuauggcacagggucuuggccagacggagcggauauuaaucugaugcccauauga

SEQ ID NO: 136332 - RNA, 1410 nt, Artificial Sequence; identical to SEQ ID NO: 136295
  derived and/or modified sequence opt3 from neuraminidase__InfluenzaA__AAY98399

SEQ ID NO: 136333 - RNA, 1410 nt, Artificial Sequence; identical to SEQ ID NO: 136295
  derived and/or modified sequence opt3 from neuraminidase__InfluenzaA__AAY98409

SEQ ID NO: 136334 - RNA, 1410 nt, Artificial Sequence; identical to SEQ ID NO: 136295
  derived and/or modified sequence opt3 from neuraminidase__InfluenzaA__AAY98773

SEQ ID NO: 136335 - RNA, 1410 nt, Artificial Sequence
  derived and/or modified sequence opt3 from neuraminidase__InfluenzaA__AAZ32955
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacauugugcacgaacgaaccccauaucguacacugcuuaugaaugagcugggaguucccuuucauuugggcacuaaacaggugugcaucgcuuggagcaguuccucuugucacgaugguaaggccuggcuccaugucugcgugaccggggacgaugaaaacgcaacagccagcuucaucuacaauggaagacugguagacuccauuguuucauggaguaagaaaauacugaggacccaggagagcgagugugugugcaucaacggcacguguacugucgugaugacagauggcucugcuuccgggaaggcagacaccaaaauucucuuuaucgaagagggaaagauagugcacacuucaacauuaagcgguagugcccaacacgucgaagagugcucuugcuauccucgguacccaggcguucgcugugugugcagagauaacuggaagggguccaauaggccgauuguagacaucaacaucaaagauuacagcauugugucgucuuaugucuguuccggacuggugggcgacacgccccggaagaaugacucaaguagcuccucucauugccuugauccuaacaaugaagagggugggcacggaguuaaaggcugggcuuucgacgauggcaacgacguguggauggggcgcaccaucagcgagaaguugcgaucaggauacgaaaccuuuaaagucauugaggguuggaguaauccaaacuccaagcugcagauaaauagacaggugaucguagauaggggcaaccggagcggguauucuggaauuuucucaguugaaggcaaaaguuguaucaaucguugcuuuuacguggagcuaauccgcgguagaaagcaggaaacagagguccucuggacuagcaacuccauuguggucuucugugggaccucuggcacauauggaacuggcucguggcccgacggggccgauauaaaucugaugccuaucuga

SEQ ID NO: 136336 - RNA, 1344 nt, Artificial Sequence
  derived and/or modified sequence opt3 from neuraminidase__InfluenzaA__AAZ32957
augaaccccaaucagaagaucauuaccauaggcagcgugucccugacaaucucuacuauuugcuucuuuaugcaaaucgccauucucaucacgaccgucacacuuauagagagaaacaucacugaaauuguuuaccugaccaauacaaccaucgagaaagaaauuuguccuaaguuggcugaguauaggaacuggucaaaaccacagugcaauaucacuggguucgcaccguuuaguaaggacaacagcauacgguuauccgccggaggugauauuugggugacacgcgaacccuacguaucuugugacccugauaaaugcuaucaguucgcgcugggccaggggaccacgcuaaauaacgugcacucgaaugacacuguccaugaucgaaccccauaccguacacuccugaugaacgagcuuggagugcccuuucaccugggcacuaagcaaguuuguaucgcuuggucaagcaguuccugccaugacgguaaggccugguugcacgugugugucaccggggaugacgagaaugcaacagccucuuucauuuauaacggaagacucguggauagcaucguauccuggaguaaaaagauccugaggacccaggaaucagagugcguuuguauuaauggcacgugcacuguggucaugacagacggcaacgcuagcgggaaagcagauaccaagauacuguuuaucgaagagggaaaaauugugcauacuucuacacucuccgguucagcccagcacguggaggaauguagcugcuacccucgguauccaggcguccgcugcguuuguagagacaauuggaaggggaguaacaggcccaucguggauauaaacauuaaggacuacucuaucguauccagcuacgugugcucgggauuagucggcgacaccccucggaaaaaugauucuuccucaaguagccacugucuggacccaaacaaugaggaaggugggcauggagugaagggcugggcuuucgaugacggcaacgauguuuggauggggcgcacgaucuccgagaaacuucgaucuggauaugaaaccuuuaaggugauugaggguuggagcaauccgaacucaaaauugcagaucaauagacaagucauuguggacaggggcaaccggaguggguacuccggaauauucagcguagagggcaagucuugcaucaaucguuguuuuuauguugaacugauucgcgguagaaaacaggagacagaagugcuauggacuucaaacaguaucgucguguucugcgggaccagcggcacauacggaacuggcuccuggcccgauggggccgacaucaaucucaugccuauuuga

SEQ ID NO: 136337 - RNA, 1344 nt, Artificial Sequence; identical to SEQ ID NO: 136336
  derived and/or modified sequence opt3 from neuraminidase__InfluenzaA__AAZ32958

SEQ ID NO: 136338 - RNA, 1344 nt, Artificial Sequence; identical to SEQ ID NO: 136336
  derived and/or modified sequence opt3 from neuraminidase__InfluenzaA__AAZ32959

SEQ ID NO: 136339 - RNA, 1410 nt, Artificial Sequence; identical to SEQ ID NO: 136300
  derived and/or modified sequence opt3 from neuraminidase__InfluenzaA__AAZ38465

SEQ ID NO: 136340 - RNA, 1410 nt, Artificial Sequence; identical to SEQ ID NO: 136300
  derived and/or modified sequence opt3 from neuraminidase__InfluenzaA__AAZ38476

SEQ ID NO: 136341 - RNA, 1410 nt, Artificial Sequence
  derived and/or modified sequence opt3 from neuraminidase__InfluenzaA__AAZ38487
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuauccuggagagaaauauaaccgaaaucguauaucuaacaaacaccacuauugagaaggaaaucuguccgaaacucgcagaguacaggaauuggucaaagccccagugcaaaauuacaggguucgccccuuuuaguaaggacaacagcauccggcuguccgcgggaggugauauaugggugacccgcgagccauaugucucuugugaccccgauaagugcuaccaauucgcucuuggccaggggacgacucugaauaaccgacauucgaaugacaccgugcacgaucguacaccuuauagaacuuugcucaugaacgaacugggaguuccauuucaucugggcaccaaacagguguguauugccuggucaagcaguuccugccacgacgguaaggcauggcuccaugucugugugacagggcacgaugagaaugccaccgcuucuuucaucuacggaggcagguuaguagacagcauuggcuccuggaguaaaaagauccugcggacgcaggaaucagagugcguuuguaucaacgggacuugcacaguggucaugaccgauggaagcgcaucuggucgcgccgacacuaaaauucuuuuuauagaggaaggcaagaucauucacaucucccaauugucagggagcgcucagcauguggaggaaugcaguuguuaucccagauacccuggagugaggugcgucugucgggauaauuggaagggcucuaaccgcccaauaguugacauuaacgugaaagauuacuccaucguaagcucguaugugugcucuggucuggucggggacacaccgcgaaagaaugacuccucaaguagcuccaacugucuaaaucccaacaaugaggaaggaggccacggcgugaaagggugggccuucgaugacggaaacgauguuuggauggguagaaccaucucugagaaguuuaggagcggcuacgagacguucaaagugauugaaggguggucaaagccuaauaguaaacuccagaucaaccggcaggucauuguggaccgugauaaucgcuccggauauagcggcauauuuucuguagaggguaagucaugcaucaacagauguuucuacguugaacugauuagggggcggaagcaagagaccgaagugugguggacaaguaauagcaucgucguguuuugcggcacuuccggaaccuauggcacagggucuuggccagacggagcggauaucaaccuuaugcccauuuga

SEQ ID NO: 136342 - RNA, 1410 nt, Artificial Sequence
  derived and/or modified sequence opt3 from neuraminidase__InfluenzaA__AAZ38509
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuugauccuaauaacgaggaaggugggcacggaguuaaaggcugggcuuucgacgauggcaaugacguguggauggggcgcaccauuagcgagaaguugcgaucaggauacgagacauuuaaagucaucgaagguuggaguaacuccaauagcaagcugcagauuaacagacaggugauaguagauaggggcaaucggucuggguauucaggaaucuucaguguugagggcaaaagcuguauuaaccguugcuuuuacguggaacuaauccgcgguagaaaggaggaaacugagguccucuggaccuccaauucuaucguggucuucugugggacaucgggcacuuauggaaccggcagcuggccagacggggccgauauuaaccugaugcccauauga

SEQ ID NO: 136343 - RNA, 1410 nt, Artificial Sequence
  derived and/or modified sequence opt3 from neuraminidase__InfluenzaA__AAZ38586
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuugauccuaauaacgaggaaggugggcacggaguuaaaggcugggcuuucgacgauggcaaugacguguggauggggcgcaccauuagcgagaaguugcgaucaggauacgagacauuuaaagucaucgaagguuggaguaacccaaauuccaagcugcagauuaacagacaggugauaguagauaggggcaaucggagcggguauucuggaaucuucucaguugagggcaaaaguuguauuaaccguugcuuuuacguggaacuaauccgcgguagaaaggaggaaacugagguccucuggaccagcaauuccaucguggucuucugugggacaucuggcacuuauggaaccggcucguggcccgacggggccgauauuaaccugaugccuauauga

SEQ ID NO: 136344 - RNA, 1410 nt, Artificial Sequence; identical to SEQ ID NO: 136343
  derived and/or modified sequence opt3 from neuraminidase__InfluenzaA__AAZ38597

SEQ ID NO: 136345 - RNA, 1410 nt, Artificial Sequence
  derived and/or modified sequence opt3 from neuraminidase__InfluenzaA__AAZ38608
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaugugccccaaauuagcugaguacaggaauuggaguaagccucagugugacaucacaggguucgcaccauuuagcaaagauaacuccauacggcugucugccggaggugacauuuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcaucgcuuggagcaguuccucuugucacgaugguaaggccuggcuccaugucugcgugacaggggacgauaagaaugcaaccgccagcuucauuuacaacggaagacugguagacuccaucguuucauggaguaaaaagauccugaggacgcaggagagcgaaugugugugcauuaauggcacuuguacagucgugaugaccgauggcucugcuuccgggaaagcagacacuaagauacucuuuaucgaggagggaaagauuauccacacaucaaccuuaagcgguagugcccaacacguggaagagugcucuugcuauccucgguacccaggcguccgcuguguuugcagagauaacuggaaaggguccaacaggccgauaguggacauuaauaucaaggacuacagcaucguaucgucuuauguguguuccggacuggucggcgauacgccccggaaaaacgacucaaguagcuccucucauugccuugauccuaauaacgaagagggugggcacggagugaagggcugggcuuucgacgauggcaaugacguuuggauggggcgcaccauuagcgaaaaauugcgaucaggauacgagacauuuaaggugaucgaggguuggaguaaaccaaacuccaagcugcagauuaauagacaggucauaguggauaggggcaaccggagcggguauucuggaaucuucucaguagaaggcaagaguuguauuaaucguugcuuuuacguugagcuaauccgcgguagaaaagaagagacugaagugcucuggaccagcaacuccaucgucguguucugugggacaucuggcacuuauggaaccggcucguggcccgacggggccgauacaaaucugaugccuauuuga

SEQ ID NO: 136346 - RNA, 1410 nt, Artificial Sequence
  derived and/or modified sequence opt3 from neuraminidase__InfluenzaA__AAZ38619
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaugugccccaaauuagcugaguacaggaauuggaguaagccucagugugacaucacaggguucgcaccauuuagcaaagauaacuccauacggcugucugccggaggugacauuuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcaucgcuuggagcaguuccucuugucacgaugguaaggccuggcuccaugucugcgugacaggggacgauaagaaugcaaccgccagcuucauuuacaacggaagacugguagacuccaucguuucauggaguaaaaagauccugaggacgcaggagagcgaaugugugugcauuaauggcacuuguacagucgugaugaccgauggcucugcuuccgggaaagcagacacuaagauacucuuuaucgaggagggaaagauuauccacacaucaaccuuaagcgguagugcccaacacguggaagagugcucuugcuauccucgguacccaggcguccgcuguguuugcagagauaacuggaaaggguccaacaggccgauaguggacauuaauaucaaggacuacagcaucguaucgucuuauguguguuccggacuggucggcgauacgccccggaaaaacgacucaaguagcuccucucauugccuugauccuaauaacgaagagggugggcacggagugaagggcugggcuuucgacgauggcaaugacguuuggauggggcgcaccauuagcgaaaaauugcgaucaggauacgagacauuuaaggugaucgaggguuggaguaaaccaaacuccaagcugcagauuaauagacaggucauaguggauaggggcaaccggagcggguauucuggaaucuucucaguagaaggcaagaguuguauuaaucguugcuuuuacguugagcuaauccgcgguagaaaagaagagacugaagugcucuggaccagcaacuccaucgucguguucugugggacaucuggcacuuauggaaccggcucguggcccgacggggccgauauuaaucugaugccuauauga

SEQ ID NO: 136347 - RNA, 1410 nt, Artificial Sequence; identical to SEQ ID NO: 136343
  derived and/or modified sequence opt3 from neuraminidase__InfluenzaA__AAZ38641

SEQ ID NO: 136348 - RNA, 1410 nt, Artificial Sequence; identical to SEQ ID NO: 136343
  derived and/or modified sequence opt3 from neuraminidase__InfluenzaA__AAZ38653

SEQ ID NO: 136349 - RNA, 1410 nt, Artificial Sequence; identical to SEQ ID NO: 136134
  derived and/or modified sequence opt3 from neuraminidase__InfluenzaA__AAZ43386

SEQ ID NO: 136350 - RNA, 1410 nt, Artificial Sequence
  derived and/or modified sequence opt3 from neuraminidase__InfluenzaA__AAZ43397
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagagggaaauuugucccaagcuggcagaguaucggaauuggucaaaaccucagugcaacaucacaggguucgccccauuuaguaaggacaauagcauacgccuauccgcgggaggugauauuugggugacccgagagcccuacgucucuugugacccugauaaaugcuaucaauucgcucucggccaggggacgacucugaacaauggacacucgaacgacaccgugcaugaucguacaccauacagaacucuucugaugaaugaauugggcguucccuuucaccucgguacccgacagguguguaucgccuggucaagcaguuccugccaugacgggaaggcauggcugcacgucugugugacaggagaugacaagaacgccaccgcuucuuucauuuauaauggccggcugguagauagcaucggcuccuggaguaaaaagauccuccgcacgcaggagucagaaugcguuuguauuaacgggacuugcacaguggucaugaccgacggaagcgcaucugguaaagccgauacuaagauauuauuuaucgaggagggcaaaauugugcacaucuccacacugucagggagcgcucaacauguggaagagugcaguuguuacccuagauauccaggagucaggugcguuugucgggacaacuggaagggcucuaaucgcccgauaguggauauuaacguaaaggacuacuccaucgugagcucguacgucugcucuggucuugugggggacacccccaggaaaaaugauuccucaaguagcucccacuguuuggacccuaacaaugaagagggaggccauggcguuaaggggugggccuucgaugacggaaacgauguguggauggguagaacgaucucugaaaaacugaggagcggcuaugagaccuuuaaggucauugagggguggucaaaaccaaauaguaagcuacagacaaaccgucaggugaucguagaacggggaaaucgcuccggcuacagcgguauuuucucuguugaggggaaaucaugcauaaacagauguuuuuauguggaacucaucaggggccggaaggaggaaacugaggucugguggaccaguaauagcauuguggucuucugcggaacauccggcacuuacgggaccggaucuuggcccgacggugcggauaucaaccugaugccuaucuga

SEQ ID NO: 136351 - RNA, 1410 nt, Artificial Sequence
  derived and/or modified sequence opt3 from neuraminidase__InfluenzaA__AAZ43408
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaugaucgagagaaauauaaccgaaaucguauauuuaacaaacaccacuauugagaaggaaaucugucccaaacuggcagaguacaggaauuggucaaagccucagugcaacauuacaggguucgccccauuuaguaaagacaauagcauccggcuauccgcgggaggugauauaugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguauugccuggucaagcaguuccugccacgacgggaaggcauggcugcaugucugugugacaggagaugacgagaacgccaccgcuucuuucaucuacaauggcagacugguagauagcauuggcuccuggucaaagaaaauccucaggacgcaggaaagugagugcguuuguaucaacgggacuugcacaguggucaugaccgacggaagcgcaucugguaaggccgauacuaaaauuuuauuuauagaggaaggcaagaucgugcacacauccucacugagcgggagugcucaacacguggaggaaugcucuuguuauccucgguacccaggaguccgcugcguuuguagagacaacuggaagggcuccaauaggccgauuguggauaucaacguaaaagacuacagcauagugucgucuuaugucugcuccggucuugugggggacacgccccggaagaaugauucaaguagcuccucucauuguuuggacccuaacaaugaggaaggaggccacggcguuaaagggugggccuucgaugacggaaacgauguguggaugggucgcaccauuagcgagaagcugcgaucaggcuacgagaccuuuaaagucaucgaaggguggaguaagccaaauuccaaacuacagaucaacagacaggugauuguagacaggggaaaucggagcggcuauucugguaucuucucaguugagaguaagagcugcauuaaccguuguuuuuacguggaacucauacgcgggagaaagcaggagacagaaguccuguggacuuccaauucuaucguggucuucugcggcaccucgggaacauauggcacugggagcuggcccgauggagcggacauuaaccuuaugccuaucuga

SEQ ID NO: 136352 - RNA, 1410 nt, Artificial Sequence
  derived and/or modified sequence opt3 from neuraminidase__InfluenzaA__AAZ74355
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggcaaugccgugcgaacccgccaucauagagagaaauacuaccgaaacaguguacuugaccaacacuacaaucgagaaggaaauuuguccuaaauuagcggaguauaggaauuggucaaagccacagugcaacaucaccggguucgcucccuuuaguaaagacaauagcauucggcuguccgccggaggugauaucuggguaacgcgcgagccuuacgugucuugugacccagauaagugcuaucaauucgcacuaggccaggggacuacccucaacaauggacacucgaacgacacaguccaugaucgaacucccuaccguacccugcuuaugaaugaacugggcgugccuuuucacuuggguacaagacagguuuguauagccuggucaagcaguuccugccaugacgggaaggcuuggcuccacgugugugucaccggagaugacgagaacgcaacggccucuuucauuuauaauggcaggcugguggauagcaucggcuccuggaguaaaaagauucugcggacucaggaaucagagugcguauguaucaacgggacaugcaccguugugaugacugacggaagcgcuucugguaaagccgauacaaagauccucuuuauugaggaaggcaaaauaguccacaucuccaccuuaucagggagcgcgcaacauguggaggaaugcaguuguuacccacgcuauccgggagugagaugcgucuguagggacaacuggaagggcucuaaucggcccauuguugauaucaacgugaaggacuacuccauaguaagcucguacgugugcucuggucuggucggggacacgccucgcaaaaaugauuccuucucaaguagccacugucuugacccaaacaaugaggaaggaggccauggcgugaaggggugggcauuugaugacggaaacgauguuuggaugggucgaaccauuuccgagaaauugagaucuggcuaugagacauucaaggugaucgaaggguggagcaaacccaauucaaagcugcagaucaacaggcaggucauuguggagcggggaaaucguaguggcuacuccgguaucuuuagcguagaagggaaaucuugcauuaaccgcuguuucuauguugagcuaauaagaggcaggaaggaagagacugaggugugguggaccucaaauaguaucgucguguuuugcggaacaagcggcacuuacgggaccggauccuggccugacggugccgauauuaaccucaugccaaucuga

SEQ ID NO: 136353 - RNA, 1410 nt, Artificial Sequence
  derived and/or modified sequence opt3 from neuraminidase__InfluenzaA__AAZ74366
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuaucauagagagaaauaucaccgaaauuguauaucugacaaacaccacuaucgagaaggaaauuuguccgaaacuagcagaguacaggaauuggucaaagccccagugcaaaaucacaggguucgccccuuuuaguaaggacaacagcauacggcucuccgcgggaggugauauuugggugacccgcgagccauaugucucuugugaccccgauaagugcuaccaauucgcucugggccaggggacgacucuuaauaaccgacauucgaaugacaccgugcacgaucguacaccuuauagaacucuguugaugaacgaacucggaguuccauuucaucugggcaccaaacagguguguaucgccuggucaagcaguuccugccacgacgguaaggcauggcugcaugucugugugacagggcacgaugagaaugccaccgcuucuuucauuuacgacggaaggcucguagauagcaucggcuccuggaguaaaaagaucuuacggacgcaggaaucagagugcguuuguauuaacggcacuugcacaguggucaugaccgacgggagcgcaucuggaaaagccgauacuaagauacuguuuaucgaggaagguaagauuauccacauaucccaacuuucaggcagcgcucagcauguggaggaaugcaguuguuauccccgcuacccuggggugagaugcgucuguagggacaauuggaaaggaucuaaccggccaauuguugauaucaacgugaaggacuacuccaucguaagcucguaugugugcucuggcuuggucggugacacaccgcgcaaaaaugauuccucaaguagcucccacugucugaaccccaauaacgaggaagggggacauggcgugaagggcugggccuucgacgaugggaaugacguuuggaugggacgaaccauuucugagaaauuuagaagcgguuacgagacguucaaggugaucgaaggcuggucaaaaccuaacaguaagcuacagauuaauaggcaggucauaguggauaaggacaaccgguccggguauagcggaaucuuuucuguagagggcaaaucaugcauuaaucguuguuucuacguugaacucauccgcgguagaaagcaagagaccgaagugugguggacaaguaacagcaucgucguguuuugcgggacuuccggcaccuauggaacaggcucuuggccagauggggcggacauuaaucugaugcccauauga

SEQ ID NO: 136354 - RNA, 1410 nt, Artificial Sequence
  derived and/or modified sequence opt3 from neuraminidase__InfluenzaA__AAZ74377
augaaccccaaucagaagaucauuaccauaggcagcgugucccugacaaucgccacuauuugcuuccucacgcagaucgcuauucuugucaccacaguuacucugcacuuuaaacaguacgaguguaacucuccuccaaauaaccaggugauguugugcgaaccgaccaucauagagagaaauaucacagaaauuguauauuuaaccaacacuacaaucgagaaggaaauuugucccaaacuggcagaguacaggaauuggucaaagccucagugcaacaucaccggguucgccccauuuaguaaagacaauagcauacggcuauccgcgggaggugauauuugggugacgcgcgagcccuaugucucuugugacccugauaagugcuaccaauucgcucucggccaggggacuacccugaacaauggacauucgaacgacacagugcacgaucgaacuccauaucguacccuucugaugaaugaauugggcguucccuuucaucucgguacaaaacagguguguaucgccuggucaagcaguuccugccacgacgggaaagcauggcugcaugucugugugaccggagaugacaagaacgccacggcuucuuucauuuacaauggcagacugguagauagcaucggcuccuggucaaagaagauccucaggacucaggagagugaaugcguuuguauuaacgggacaugcaccguggucaugacugacggaagcgcaucugguaaagccgauacaaagauauuauuuaucgaggagggcaagauugugcacaccucccugcuuucagggagcgcucaacacguggaagagugcaguuguuauccucgguacccaggaguccgcugcguuuguagagacaacuggaaaggcucuaauaggccgaucguggauauaaacguaaaggacuacuccauugugagcucguaugucugcucugguuuggugggggacacgccccggaaaaaugauuccucaaguagcucccauugucuggacccuaacaaugaagagggaggccacggcguuaaggggugggccuucgaugacggaaacgauguguggaugggucgcaccauccgagaaaaacuaagaucuggcuacgagacauuuaaggucaucgagggguggagcaaaccaaauucaaagcuccagauuaacaggcaagugaucguagaccgggauaaucguaguggauauuccggcauuuucagcguugaagguaagucuugcauaaaccgcuguuuuuacguggagcugaucagagggaggaaucaggaaacugagguccuuuggaccucaaacaguauuguggucuucugcggcacaagcggaacuuauggcaccggguccuggcccgacggagcggauaucaaucugaugccuaucuga

SEQ ID NO: 136355 - RNA, 1410 nt, Artificial Sequence
  derived and/or modified sequence opt3 from neuraminidase__InfluenzaA__AAZ74400
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucucugauuuacgacggaaggcucguagauagcaucggcuccuggucaaagaagaucuuacggacgcaggaaagugagugcguuuguauuaacggcacuugcacaguggucaugaccgacgggagcgcaucuggacgcgccgauacuaaaauacuguucaucgaggaagguaagauugugcacacauccaaacuuucaggcagcgcucaacauguggaggaaugcaguuguuauccuagauacccaggggucaggugcguuugucgggacaauuggaaaggaucuaaccgcccgaucguggauauaaacguaaaggacuacuccauugugagcucguaugucugcucuggcuuggugggugacacgccccggaaaaaugauuccucaaguagcucccacugucuggacccuaacaaugaggaagggggacauggcguuaagggcugggccuuugaugacgggaacgauguguggaugggaagaaccaucucugagaaaagcaggucagguuacgagaccuucaaggucaucgaaggcuggaguaaaccaaauuccaagcuacagauuaaccgacaggugaucguagagcgugggaauaugagcggauauucuggcauauuuucaguugaagguaagaguugcauuaaccgcuguuucuacguggagcucaucagagggaggaaacaggaaacagaggucugguggacuagcaauuccauuguggucuuuugcggcaccucuggaacauauggcacugggucguggcccgacggagcggauaucaaccugaugccuaucuga

SEQ ID NO: 136356 - RNA, 1410 nt, Artificial Sequence; identical to SEQ ID NO: 136295
  derived and/or modified sequence opt3 from neuraminidase__InfluenzaA__AAZ74411

SEQ ID NO: 136357 - RNA, 1410 nt, Artificial Sequence
  derived and/or modified sequence opt3 from neuraminidase__InfluenzaA__AAZ74422
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaaugauaccgugcacgaccgaacacccuaucguacucuccugaugaacgaacuuggaguuccuuuucaucugggcaccaaacaggugugcauugcuuggagcaguuccucuugucacgaugguaaggccugguugcaugucugcgugacaggggacgauaagaaugcaaccgccagcuucaucuacaacggaagacucguagacuccaucguuucauggaguaaagagauucugaggacgcaggaaagcgagugugugugcauaaauggcacuugugcugucgugaugacagauggcucugcauccgggaaggccgacaccaaaauccuguuuauugaggaaggaaagaucgugcacacuucaaagcucagcgguagugcucaacacgucgaggaaugcucuugcuauccacgguacccgggcauacgcuguguuugcagagauaacuggaaaggguccaacaggcccauuguggacaucaauaucaaggacuacagcauuguaucgucuuauguguguuccggauuagucggcgauacaccucggaaaaacgacucaaguagcuccucucauugccuggauccaaauaacgaggaaggugggcacggagugaagggcugggccuucgacgauggcaaugacguuuggauggggcgcaccaucagcgagaaacuucgaucaggauacgagacguuuaaggugauugaagguuggaguaaccccaauuccaaauugcagauaaacagacaggucaucguggauaggggcaaucggagcggguauucuggaauuuucucaguagagggcaagaguuguaucaaccguugcuuuuacguugaacugauccgcgguagaaaggaggaaaccgaggugcuauggacaagcaauuccauugucguguucugugggacuucuggcaccuauggaacaggcucguggccugacggggcggauauaaaccucaugccaaucuga

SEQ ID NO: 136358 - RNA, 1410 nt, Artificial Sequence; identical to SEQ ID NO: 136343
  derived and/or modified sequence opt3 from neuraminidase__InfluenzaA__AAZ74444

SEQ ID NO: 136359 - RNA, 1410 nt, Artificial Sequence
  derived and/or modified sequence opt3 from neuraminidase__InfluenzaA__AAZ74455
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagauauucugaggacgcaggagagcgaaugugugugcauaaauggcacuuguacagucgugaugaccgacggcucugcuuccgggaaggcagauacuaaaauccucuuuauugaggagggaaagaucgugcacacaucaaccuuaagcgguagugcccaacacgucgaagagugcucuugcuauccucgguacccaggcguucgcugugugugcagagacaacuggaagggguccaacaggccgauaguagacauuaauaucaaagauuacagcaucgugucgucuuaugucuguuccggacuggugggcgacacgccccggaagaacgauucaaguagcuccucucauugccuugacccuaauaacgaagagggugggcacggaguuaaaggcugggcuuucgaugacggcaaugauguguggauggggcgcaccauuagcgaaaaguugcgacugggauacgagacauuuaaagucaucgaggguuggucaaacccaaauaguaagcuacagauuaacagacaggugauaguagaaaggggcaaucgguccggguauagcggaaucuucucuguugagggcaaaucauguauuaaccguugcuuuuacguggaacucauccgcgguagaaaggaggaaacugagguccuguggaccaguaauagcaucguggucuucugugggacauccggcacuuauggaaccggcucuuggcccgacggggccgauauuaaccuuaugccuauauga

SEQ ID NO: 136360 - RNA, 1410 nt, Artificial Sequence; identical to SEQ ID NO: 136343
  derived and/or modified sequence opt3 from neuraminidase__InfluenzaA__AAZ74477

SEQ ID NO: 136361 - RNA, 1410 nt, Artificial Sequence; identical to SEQ ID NO: 136359
  derived and/or modified sequence opt3 from neuraminidase__InfluenzaA__AAZ74488

SEQ ID NO: 136362 - RNA, 1410 nt, Artificial Sequence
  derived and/or modified sequence opt3 from neuraminidase__InfluenzaA__AAZ74499
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuugugcugucgugaugacagauggcucugcauccgggaaggccgacaccaaaauccucuuuauugaggaaggaaagaucgugcacacuucaaaguuaagcgguagugcucaacacgucgaggaaugcucuugcuauccucgguacccaggcauacgcuguguuugcagagauaacuggaaaggguccaacaggccgauuguggacaucaauaucaaggacuacagcauuguaucgucuuauguguguuccggacuggucggcgauacaccccggaaaaacgacucaaguagcuccucucauugccuugauccuaauaacgaggaaggugggcacggagugaagggcugggccuucgacgauggcaaugacguuuggauggggcgcaccaucagcgagaaauugcgaucaggauacgagacguuuaaggugauugaagguuggaguaacccaaauuccaaacugcagauaaacagacaggucaucguggauaggggcaaucggagcggguauucuggaauuuucucaguagagggcaagaguuguaucaaccguugcuuuuacguugaacuaauccgcgguagaaaggaggaaaccgaggugcucuggacaagcaauuccauugucguguucugugggacuucuggcaccuauggaacaggcucguggcccgacggggcggauauaaaccugaugccuaucuga

SEQ ID NO: 136363 - RNA, 1410 nt, Artificial Sequence; identical to SEQ ID NO: 136359
  derived and/or modified sequence opt3 from neuraminidase__InfluenzaA__AAZ74510

SEQ ID NO: 136364 - RNA, 1410 nt, Artificial Sequence; identical to SEQ ID NO: 136362
  derived and/or modified sequence opt3 from neuraminidase__InfluenzaA__AAZ74521

SEQ ID NO: 136365 - RNA, 1410 nt, Artificial Sequence
  derived and/or modified sequence opt3 from neuraminidase__InfluenzaA__AAZ74532
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagauauucugaggacgcaggagagcgaaugugugugcauaaauggcacuuguacagucgugaugaccgacggcucugcuuccgggaaggcagauacuaaaauccucuuuauugaggagggaaagaucgugcacacaucaaccuuaagcgguaacgcccaacacgucgaagagugcaguugcuauccucgguacccaggcguucgcugugugugcagagacaacuggaaggggucuaauaggccgauaguagacauuaacaucaaagauuacuccaucgugagcucguaugucuguucuggacuggugggcgacacgccccggaagaaugauuccucaaguagcucccauugccuugacccuaacaaugaagagggugggcacggaguuaaaggcugggcuuucgaugacggcaacgauguguggauggggcgcaccauuucugaaaaguugcgacugggauacgagacauuuaaagucaucgaggguuggagcaauccaaacucaaagcuacagauuaauagacaggugauaguagaaaggggcaaccggaguggguauuccggaaucuucagcguugagggcaaaucuuguauuaaucguugcuuuuacguggaacucauccgcgguagaaaggaggaaacugagguccuguggaccucaaacaguaucguggucuucugugggacaagcggcacuuauggaaccggcuccuggcccgacggggccaauauuaaccuuaugccuauauga

SEQ ID NO: 136366 - RNA, 1410 nt, Artificial Sequence; identical to SEQ ID NO: 136343
  derived and/or modified sequence opt3 from neuraminidase__InfluenzaA__AAZ74543

SEQ ID NO: 136367 - RNA, 1410 nt, Artificial Sequence; identical to SEQ ID NO: 136295
  derived and/or modified sequence opt3 from neuraminidase__InfluenzaA__AAZ74565

SEQ ID NO: 136368 - RNA, 1410 nt, Artificial Sequence; identical to SEQ ID NO: 136343
  derived and/or modified sequence opt3 from neuraminidase__InfluenzaA__AAZ74598

SEQ ID NO: 136369 - RNA, 1410 nt, Artificial Sequence
  derived and/or modified sequence opt3 from neuraminidase__InfluenzaA__AAZ74609
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgaucauaaucgagagaaauauuacugaaaucguauauuuaaccaacacaaccauugagaaggaaaucugucccaaacuggcagaguacaggaauuggucaaagccucagugcaaaauaacuggguucgccccauuuaguaaggacaacagcauucggcuauccgcgggaggugauaucugggugacacgcgagcccuaugucucuugugacccugauaagugcuaccaauucgcucucggccaggggaccacgcugaauaaccgacauucgaaugacacugugcacgaucguaccccauauagaacacuucugaugaacgaauugggaguucccuuucaucucggcacuaaacagguguguauugccuggucaagcaguuccugccacgacgguaaggcauggcugcaugucugugugaccgggcacgaugagaaugccacagcuucuuucaucuacgacggaaggcugguagauagcaucuccucauggaguaaaaacauucuccggacccaggaaagcgagugcguuuguauaaauggcacgugcacuguggucaugacagacggcucugcauccgagcgcgccgauaccaagaucuuauuuauugaagaggggaaaaucgugcacauaucaccucugagcggaagugcucaacauguggaagagugcucuuguuauccaagauacccgggugucaggugcguuugucgggacaacuggaagggcuccaaccgccccauuguggauaucaauguaaaggacuacagcaucgugucgucuuaugucugcuccgggcuugugggagacacuccucggaaaaacgauucaaguagcuccucuuacuguuugaauccaaacaaugaagagggcggucacgggguuaagggaugggccuucgacgauggcaacgacguguggaugggcagaacaauuagcgagaaacugaggucaggguaugaaaccuuuaaggucaucggagguuggaguaaacccaauuccaagcuacagauuaaccgacaggugauaguagaucguggcaaucgcagcggguacucuggaaucuucucaguugagggcaaaaguugcgugaacagauguuuuuaugucgaacucauuaggggucggaagcaggagacggaagugugguggaccagcaauuccaucgucguguucugcgggacaucuggcacuuacggaaccggcucguggccugacggggcggauaucaaccugaugccaauuuga

SEQ ID NO: 136370 - RNA, 1410 nt, Artificial Sequence; identical to SEQ ID NO: 136077
  derived and/or modified sequence opt3 from neuraminidase__InfluenzaA__AAZ74620

SEQ ID NO: 136371 - RNA, 1410 nt, Artificial Sequence; identical to SEQ ID NO: 136189
  derived and/or modified sequence opt3 from neuraminidase__InfluenzaA__AAZ79508

SEQ ID NO: 136372 - RNA, 1410 nt, Artificial Sequence
  derived and/or modified sequence opt3 from neuraminidase__InfluenzaA__AAZ79519
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucuuagagagaaauauaaccgaaaucguauaucugacaaacaccacuauugagaaggaaaucugucccaaacuagcagaguacaggaauuggucaaagccucagugcaaaauuacaggguucgccccauuuaguaaggacaacagcauccggcucuccgcgggaggugauauaugggugacccgcgagcccuaugucucuugugacccugauaagugcuaccaauucgcucugggccaggggacgacucuuaauaaccgacauucgaaugacaccgugcacgaucguacaccauauagaacucuguugaugaacgaacucggaguucccuuucaucugggcaccaaacagguguguauugccuggucaagcaguuccugccacgacgguaaggcauggcugcaugucugugugacagggcacgauaaaaaugccaccgcuucuuucaucuacggaggcaggcucguagacagcauuggcuccuggucaaagaaaaucuuacggacgcaggagagugaaugcguuuguaucaacgggacuugcacaguggucaugaccgauggaagcgcaucuggucgcgccgacacuaagauucuguuuauagaggagggcaagaucauucacaucucccaacuuucagggagcgcucagcauguggaagagugcaguuguuauccuagauacccaggagugaggugcgucugucgggauaauuggaaaggcucuaaccgcccgauaguugacauuaacgugaaggauuacuccaucguaagcucguaugugugcucugguuuggucggggacacaccccgaaagaaugacuccucaaguagcucccacugucugaacccuaauaacgaagagggaggccauggcgugaaagggugggccuucgaugacggaaaugauguuuggauggguagaaccaucucugaaaaauuuaggagcggcuacgagacguucaaggugauugagggguggucacggccaaacaguaaacuacagaucaaucgucaggucauuguggaccgcgauaacagauccggauauagcggcauauuuucuguagaagguaagucaugcaucaauagguguuucuacguugagcucauucgggggcgaaagcaagaaaccgaggugugguggacaaguaacagcaucgucguguuuugcggcacuuccggaaccuauggcacagggucuuggcccgacggagcggauaucaaucugaugccuauuuga

SEQ ID NO: 136373 - RNA, 1410 nt, Artificial Sequence; identical to SEQ ID NO: 136153
  derived and/or modified sequence opt3 from neuraminidase__InfluenzaA__AAZ79530

SEQ ID NO: 136374 - RNA, 1410 nt, Artificial Sequence
  derived and/or modified sequence opt3 from neuraminidase__InfluenzaA__AAZ79552
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccacaucguacucuucugaugaaugaauugggcguucccuuucaccucgguaccaaacagguguguaucgccuggucaagcaguuccugccaugacgggaaagcauggcugcacgucugugugacaggagaugacaagaacgccaccgcuucuuucauuuauaauggcagacugguagauagcaucggcuccuggucaaagaagauccucaggacgcaggagagugaaugcguuuguauuaacgggacuugcacaguggucaugaccgacggaagcgcaucugguaaagccgauacuaagauauuauuuaucgaggagggcaagauugugcacacaucccugcuuucagggagcgcucaacauguggaagagugcaguuguuacccucgguauccaggaguccgcugcguuuguagagacaacuggaaaggcucuaauaggccgaucguggauauaaacguaaaggacuacuccauugugagcucguacgucugcucugguuuggugggggacacuccccggaaaaaugauuccucaaguagcucccacugucuggacccuaacaaugaagagggaggccauggcguuaaggggugggccuucgaugacggaaacgauguguggaugggucgcacgaucucugaaaaacuacgaagcggcuaugagaccuuuaaggucaucgagggguggucaaaaccaaauaguaagcuccagauuaacagacaggugaucguagacagggauaaucgguccggauacagcggcauuuucucuguugaagguaagucaugcauaaaccguuguuuuuauguggagcugauccgcgggagaaaucaggaaacagagguccuuuggaccaguaacagcauuguggucuucugcggcaccuccggaacauacggcacugggucuuggcccgacggagcggauaucaaucugaugccuaucuga

SEQ ID NO: 136375 - RNA, 1410 nt, Artificial Sequence; identical to SEQ ID NO: 136295
  derived and/or modified sequence opt3 from neuraminidase__InfluenzaA__AAZ79563

SEQ ID NO: 136376 - RNA, 1410 nt, Artificial Sequence; identical to SEQ ID NO: 136295
  derived and/or modified sequence opt3 from neuraminidase__InfluenzaA__AAZ79574

SEQ ID NO: 136377 - RNA, 1410 nt, Artificial Sequence; identical to SEQ ID NO: 136295
  derived and/or modified sequence opt3 from neuraminidase__InfluenzaA__AAZ79585

SEQ ID NO: 136378 - RNA, 1410 nt, Artificial Sequence; identical to SEQ ID NO: 136362
  derived and/or modified sequence opt3 from neuraminidase__InfluenzaA__AAZ79618

SEQ ID NO: 136379 - RNA, 1410 nt, Artificial Sequence; identical to SEQ ID NO: 136343
  derived and/or modified sequence opt3 from neuraminidase__InfluenzaA__AAZ79633

SEQ ID NO: 136380 - RNA, 1410 nt, Artificial Sequence; identical to SEQ ID NO: 136362
  derived and/or modified sequence opt3 from neuraminidase__InfluenzaA__AAZ79945

SEQ ID NO: 136381 - RNA, 1410 nt, Artificial Sequence; identical to SEQ ID NO: 136359
  derived and/or modified sequence opt3 from neuraminidase__InfluenzaA__AAZ79966

SEQ ID NO: 136382 - RNA, 1410 nt, Artificial Sequence; identical to SEQ ID NO: 136343
  derived and/or modified sequence opt3 from neuraminidase__InfluenzaA__AAZ79977

SEQ ID NO: 136383 - RNA, 1410 nt, Artificial Sequence; identical to SEQ ID NO: 136343
  derived and/or modified sequence opt3 from neuraminidase__InfluenzaA__AAZ79988

SEQ ID NO: 136384 - RNA, 1410 nt, Artificial Sequence
  derived and/or modified sequence opt3 from neuraminidase__InfluenzaA__AAZ79999
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagaugaugcugugugaaccgacuauaaucgagagaaauauuaccgaaaucguuuauuugacaaacaccacuauugagaaggaaaucugccccaaauuagcugaguacaggaauuggaguaagccucagugugacauaacaggguucgcaccauuuagcaaagauaacuccauucggcugucugccggaggugacaucugggugacccgcgagcccuauguaucgugcgauccugacaaguguuaccaauucgcgcuaggccaggggacgacucucaauaacgugcauucaaaugauaccguccacgaccgaacaccauaucguacucugcuuaugaacgaacugggagugcccuuucauuugggcaccaagcagguuugcauugcuuggagcaguuccucuugucacgaugguaaagccuggcuccaugugugcgucacaggggacgauaagaaugcaaccgccagcuucaucuacaacggaagacugguggacuccaucguaucauggaguaaagauauucugaggacgcaggagagcgaauguguuugcauaaauggcacuuguacaguggucaugaccgacggcucugcuuccgggaaggcagauacuaaaauccucuuuauugaggagggaaagaucgugcacacaucaaccuuaagcgguagugcccaacacguggaagagugcucuugcuauccucgguacccaggcguccgcuguguuugcagagacaacuggaagggguccaacaggccgauaguggacauuaauaucaaagauuacagcaucguaucgucuuauguguguuccggacuggucggcgacacgccccggaagaacgauucaaguagcuccucucauugccuugacccuaauaacgaagagggugggcacggagugaaaggcugggcuuucgaugacggcaaugauguuuggauggggcgcaccauuagcgaaaaguugcgacugggauacgagacauuuaaagugaucgaggguuggucaaacccaaauaguaagcuacagauuaacagacaggucauaguggaaaggggcaaucgguccggguauagcggaaucuucucuguagagggcaaaucauguauuaaccguugcuuuuacguugaacucauccgcgguagaaaggaggaaacugaggugcuguggaccaguaauagcaucgucguguucugugggacauccggcacuuauggaaccggcucuuggcccgacggggccgauauuaaccuuaugccuauauga

SEQ ID NO: 136385 - RNA, 1410 nt, Artificial Sequence; identical to SEQ ID NO: 136131
  derived and/or modified sequence opt3 from neuraminidase__InfluenzaA__AAZ80010

SEQ ID NO: 136386 - RNA, 1410 nt, Artificial Sequence
  derived and/or modified sequence opt3 from neuraminidase__InfluenzaA__AAZ80021
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcgugacaggggacgauaagaaugcaaccgccagcuucaucuacaacggaaggcugguagacuccaucguuucauggaguaaagagauucugcggacgcaggaaagcgagugugugugcauaaauggcacuugugcugucgugaugacagauggcucugcauccgggaaggccgacaccaaaauccucuuuauugaggaaggaaagaucgugcauacuucaaaguuaagcgguagugcucaacacgucgaggaaugcucuugcuauccucgcuacccaggcauaagauguguuugcagggauaacuggaaaggguccaaccggccgauuguggacaucaauaucaaggacuacagcauuguaucgucuuauguguguuccggacuggucggcgauacaccccgcaaaaacgacucaaguagcuccucucacugccuugauccuaauaacgaggaaggugggcauggagugaagggcugggccuucgacgauggcaaugacguuuggauggggcgaaccaucagcgagaaauugagaucaggauacgagacguuuaaggugauugaagguuggaguaacccaaauuccaaacugcagauaaacaggcaggucaucguggaucggggcaaucguagcggguauucuggaauuuucucaguagagggcaagaguuguaucaaccgcugcuuuuacguugaacuaaucagagguaggaaggaggaaaccgaggugcucuggacaagcaauuccauugucguguucugugggacuucuggcaccuauggaacaggcucguggcccgacggggcggauauaaaccugaugccuaucuga

SEQ ID NO: 136387 - RNA, 1410 nt, Artificial Sequence
  derived and/or modified sequence opt3 from neuraminidase__InfluenzaA__AAZ83245
augaaccccaaucagaagaucauuaccauaggcagcgugucccugacaaucucuacuauuugcuucuuuaugcaaaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaauuagcugaguacaggaauuggucaaagccacaguguaacauaacaggguucgcacccuuuaguaaagacaauagcauucggcuguccgccggaggugauaucuggguaacccgcgagccuuaugugucuugcgacccagauaaguguuaccaauucgcgcuaggccaggggacgacucucaacaauguccauucgaacgacaccgugcacgaucgaacacccuaucguacucugcuuaugaaugaacugggaguuccuuuucauuugggcaccaaacaggugugcauugcuuggucaagcaguuccugucacgacgguaaggccuggcuccaugucugcgugacaggggaugacgagaacgcaaccgccucuuucaucuacaauggaagacugguagauagcaucguuuccuggucaaagaaaauucugaggacgcaggaaagugagugugugugcauaaacggcacuuguacagucgugaugaccgacggcagcgcuucugggaaggcagauacuaaaauccucuuuauugaggaaggaaagaucgugcacacauccaccuuaucagguagcgcccaacacgucgaggaaugcaguugcuauccacgguacccgggcguucgcugugugugcagagacaacuggaaggggucuaauaggcccauaguagauauuaacaucaaagacuacuccaucgugagcucguaugucuguucuggacuggugggcgacacgccucggaagaaugauuccucaaguagcucccauugccuugacccaaacaaugaggaaggugggcacggaguuaaaggcugggcuuucgaugacggcaacgauguguggauggggcgcaccauuucugagaaguugcgaagcggauacgagacauuuaaagucaucgaagguuggucaaaucccaacaguaagcugcagauuaauagacaggugauaguagacagggauaaccgguccggcuauagcgggaucuucucuguugagggaaaaucauguauuaaucguugcuuuuacguggaacuaauccgcggcagaaaccaggagacugaaguccucuggaccaguaauagcaucguggucuucugugguacauccgggacuuauggcaccggaucuuggccugacggcgccgauauuaaccugaugccaauauga

SEQ ID NO: 136388 - RNA, 1413 nt, Artificial Sequence
  derived and/or modified sequence opt3 from neuraminidase__InfluenzaA__AAZ83256
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcaaggggucauguaacccggucacuguugauggagccgacggcgugaaagguuucaguuacaaguaugggaauggcguauggaucggaaggacaaaauccaaccggcugcgcaagggcuuugagaugaucugggaccccaauggguggaccgauacugacagcgauuucucugugaagcaagacgucguggcuauuacagauuggucaggauacagugguagcuuuguucagcauccugaacucaccggcuuagacugcauacgaccauguuucuggguggagcuggucagagggcuucccagggaaaacacgaccaucuggacauccggaucuucgauuagcuucugcggcaucgauuccgacacugccaauuggucauggccugauggugcagaguugccauuuaccauugacaaauga

SEQ ID NO: 136389 - RNA, 1410 nt, Artificial Sequence; identical to SEQ ID NO: 136295
  derived and/or modified sequence opt3 from neuraminidase__InfluenzaA__AAZ83269

SEQ ID NO: 136390 - RNA, 1410 nt, Artificial Sequence; identical to SEQ ID NO: 136295
  derived and/or modified sequence opt3 from neuraminidase__InfluenzaA__AAZ83280

SEQ ID NO: 136391 - RNA, 1410 nt, Artificial Sequence; identical to SEQ ID NO: 136269
  derived and/or modified sequence opt3 from neuraminidase__InfluenzaA__AAZ83291

SEQ ID NO: 136392 - RNA, 1413 nt, Artificial Sequence
  derived and/or modified sequence opt3 from neuraminidase__InfluenzaA__AAZ83302
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaaggccucgguaacccuugcgggaaauucaagccuguguaguauuuccggcugggcuaucuacacaaaagauaacucuaucaggauugguagcaagggggacguguucgucauacgggagccuuuuaucuccugcucacauagugagugucgcaccuucuuuuugacucaaggagccuuacugaaugauaaacacagcaacggcacagugaaggaccgaucuccauaucgugcacuaauguccugcccgcucggcgaagcccccucaccuuacaauagcaaguucgagaguguugcuuggucugcauccgccugucaugaugggaugggauggcugaccauugguaucagcggcccagacaacggggcuguggccguccuuaaauauaacggaauaauuacggaaacuaucaagucguggaaaaagcagauccugagaacccaggagucugagugcguguguguaaauggcuccugcuuuacaauuaugacugauggucccucaaacggggcggcaaguuacaaaaucuucaagauugaaaagggaaaaguuaccaagagcauagaguugaaugccccuaacuuucacuaugaagaguguuccugcuacccagacacaggcaccgugaugugugucugcagggauaauuggcacggcucuaaccggcccugggugagcuucaaucagaaccucgacuaccaaaucggguauauuugcucaggaguguuuggugauaauccucgcccaaaagacggcgaggggaguuguaacccggucacgguugauggagcuaauggcgugaaggguuucuccuacaaauaugggaacggcguauggaucggaagaacuaagagcaauaggcugcggaaaggcuuugaaaugaucugggaccccaacggguggacagacaccgauucugacuucucagugaagcaggaugucguggccauuacugacuggaguggauacagcgguuccuuuguucagcauccugagcugacaggccucgauugcauacgcccauguuucuggguggaauuaguccgagggcugcccaaggagaauaccacgaucuggaccucuggaucgagcauuuccuucugcggcgugaacucagacacagcaaacuggaguuggccugauggugcugaacuuccauuuacuaucgacaaauga

SEQ ID NO: 136393 - RNA, 1410 nt, Artificial Sequence
  derived and/or modified sequence opt3 from neuraminidase__InfluenzaA__AAZ83315
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuaucauagagagaaauaucaccgaaauuguauaucugacaaacaccacuaucgagaaggaaauuuguccgaaacuagcagaguacaggaauuggucaaagccccagugcaaaaucacaggguucgccccuuuuaguaaggacaacagcauacggcucuccgcgggaggugauauuugggugacccgcgagccauaugucucuugugaccccgauaagugcuaccaauucgcucugggccaggggacgacucuuaauaaccgacauucgaaugacaccgugcacgaucguacaccuuauagaacucuguugaugaacgaacucggaguuccauuucaucugggcaccaaacagguguguaucgccuggucaagcaguuccugccacgacgguaaggcauggcugcaugucugugugacagggcacgaugagaaugccaccgcuucuuucauuuacgacggaaggcucguagauagcaucggcuccuggaguaaaaagaucuuacggacgcaggaaucagagugcguuuguauuaacggcacuugcacaguggucaugaccgacgggagcgcaucuggacgcgccaauacuaaaauacuguuuaucgaggaagguaagauuauccacauaucccaacuuucaggcagcgcucagcauguggaggaaugcaguuguuaucccagauacccuggggugaggugcgucugucgggauaacuggaagggaucuaaccgcccaauuguugacaucaaugugaaagauuacuccaucgccagcucguauguaugcucuggcuuggugggugacacaccgcgaaagaacgacuccucaaguagcucccacugucugaaucccaacaaugaggaagggggacauggcgucaaaggcugggcguucgaugacgggaacgauguguggaugggaagaaccauuucugagaaguuuaggagcgguuacgagacguucaaaguuaucgaaggcuggucaaagccuaauaguaaacuacagauuaaccgucaggugauagucgaccgggauaaucgcuccggguauagcggaaucuuuucuguggagggcaagucaugcauuaacagauguuucuacguagaacucaucaggggucggaagcaagagaccgaaguuugguggacaaguaauagcaucguggucuuuugcgggacuuccggcaccuauggaacaggcucuuggccagacggggcagauauuaaccugaugcccauauga

SEQ ID NO: 136394 - RNA, 1410 nt, Artificial Sequence
  derived and/or modified sequence opt3 from neuraminidase__InfluenzaA__AAZ83326
augaaccccaaucagaagaucauuaccauaggcagcgugucccugacaaucgccacuauuugcuuccucaugcaaaucgcuauucuugucacgaccguuacacugcacuuuaaacaguacgagugugacucuuugccuaacaaucaggugauguuaugcgaaccaacuaucauagagagaaacaucaccgaaauuguauaucugacaaauaccacuaucgagaaggaaauuuguccgaaacuagcagaguacaggaacuggucaaagccccagugcaaaaucacaggguucgccccuuuuaguaaggauaauagcauacggcucuccgcgggaggugacauuugggugacccgcgagccauaugucucuugugaucccgacaagugcuaccaauucgcucugggccaggggacgacucuuaacaaucgacauucgaacgauaccgugcacgaccguacaccuuauagaacucuguugaugaaugaacucggaguuccauuucaucugggcaccaaacagguguguaucgccuggucaagcaguuccugccacgaugguaaggcauggcugcaugucugugugacagggcacgacgagaacgccaccgcuucuuucauuuacgauggaaggcucguagacagcaucggcuccuggaguaaaaagaucuuacggacgcaggaaucagagugcguuuguauuaauggcacuugcacaguggucaugaccgaugggagcgcaucuggacgcgccgacacuaaaauacuguuuaucgaggaagguaagauuauccacauaucccaacuuucaggcagcgcucagcauguggaggaaugcaguuguuaucccagauacccuggggugaggugcgucugucgggauaacuggaagggaucuaaucgcccaauuguugacaucaacgugaaagacuacuccaucguaagcucguaugugugcucuggcuuggucggugauacaccgcgaaagaacgacuccucaaguagcucccacugucugaaucccaacaaugaggaagggggacauggcgugaaaggcugggccuucgaugacgggaacgauguuuggaugggaagaaccauuucugagaaguuuaggagcgguuacgagacguucaaagugaucgaaggcuggucaaagccuaauaguaaacuacagauuaaccggcaggucauaguggaccgugauaaucgcuccggguauagcggaaucuuuucuguagagggcaagucaugcauuaacagauguuucuacguugaacucaucaggggucggaagcaagagaccgaagugugguggacaaguaauagcaucgucguguuuugcgggacuuccggcaccuauggaacaggcucuuggccagacggggcggauauuaaccugaugcccauauga

SEQ ID NO: 136395 - RNA, 1410 nt, Artificial Sequence
  derived and/or modified sequence opt3 from neuraminidase__InfluenzaA__AAZ83374
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuugauccuaauaacgaggaaggugggcacggaguuaaaggcugggcuuucgacgauggcaaugacguguggauggggcgcaccauuagcgagaaguugcgaacaggauacgagacuuuuaaagucaucgaagguuggucaaacccaaauaguaagcugcagauuaacagacaggugauaguagauaggggcaaucgguccggguauagcggaaucuucucuguugagggcaaaucauguauuaaccguugcuuuuacguggaacuaauccgcgguagaaaggaggaaaccgagguccucuggacaaguaauagcaucguggucuucugugggacuuccggcaccuauggaacaggcucuuggcccgacggggccgauauuaaccugaugccuauauga

SEQ ID NO: 136396 - RNA, 1410 nt, Artificial Sequence; identical to SEQ ID NO: 136362
  derived and/or modified sequence opt3 from neuraminidase__InfluenzaA__AAZ83385

SEQ ID NO: 136397 - RNA, 1413 nt, Artificial Sequence
  derived and/or modified sequence opt3 from neuraminidase__InfluenzaA__AAZ85129
augaacaccaaucagaagaucauuacaauaggcagcaucuccauugccaucgggauuaucucucugaugcuccaaauaggaaacaucauuucaaucugggcuagucacagcauucagacugguucccagaaucauacgggcgugugcaaccagagaaucauaaccuacgaaaauucuacaugggucaaccacacuuauguuaauauuaacaauaccaacgugaucgcagggaaagacaagacaucgguaacccuugccggaaauucaagccuguguaguauuuccggcugggcgaucuacacuaaagauaacucuaucaggauugguagcaagggggacguguucgucauacgggagcccuuuaucuccugcucacauuuggagugucgcacauucuuuuuaacccaaggagcucugcuaaaugauaaacacaguaacggcacggugaaggaccgaagcccuuaucgugcccucaugucuugcccacugggcgaagcaccgucccccuacaauucaaaguucgagagcguugccuggagugcuucugcaugucaugaugggaugggauggcuuacuauugguaucuccggcccugacaacggggccguggcuguccugaaauauaacggaauaauuaccgaaacaaucaagagcuggaaaaagcagaucuugagaacucaggagucggagugcguguguguaaauggcucuugcuuuaccauuaugacagaugguccauccaacggggccgcgucauacaaaaucuucaagauugaaaagggaaaaguuaccaagaguauagagcucaaugcacccaacuuucacuaugaagaguguagcugcuacccugacacgggcacugugaugugugucugcagggauaauuggcacggcuccaaccggccaugggugucuuucaaucagaaccuggacuaccaaaucggguauauuugcagcggaguguuuggugauaauccccgcccuaaagacggcgaggggucauguaacccagucacaguugauggagccaauggcgugaaggguuucaguuacaaauaugggaacggcguauggaucggaagaaccaaguccaauaggcugcggaaaggcuuugaaaugaucugggacccgaacggguggacugacacagauagcgacuucucugugaagcaggaugucguggcuauuaccgacuggucaggauacagugguagcuuuguucagcaucccgagcucacgggcuuagauugcauacgcccuuguuucuggguggaacugguccgagggcuuccaaaggagaauaccacaaucuggacuuccggaucuucgauuagcuucugcggcgugaacuccgacaccgccaacuggucauggcccgauggugcagaauugccuuuuacaaucgacaaauga

SEQ ID NO: 136398 - RNA, 1410 nt, Artificial Sequence
  derived and/or modified sequence opt3 from neuraminidase__InfluenzaA__ABA06513
augaaccccaaucagaagaucauuaccauaggcagcgugucccugacaaucgccacuauuugcuuccucacgcaaaucgcuauucuugucaccacaguuacucugcacuuuaaacaguacgaguguaacucuccuccaaauaaccaggugauguugugcgaaccgaccaucauagagagaaauaucacagaaauuguauauuuaaccaacacuacaaucgagaaggaaauuugucccaaacuggcagaguacaggaauuggucaaagccucagugcaacaucaccggguucgccccauuuaguaaagacaauagcauacggcuauccgcgggaggugauauuugggugacgcgcgagcccuaugucucuugugacccugauaagugcuaccaauucgcucucggccaggggacuacccugaacaauggacauucgaacgacacagugcacgaucgaacuccauaucguacccuucugaugaaugaauugggcguucccuuucaucucgguacaaaacagguguguaucgccuggucaagcaguuccugccacgacgggaaagcauggcugcaugucugugugaccggagaugacaagaacgccacggcuucuuucauuuacaauggcagacugguagauagcaucggcuccuggucaaagaagauccucaggacucaggagagugaaugcguuuguauuaacgggacaugcaccguggucaugacugacggaagcgcaucugguaaagccgauacaaagauauuauuuaucgaggagggcaagauugugcacaccucccugcuuucagggagcgcucaacacguggaagagugcaguuguuauccucgguacccaggaguccgcugcguuuguagagacaacuggaaaggcucuaauaggccgaucguggauauaaacguaaaggacuacuccauugugagcucguaugucugcucugguuuggugggggacacgccccggaaaaaugauuccucaaguagcucccauugucuggacccuaacaaugaagagggaggccacggcguuaaggggugggccuucgaugacggaaacgauguguggaugggucgcaccaucucugaaaaacuacgaagcggcuacgagacauuuaaggucaucgagggguggucaaaaccaaauaguaagcuccagauuaacagacaggugaucguagacagggauaaucgguccggauauagcggcauuuucucuguugaagguaagucaugcauaaaccguuguuuuuacguggagcugauccgcgggagaaaucaggaaacugagguccuuuggaccaguaacagcauuguggucuucugcggcacauccggaacuuauggcaccgggucuuggcccgacggagcggauaucaaucugaugccuaucuga

SEQ ID NO: 136399 - RNA, 1410 nt, Artificial Sequence; identical to SEQ ID NO: 136398
  derived and/or modified sequence opt3 from neuraminidase__InfluenzaA__ABA06545

SEQ ID NO: 136400 - RNA, 1413 nt, Artificial Sequence
  derived and/or modified sequence opt3 from neuraminidase__InfluenzaA__ABA08478
augaacaccaaucagaagaucauuacaauaggcagcaucuccauugccaucgggauuaucucucugaugcuccaaauaggaaacaucauuucaaucugggcuagucacagcauucagacugguucccagaaucauacgggcaucugcaaccagagaauaauuaccuacgaaaauucuacaugggugaaccacacuuaugucaauaucaacaauaccaacguuguggcagggaaagacaagacaucgguaacccuugccggaaauucaagccuguguaguauuuccggcugggcgaucuacacuaaagauaacucuaucaggauugguagcaagggggacguguucgucauacgggagcccuuuaucuccugcucacauuuggagugucgcacauucuuuuuaacccaaggagcucugcuaaaugauaaacacaguaacggcacggugaaggaccgaagcccuuaucgugcccucaugucuugcccacugggcgaagcaccgucccccuacaauucaaaguucgagagcguugccuggagugcuucugcaugucaugaugggaugggauggcuuacuauugguaucuccggcccugacaacggggccguggcuguccugaaauauaacggaauaauuaccgaaacaaucaagagcuggaaaaagagaaucuugaggacucaggagucggagugcguguguguaaauggcucuugcuuuaccauuaugacagaugguccauccaacggggccgcgucauacaaaaucuucaagauugaaaagggaaaaguuaccaagaguauagagcucaaugcacccaacuuucacuaugaagaguguagcugcuacccugacacgggcacugugaugugugucugccgggauaauuggcacggcuccaaccgcccaugggugucuuucaaucagaaccuggacuaccagaucggguauauuugcagcggaguguuuggugauaaucccagaccuaaagacggcaaggggucauguaacccagucacaguugauggagccgacggcgugaaagguuucaguuacaaguaugggaauggcguauggaucggaaggaccaaauccaaccggcugcgcaagggcuuugagaugaucugggacccgaauggguggacugauacagacagcgauuucucugugaagcaagacgucguggcuauuaccgauuggucaggauacagugguagcuuuguucagcaucccgaacucacgggcuuagacugcauacgaccuuguuucuggguggagcuggucagagggcuuccaagggaaaacaccacaaucuggacuuccggaucuucgauuagcuucugcggcguggauuccgacaccgccaauuggucauggcccgauggugcagaguugccuuuuacaaucgacaaauga

SEQ ID NO: 136401 - RNA, 1410 nt, Artificial Sequence; identical to SEQ ID NO: 136398
  derived and/or modified sequence opt3 from neuraminidase__InfluenzaA__ABA08511

SEQ ID NO: 136402 - RNA, 1413 nt, Artificial Sequence
  derived and/or modified sequence opt3 from neuraminidase__InfluenzaA__ABA12699
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcaaggggucauguaacccggucacuguugauggagccgacggcgugaaagguuucaguuacaaguaugggaauggcguauggaucggaaggacaaaauccaaccggcugcgcaagggcuuugagaugaucugggaccccaauggguggaccgauacugacagcgauuucucugugaagcaagacgucguggcuauuacagauuggucaggauacagugguagcuuuguucagcauccugaacucaccggcuuagacugcauacgaccauguuucuggguggagcuggucagagggcuucccagggaaaacacgaccaucuggacauccggaucuucgauuagcuucugcggcguggauuccgacacugccaauuggucauggccugauggugcagaguugccauuuaccaucgacaaauga

SEQ ID NO: 136403 - RNA, 1413 nt, Artificial Sequence; identical to SEQ ID NO: 136402
  derived and/or modified sequence opt3 from neuraminidase__InfluenzaA__ABA12710

SEQ ID NO: 136404 - RNA, 1413 nt, Artificial Sequence
  derived and/or modified sequence opt3 from neuraminidase__InfluenzaA__ABA12721
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagcagaucuugagaacacaggagucggagugcguguguguaaauggcucuugcuuuacuauuaugaccgauggucccuccaacggggccgcgucauacaaaaucuucaagauuggaaagggcaaaguuacaaagaguauagaacucaaugcaccuaacuuucacuaugaggaauguagcugcuacccagacaccggcacggugaugugugucugcagggauaauuggcacggguccaaccggcccugggugucuuucaaucagaaccuggacuaccaaaucggauauauuugcagcgguguguuuggcgauaauccucgcccaagagacggggagggaucauguaacccggucacuguugauggcgccaauggugugaaaggguucaguuacaaguauggcaacggaguauggaucggcaggacaaaauccaaucggcugcgcaagggguuugagaugaucugggaccccaacggauggaccgacacugauagcgacuucucugugaaacaggaugucguggcuauuacagacuggucagguuacaguggcagcuuuguucagcauccugaacucaccggguuagauugcauacgaccauguuucuggguggagcuggucagaggacuucccagggaaaauacgaccaucuggacauccgguucuucgauuagcuucugcggcgugaacuccgacacugccaacuggucauggccugauggggcagaguugccauuuaccaucgacaaguga

SEQ ID NO: 136405 - RNA, 1413 nt, Artificial Sequence; identical to SEQ ID NO: 136402
  derived and/or modified sequence opt3 from neuraminidase__InfluenzaA__ABA12732

SEQ ID NO: 136406 - RNA, 1410 nt, Artificial Sequence; identical to SEQ ID NO: 136343
  derived and/or modified sequence opt3 from neuraminidase__InfluenzaA__ABA12743

SEQ ID NO: 136407 - RNA, 1410 nt, Artificial Sequence; identical to SEQ ID NO: 136359
  derived and/or modified sequence opt3 from neuraminidase__InfluenzaA__ABA12754

SEQ ID NO: 136408 - RNA, 1410 nt, Artificial Sequence; identical to SEQ ID NO: 136362
  derived and/or modified sequence opt3 from neuraminidase__InfluenzaA__ABA12765

SEQ ID NO: 136409 - RNA, 1410 nt, Artificial Sequence; identical to SEQ ID NO: 136134
  derived and/or modified sequence opt3 from neuraminidase__InfluenzaA__ABA12776

SEQ ID NO: 136410 - RNA, 1410 nt, Artificial Sequence; identical to SEQ ID NO: 136343
  derived and/or modified sequence opt3 from neuraminidase__InfluenzaA__ABA12786

SEQ ID NO: 136411 - RNA, 1410 nt, Artificial Sequence; identical to SEQ ID NO: 136362
  derived and/or modified sequence opt3 from neuraminidase__InfluenzaA__ABA18029

SEQ ID NO: 136412 - RNA, 1413 nt, Artificial Sequence
  derived and/or modified sequence opt3 from neuraminidase__InfluenzaA__ABA18040
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagcagaucuugagaacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugcagggauaauuggcacggcuccaaccggcccugggugucuuucaaucagaaccuggacuaccaaaucggguauauuugcagcggaguguuuggugauaauccucgcccaaaagacggcgaggggucauguaacccggucacuguugauggagccaauggcgugaaggguuucaguuacaaauaugggaacggcguauggaucggaagaacaaaguccaauaggcugcggaaaggcuuugaaaugaucugggaccccaacggguggaccgacacugauagcgacuucucugugaagcaggaugucguggcuauuacagacuggucaggauacagugguagcuuuguucagcauccugagcucaccggcuuagauugcauacgcccauguuucuggguggaacugguccgagggcuucccaaggagaauacgaccaucuggacauccggaucuucgauuagcuucugcggcgugaacuccgacacugccaacuggucauggccugauggugcagaauugccauuuaccaucgacaaauga

SEQ ID NO: 136413 - RNA, 1410 nt, Artificial Sequence
  derived and/or modified sequence opt3 from neuraminidase__InfluenzaA__ABA18126
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacaucuccacacugucagggagcgcucaacacguggaggaaugcaguuguuauccucgguacccaggaguccgcugcguuuguagagacaacuggaagggcucuaauaggccgauaguggauauuaacguaaaagacuacuccaucgugagcucguaugucugcucuggucuugugggggacacgccccggaagaaugauuccuucucaaguagccauuguuuggacccuaacaaugaggaaggaggccacggcguuaaagggugggccuuugaugacggaaacgauauguggaugggucgcaccaucuccgagaagcugcgaucuggcuacgagaccuucaaagugauugaaggguggagcaagccaaauucaaaacuacagaucaacagacaggucauuguggagaggggaaaucggaguggcuauuccgguauauuuagcguagaagggaagucuugcaucaaccguuguuucuacguugagcucauucgcggcagaaaggaagagacagaggugugguggacuucaaauaguaucgucguguuuugcggaaccagcggcacauaugggacuggauccuggcccgacggugcggauaucaaccugaugccuauuuga

SEQ ID NO: 136414 - RNA, 1413 nt, Artificial Sequence; identical to SEQ ID NO: 136402
  derived and/or modified sequence opt3 from neuraminidase__InfluenzaA__ABA18148

SEQ ID NO: 136415 - RNA, 1410 nt, Artificial Sequence
  derived and/or modified sequence opt3 from neuraminidase__InfluenzaA__ABA18159
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuugugcugucgugaugacagauggcucugcauccgggaaggccgacaccaaaauccucuuuauugaggaaggaaagaucgugcacacuucaaaguuaagcgguagugcucaacacgucgaggaaugcucuugcuauccucgguacccaggcauacgcuguguuugcagagauaacuggaaaggguccaacaggccgauuguggacguaaauaucaaggacuacagcaucgugucgucuuaugucuguuccggacuggugggcgauacaccccggaaaaacgacucaaguagcuccucucauugccuugauccuaauaacgaggaaggugggcacggaguuaagggcugggccuucgacgauggcaaugacguguggauggggcgcaccauuagcgagaaauugcgaucaggauacgagacguuuaaggucaucgaagguuggaguaacccaaauuccaaacugcagauuaacagacaggugauaguagauaggggcaaucggagcggguauucuggaaucuucucaguugagggcaagaguuguauuaaccguugcuuuuacguggaacuaauccgcgguagaaaggaggaaaccgagguccucuggacaagcaauuccaucguggucuucugugggacuucuggcaccuauggaacaggcucguggcccgacggggcggauauuaaccugaugccuauauga

SEQ ID NO: 136416 - RNA, 1410 nt, Artificial Sequence; identical to SEQ ID NO: 136343
  derived and/or modified sequence opt3 from neuraminidase__InfluenzaA__ABA26703

SEQ ID NO: 136417 - RNA, 1410 nt, Artificial Sequence; identical to SEQ ID NO: 136343
  derived and/or modified sequence opt3 from neuraminidase__InfluenzaA__ABA26714

SEQ ID NO: 136418 - RNA, 1410 nt, Artificial Sequence; identical to SEQ ID NO: 136343
  derived and/or modified sequence opt3 from neuraminidase__InfluenzaA__ABA26736

SEQ ID NO: 136419 - RNA, 1410 nt, Artificial Sequence; identical to SEQ ID NO: 136343
  derived and/or modified sequence opt3 from neuraminidase__InfluenzaA__ABA26747

SEQ ID NO: 136420 - RNA, 1410 nt, Artificial Sequence; identical to SEQ ID NO: 136343
  derived and/or modified sequence opt3 from neuraminidase__InfluenzaA__ABA26758

SEQ ID NO: 136421 - RNA, 1410 nt, Artificial Sequence; identical to SEQ ID NO: 136343
  derived and/or modified sequence opt3 from neuraminidase__InfluenzaA__ABA26769

SEQ ID NO: 136422 - RNA, 1410 nt, Artificial Sequence; identical to SEQ ID NO: 136343
  derived and/or modified sequence opt3 from neuraminidase__InfluenzaA__ABA26780

SEQ ID NO: 136423 - RNA, 1410 nt, Artificial Sequence; identical to SEQ ID NO: 136343
  derived and/or modified sequence opt3 from neuraminidase__InfluenzaA__ABA26791

SEQ ID NO: 136424 - RNA, 1410 nt, Artificial Sequence; identical to SEQ ID NO: 136343
  derived and/or modified sequence opt3 from neuraminidase__InfluenzaA__ABA26802

SEQ ID NO: 136425 - RNA, 1413 nt, Artificial Sequence
  derived and/or modified sequence opt3 from neuraminidase__InfluenzaA__ABA42250
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcaaggggucauguaacccggucacuguugauggagccgacggcgugaaagguuucaguuacaaguauggggacggcguauggaucggaaggacaaaauccaaucggcugcgcaagggcuuugagaugaucugggaucccaacggguggaccgacacugauagcgacuucucugugaagcaagaugucguggcuauuacagacuggucaggauacagugguagcuuuguucagcauccugaacucaccggcuuagauugcauacgaccauguuucuggguggagcuggucagagggcuucccagggaaaauacgaccaucuggacauccggaucuucgauuagcuucugcggcguggacuccgauacugccaacuggucauggccugacggugcagaguugccauuuaccaucgauaaauga

SEQ ID NO: 136426 - RNA, 1413 nt, Artificial Sequence; identical to SEQ ID NO: 136412
  derived and/or modified sequence opt3 from neuraminidase__InfluenzaA__ABA42261

SEQ ID NO: 136427 - RNA, 1410 nt, Artificial Sequence
  derived and/or modified sequence opt3 from neuraminidase__InfluenzaA__ABA42272
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagauauucugaggacgcaggagagcgaaugugugugcauaaauggcacuuguacagucgugaugaccgacggcucugcuuccgggaaggcagauacuaaaauccucuuuauugaggagggaaagaucgugcacacaucaaccuuaagcgguagugcccaacacgucgaagagugcucuugcuauccucgguacccaggcguucgcugugugugcagagacaacuggaagggguccaacaggccgauaguagacauuaauaucaaagauuacagcaucgugucgucuuaugucuguuccggacuggugggcgacacgccccggaagaacgauucaaguagcuccucucauugccuugacccuaauaacgaagagggugggcacggaguuaaaggcugggcuuucgaugacggcaaugauguguggauggggcgcaccauuaacgaaaaguugcgacugggauacgagacauuuaaagucaucgaggguuggagcaauccaaacucaaagcuacagauuaauagacaggugauaguagaaaggggcaaccggaguggguauuccggaaucuucagcguugagggcaaaucuuguauuaaucguugcuuuuacguggaacucauccgcgguagaaaggaggaaacugagguccuguggaccucaaacaguaucguggucuucugugggacaagcggcacuuauggaaccggcuccuggcccgacggggccgauauuaaucuuaugccuauauga

SEQ ID NO: 136428 - RNA, 1410 nt, Artificial Sequence; identical to SEQ ID NO: 136343
  derived and/or modified sequence opt3 from neuraminidase__InfluenzaA__ABA42294

SEQ ID NO: 136429 - RNA, 1410 nt, Artificial Sequence; identical to SEQ ID NO: 136170
  derived and/or modified sequence opt3 from neuraminidase__InfluenzaA__ABA42305

SEQ ID NO: 136430 - RNA, 1410 nt, Artificial Sequence; identical to SEQ ID NO: 136180
  derived and/or modified sequence opt3 from neuraminidase__InfluenzaA__ABA42316

SEQ ID NO: 136431 - RNA, 1413 nt, Artificial Sequence
  derived and/or modified sequence opt3 from neuraminidase__InfluenzaA__ABA42327
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugugaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcgaggggucauguaacccggucacuguugauggagccgacggcgugaaggguuucaguuacaaauaugggaauggcguauggaucggaaggacaaaguccaaccggcugcgcaaaggcuuugaaaugaucugggaccccaauggguggaccgauacugacagcgauuucucugugaagcaagacgucguggcuauuacagauuggucaggauacagugguagcuuuguucagcauccugagcucaccggcuuagacugcauacgaccauguuucuggguggaacuggucagagggcuucccagggagaacacgaccaucuggacauccggaucuucgauuagcuucugcggcgucaauuccgauacugccaacuggucauggccugacggugcagaauugccauuuaccaucgauaaguga

SEQ ID NO: 136432 - RNA, 1410 nt, Artificial Sequence; identical to SEQ ID NO: 136165
  derived and/or modified sequence opt3 from neuraminidase__InfluenzaA__ABA42338

SEQ ID NO: 136433 - RNA, 1410 nt, Artificial Sequence
  derived and/or modified sequence opt3 from neuraminidase__InfluenzaA__ABA42349
augaaccccaaucagaagaucauuaccauaggcagcgugucccugacaaucgccacuauuugcuuccucaugcaaaucgcuauucuugucacgaccguuacacugcacuuuaaacaguacgagugugacucuccuccaaacaaucaggugauguugugcgaaccgacuaucauagagagaaacaucaccgaaauuguauauuuaacaaauaccacuaucgagaaggaaauuugucccaaacuggcagaguacaggaacuggucaaagccucagugcaauaucacaggguucgccccauuuaguaaagauaacagcauacggcuauccgcgggaggugacauuugggugacccgcgagcccuaugucucuugugauccugacaagugcuaccaauucgcucucggccaggggacgacucugaauaacggacauucgaaugauaccgugcacgaccgaacaccauaucguacucuucugaugaacgaauugggcguucccuuucaucucgguaccagacagguguguaucgccuggucaagcaguuccugccacgaugggaaggcauggcugcaugucugugugacaggagacgaugagaaugccaccgcuucuuucauuuacaacggcaaacugguagacagcaucggcuccuggucaaagaaaauccucaggacgcaggaaagugagugcguuuguauuaaugggacuugcacaguggucaugaccgauggaagcgcaucugguaaggccgacacuaaaauauuauuuaucgaggaaggcaagauugugcacaucuccacacugucagggagcgcucaacacguggaggaaugcaguuguuauccucgguacccaggaguccgcugcguuuguagagauaacuggaagggcucuaacaggccgauaguggacauuaauguaaaagacuacuccaucgugagcucguaugucugcucuggucuugugggggauacgccccggaagaacgacuccuucucaaguagccauuguuuggauccuaauaacgaggaaggaggccacggcguuaaagggugggccuuugacgauggaaaugacguguggaugggucgcaccaucuccgagaagcugcgaucuggcuacgagaccuucaaagucauugaaggguggagcaagccaaacucaaaacuacagaucaauagacaggugauuguagagaggggaaaccggaguggcuauuccgguauauuuagcguugaagggaagucuugcaucaaucguuguuucuacguggagcucauucgcggcagaaaggaagagacagaggucugguggacuucaaacaguaucguggucuuuugcggaaccagcggcacauaugggacuggauccuggcccgauggugcggacaucaaucugaugccuauuuga

SEQ ID NO: 136434 - RNA, 1410 nt, Artificial Sequence; identical to SEQ ID NO: 136170
  derived and/or modified sequence opt3 from neuraminidase__InfluenzaA__ABA42360

SEQ ID NO: 136435 - RNA, 1410 nt, Artificial Sequence; identical to SEQ ID NO: 136165
  derived and/or modified sequence opt3 from neuraminidase__InfluenzaA__ABA42371

SEQ ID NO: 136436 - RNA, 1410 nt, Artificial Sequence; identical to SEQ ID NO: 136180
  derived and/or modified sequence opt3 from neuraminidase__InfluenzaA__ABA42382

SEQ ID NO: 136437 - RNA, 1410 nt, Artificial Sequence; identical to SEQ ID NO: 136165
  derived and/or modified sequence opt3 from neuraminidase__InfluenzaA__ABA42393

SEQ ID NO: 136438 - RNA, 1410 nt, Artificial Sequence
  derived and/or modified sequence opt3 from neuraminidase__InfluenzaA__ABA42404
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccggcaaucauagagagaaauaucacugaaauuguauauuuaaccaacacaaccaucgagaaggaaauuugucccaaacuggccgaguacaggaauuggucaaagccucagugcaacaucacuggguucgcgccauuuaguaaagacaauagcauacggcuauccgcuggaggugauauuugggugacacgcgagcccuaugucucuugugacccugauaagugcuaccaauucgcccucggccaggggaccacgcugaacaauggacauucgaacgacacugugcacgaucgaaccccauaucguacacuucugaugaaugaauugggcguucccuuucaucucgguacuagacagguguguaucgcauggucaagcaguuccugccacgacgggaaggccuggcugcaugucugugugaccggagaugacgagaacgcuacagcaucuuucauuuacaauggcaggcugguagauagcaucggcuccuggaguaaaaagauccuccggacccaggaaagugagugcguuuguauuaacgggacgugcacuguggucaugacagacggaagcgccucugguaaagcugauaccaagauauuauuuaucgaggaaggcaaaauugugaacaucuccacucugccugggucagcccaacacguggaggaaugcagcuguuauccacgcuacccgggagucagaugcguuuguagggacaauuggaagggcaguaaccggcccauaguggauauuaauguaaaggacuacucuaucguguccagcuaugucugcucgggucuugugggggacacaccucgcaaaaacgauucuuucuccucaagucacuguuuggacccaaauaacgaggaaggaggccauggcguuaaggggugggcguuugaugacggaaaugauguguggaugggucgaaccaucagcgagaaacugagauccggcuacgagacguucaaggucauugaaggguggucuaaacccaacagcaagcuacagaucaauaggcaagugauuguagagcggggaaaccguucaggcuauagugguauauuuuccguugaagggaaaagcugcaucaaucgcuguuucuacguggagcucauuagaggcaggaaggaagagaccgaggucugguggacaucuaacucaaucguggucuuuugcggaacuucaggcaccuaugggacaggaagcuggccugacggugcagauaucaaucugaugccaauuuga

SEQ ID NO: 136439 - RNA, 1410 nt, Artificial Sequence; identical to SEQ ID NO: 136180
  derived and/or modified sequence opt3 from neuraminidase__InfluenzaA__ABA42415

SEQ ID NO: 136440 - RNA, 1410 nt, Artificial Sequence; identical to SEQ ID NO: 136187
  derived and/or modified sequence opt3 from neuraminidase__InfluenzaA__ABA42446

SEQ ID NO: 136441 - RNA, 1410 nt, Artificial Sequence
  derived and/or modified sequence opt3 from neuraminidase__InfluenzaA__ABA42457
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaagugagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacccccaggaaaaaugauuccuucucaaguagccauuguuuggacccuaacaaugaggaaggaggccacggcguuaaggggugggccuuugaugacggaaacgauguguggaugggucgaacgaucuccgagaaacugagaucuggcuacgagaccuucaaggucauugaaggguggagcaaaccaaauucaaagcuacagaucaaccgccaggugauuguagagcggggaaaucguaguggcuauuccgguauauuuagcguugaaucuaaaucaugcaucaaccgcuguuucuacguggagcucauuagagggaggaaggaagagacagaggucugguggacuucaaauagcaucguggucuuuugcggcaccuccggaacauauggcacugggucuuggcccgacggagcggauaucaaccugaugccuauuuga

SEQ ID NO: 136442 - RNA, 1410 nt, Artificial Sequence; identical to SEQ ID NO: 136187
  derived and/or modified sequence opt3 from neuraminidase__InfluenzaA__ABA42468

SEQ ID NO: 136443 - RNA, 1410 nt, Artificial Sequence
  derived and/or modified sequence opt3 from neuraminidase__InfluenzaA__ABA42479
augaaccccaaucagaagaucauuaccauaggcagcgugucccugacaaucgccacuauuugcuuccucaugcaaaucgcuauucuugucacgaccguuacacugcacuuuaaacaguacgagugugacucuccuccaaacaaucaggugauguugugcgaaccgacuaucauagagagaaacaucaccgaaauuguauauuuaacaaauaccacuaucgagaaggaaauuugucccaaacuggcagaguacaggaacuggucaaagccucagugcaauaucacaggguucgccccauuuaguaaagauaacagcauacggcuauccgcgggaggugacauuugggugacccgcgagcccuaugucucuugugauccugacaagugcuaccaauucgcucucggccaggggacgacucugaauaacggacauucgaaugauaccgugcacgaccgaacaccauaucguacucuucugaugaacgaauugggcguucccuuucaucucgguaccagacagguguguaucgccuggucaagcaguuccugccacgaugggaaggcauggcugcaugucugugugacaggagacgaugagaaugccaccgcuucuuucauuuacaacggcaggcugguagacagcaucggcuccuggaguaaaaagauccuccggacgcaggaaucagagugcguuuguauuaaugggacuugcacaguggucaugaccgauggaagcgcaucugguaaagccgacacuaagauauuauuuaucgaggaaggcaaaauugugcacaucuccacacugucagggagcgcucaacacguggaggaaugcaguuguuauccucgcuacccaggagucagaugcguuuguagggauaacuggaagggcucuaaccggccgauaguggacauuaauguaaaggacuacuccaucgugagcucguaugucugcucuggucuugugggggauacccccaggaaaaacgacuccuucucaaguagccauuguuuggauccuaauaacgaggacggaggccacggcguuaaggggugggccuuugaugacggaaaugauguguggaugggucgaacgaucuccgaaaaacugagaucuggcuacgagaccuucaaggucauugagggguggagcaaaccaaacucaaagcuacagaucaaucgccaggugauuguagaacggggaaaccguaguggcuauuccgguauauuuagcguugaggggaaaucuugcaucaaucgcuguuucuacguggaacucauuagaggcaggaaggaggaaacagaggucugguggacuucaaacaguaucguggucuuuugcggaaccagcggcacauaugggacuggauccuggcccgacggugcggauaucaaucugaugccuauuuga

SEQ ID NO: 136444 - RNA, 1410 nt, Artificial Sequence
  derived and/or modified sequence opt3 from neuraminidase__InfluenzaA__ABA42490
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccaagcugucagggagcgcucaacacguggaggaaugcaguuguuauccucgcuacccaggagucagaugcguuuguagggacaacuggaagggcucuaaucggccgauaguggauauuaacguaaaagacuacuccaucgugagcucguaugucugcucuggucuugugggggacacaccccgcaagaaugauuccuucucaaguagccauuguuuggacccuaacaaugaggaaggaggccacggcguuaaagggugggccuuugaugacggaaacgauguguggaugggucgaaccaucuccgagaagcugagaucuggcuacgagacguucaaagucauuaagggguggagcaaaccaaauucaaagcuacagaucaacaggcaagugauuguagaacggggaaaucguaguggcuauuccgguauauuuagcguugaggggaagucuugcaucaaccgcuguuucuacguggaacucauuagaggcaggaaagaggaaaccgaggucugguggacaucaaauaguaucguggucuuuugcggaacuagcggcaccuaugggacaggauccuggcccgacggugcggauaucaaccugaugccuauuuga

SEQ ID NO: 136445 - RNA, 1410 nt, Artificial Sequence; identical to SEQ ID NO: 136187
  derived and/or modified sequence opt3 from neuraminidase__InfluenzaA__ABA42501

SEQ ID NO: 136446 - RNA, 1410 nt, Artificial Sequence
  derived and/or modified sequence opt3 from neuraminidase__InfluenzaA__ABA42512
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauaucccacaaacaccacuaucgagaaggaaauuuguccuaaauuagcagaguacaggaauuggucaaagccacagugcaacaucacaggguucgcccccuuuaguaaagacaauagcauacggcuguccgcgggaggugauauuugggugacccgcgagccuuaugucucuugugacccagauaagugcuaccaauucgcucuaggccaggggacgacucucaacaauggacauucgaacgacaccgugcacgaucgaacacccuaucguacucugcuuaugaaugaacugggcguuccuuuucauuuggguaccaaacagguguguaucgccuggucaagcaguuccugccacgacgggaaggcauggcuccaugucugugugacaggagaugacgagaacgccaccgcuucuuucauuuacaauggcagacugguagauagcaucggcuccuggucaaagaaaauccugaggacgcaggaaagugagugcguuuguauuaacgggacuugcacaguggucaugaccgacggaagcgcaucugguaaggccgauacuaaaauacucuuuaucgaggaaggcaagauugugcacacauccucauuaagcgggagugcucaacacguggaggaaugcucuuguuauccacgguacccgggaguccgcugcguuuguagagacaacuggaagggcuccaauaggcccaucguggauauaaacguaaaagacuacagcauugugucgucuuaugucugcuccggucuggugggggacaccccucggaagaaugauucaaguagcuccucucauugucuugacccaaacaaugaggaaggaggccacggcguuaaagggugggccuucgaugacggaaacgauguguggaugggucgcacgaucagcgagaaguugcgaucaggcuacgagaccuuuaaagucaucgaaggguggaguaagcccaauuccaaacugcagauuaacagacaggugaucguagacaggggaaaucggagcggcuauucugguauuuucucaguugaggggaagaguugcauaaaccguuguuuuuacguggaacuaauccgcggcagaaagcaggagacagaaguccucuggacuagcaauuccauuguggucuucugcggaaccucuggcacauaugggacuggaucguggccugauggugcggacaucaaccugaugccaaucuga

SEQ ID NO: 136447 - RNA, 1410 nt, Artificial Sequence; identical to SEQ ID NO: 136077
  derived and/or modified sequence opt3 from neuraminidase__InfluenzaA__ABA42523

SEQ ID NO: 136448 - RNA, 1410 nt, Artificial Sequence; identical to SEQ ID NO: 136077
  derived and/or modified sequence opt3 from neuraminidase__InfluenzaA__ABA42534

SEQ ID NO: 136449 - RNA, 1410 nt, Artificial Sequence; identical to SEQ ID NO: 136269
  derived and/or modified sequence opt3 from neuraminidase__InfluenzaA__ABA42545

SEQ ID NO: 136450 - RNA, 1410 nt, Artificial Sequence
  derived and/or modified sequence opt3 from neuraminidase__InfluenzaA__ABA42556
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacaucccugcuuucagggagcgcucaacacguggaggaaugcaguuguuauccucgguacccaggaguccgcugcguuuguagagacaacuggaagggcucuaauaggccgaucguggauauaaacguaaaagacuacuccauugugagcucguaugucugcucugguuuggugggggacacgccccggaagaaugauuccucaaguagcucccauugucuggacccuaacaaugaggaaggaggccacggcguuaaagggugggccuucgaugacggaaacgauguguggaugggucgcaccaucucugagaagcuacgaagcggcuacgagaccuuuaaagucaucgaaggguggucaaagccaaauaguaaacuccagauuaacagacaggugaucguagacaggggaaaucgguccggcuauagcgguauuuucucuguugaggggaagucaugcauaaaccguuguuuuuacguggaacugauccgcggcagaaagcaggaggcggaaguccuuuggacaaguaauagcauuguggucuucugcggaacuuccggcaccuaugggacaggaucuuggcccgauggugcagacaucaaccugaugccuaucuga

SEQ ID NO: 136451 - RNA, 1410 nt, Artificial Sequence; identical to SEQ ID NO: 136077
  derived and/or modified sequence opt3 from neuraminidase__InfluenzaA__ABA42567

SEQ ID NO: 136452 - RNA, 1410 nt, Artificial Sequence
  derived and/or modified sequence opt3 from neuraminidase__InfluenzaA__ABA42931
augaaccccaaucagaagaucauuaccauaggcagcgugucccugacaaucgccacuauuugcucucucaugcaaaucgcuauucuugucacgaccguuacacugcacuucaaacaguacgaguguaacucaccuccaaauaaccaggugauguugugcgaaccgacuaucauagagagaaauaucaccgaaauuguauauuuaacaaacaccacuaucgagaaggaaauuugucccaaacuggcagaguacaggaauuggaguaagccucagugcaacaucacaggguuugccccauucagcaaagacaauuccauacggcuaucugcgggaggugauauuugggugacccgcgagcccuaugucucgugugacccugauaagugcuaccaauuugcucucggccaggggacgacucugaacaauggacauucaaacgacaccgugcacgaucgaacaccauaucguacucuucugaugaaugaauugggcguucccuuccaucucgguaccaaacagguguguaucgccuggagcaguuccucuugccacgacgggaaggcauggcugcaugucugugugacaggagaugacgagaacgccaccgcuagcuuuauuuacaauggcagacugguagauuccaucggcucauggaguaagaaaauccucaggacgcaggaaagcgagugcguuuguauuaacgggacuugcacaguggucaugaccgacggaucugcauccgguaaggccgauacuaaaauauuauucaucgaggaaggcaagauugugcacacaucacugcuuagcgggagugcucaacacguggaggaaugcucuuguuauccucgguacccaggaguccgcugcguuuguagagacaacuggaagggcuccaauaggccgaucguggauauaaacguaaaagacuacagcauugugucgucuuaugucugcuccgguuuggugggggacacgccccggaagaaugauucaaguagcuccucucauugucuggacccuaacaaugaggaaggaggccacggcguuaaagggugggccuuugaugacggaaacgauguguggaugggucgcaccaucagcgagaagcuacgaucaggcuacgagaccuucaaagucaucgaaggguggaguaagccaaauuccaaacuccagauuaacagacaggugaucguagacaggggaaaucggagcggcuauucugguauauuuucaguugaggggaagaguugcauuaaccguuguuucuacguggaacugauccgcggcagaaagcaggagacagaaguccuuuggacuagcaauuccauuguggucuuuugcggaaccucuggcacauaugggacuggaucguggcccgauggugcggacaucaaccugaugccuaucuga

SEQ ID NO: 136453 - RNA, 1410 nt, Artificial Sequence; identical to SEQ ID NO: 136077
  derived and/or modified sequence opt3 from neuraminidase__InfluenzaA__ABA42942

SEQ ID NO: 136454 - RNA, 1410 nt, Artificial Sequence; identical to SEQ ID NO: 136077
  derived and/or modified sequence opt3 from neuraminidase__InfluenzaA__ABA42981

SEQ ID NO: 136455 - RNA, 1410 nt, Artificial Sequence; identical to SEQ ID NO: 136165
  derived and/or modified sequence opt3 from neuraminidase__InfluenzaA__ABA42992

SEQ ID NO: 136456 - RNA, 1413 nt, Artificial Sequence
  derived and/or modified sequence opt3 from neuraminidase__InfluenzaA__ABA43192
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaauucuugccggaaauucaagccuguguaguaucuccggcugggcgaucuacacaaaagauaacucuauuaggauagguagcaagggggacguguucgucauccgggagccuuuuauuuccugcucacauuuggagugucgcaccuucuuuuuaacucaaggagcucugcuaaaugauaaacacaguaacggcacagugaaggaccgaagcccauaucgugcccucaugucuugcccgcugggcgaagcacccuccccuuacaauucaaaguucgagagcguugccuggagugcuucugcaugucaugaugggaugggauggcuuaccaucgguauauccggcccagacaacggggccguggcuguccugaaauauaacggaauuaucacggaaacuaucaagagcuggaaaaagcagauuuugagaacccaggagucggagugcguguguguaaauggcucuugcuuuacaaucaugacugauggucccuccaacggggccgcgucauacaaaauuuucaagauagaaaagggaaaaguuaccaagaguaucgagcucaaugcaccuaacuuucacuaugaagaguguagcugcuacccagacacaggcaccgugaugugugucugcagggauaauuggcacggcuccaaccggcccugggugucuuucaaucagaaccuggacuaccaaauuggguauaucugcagcggaguguuuggugauaauccucgcccaaaagacggcgaggggucauguaacccggucacgguugauggagccaauggcgugaaggguuucaguuacaaauaugggaacggcguauggaucggaagaacuaaguccaauaggcugcggaaaggcuuugaaaugauuugggaccccaacggguggacagacaccgauagcgacuucucugugaagcaggaugucgugucaauaacugacuggaguggauacagcgguuccuuuguucagcauccugagcucacaggcuuagauugcauccgcccauguuucuggguggaacugguccgagggcuucccaaggagaauaccacgauuuggaccucuggaucgagcaucuccuucugcggcgugaacucagacacagcuaacuggaguuggccugauggugccgaauugccauuuacuauugacaaauga

SEQ ID NO: 136457 - RNA, 1410 nt, Artificial Sequence; identical to SEQ ID NO: 136362
  derived and/or modified sequence opt3 from neuraminidase__InfluenzaA__ABA43203

SEQ ID NO: 136458 - RNA, 1410 nt, Artificial Sequence
  derived and/or modified sequence opt3 from neuraminidase__InfluenzaA__ABA43339
augaaccccaaucagaagaucauuaccauaggcagcgugucccugucuaucgccacaauuugcuuccucaugcaaaucgcuauucuugucacuacgguuacccugcacuuuaaacaguacgaguguucaaguccuccaaacaaucaggugaugccgugcgaacccacaaucauagagagaaacaucacugaaauuguauauuugaccaauacaaccaucgagaaggaaauuuguccuaaauuaguggaguacaggaacuggagcaagccacagugcaaaaucacuggguucgcacccuuuuccaaggacaauucuauacggcugucggccggaggugauauuugggucacacgcgagccuuaugugucaugugacccaggcaagugcuaccaauucgcgcuagggcagggaaccacgcucaacaaucgacauagcaacgauacuguucacgaccguacccccuauagaacacugcuuaugaaugaacugggcgugccuuuucauuuggguacuaaacaggucuguauggcuuggaguuccucuagcugccacgaugggaaggccuggcuccauguguguguaaccggacacgacgagaacgcaacagccuccuucaucuacgauggcaggcugguugacucaauuggcaguuggagcaaaaauauccugcggacccaggaaucugagugcguguguaucaacgggacgugcacugucgugaugacagauggauccgcuucagagcgcgcagacaccaagauucucuuuauagaagaggguaaaaucgugcacauuagcccauuaaguggcucugcccaacaugucgaagagugcuccuguuauccgagauaccccgggguuaggugcgugugucgggauaauuggaagggaagcaaccgcccuaucguagacauaaacgugaaggauuacucgauugucucuuccuaugugugcucaggccugguuggugacacuccacgaaagaaugacagaaguagcuccucuuacuguaggaaccccaauaacgaaaaggggagccacggagugaaaggcugggcuuucgaugacggcaaugaugucuggauggggcggacaaucggagaggagcuucguucagguuaugaaaccuuuaaggugaucggcggguggaguacgccuaacuccaaauugcagauuaaucgccagguaaucguugacagcggaaacagaucuggcuacucagguauuuucaguguggaggggaaaagcugcauaaauagguguuuuuaugucgaacugauccggggccgaaaacaggagacccgcgugugguggacauccaacucuauugucguguucugcggaacuucgggcaccuacgggacaggaagcuggccagauggugccgacaucaaucuaaugcccaucuga

SEQ ID NO: 136459 - RNA, 1410 nt, Artificial Sequence
  derived and/or modified sequence opt3 from neuraminidase__InfluenzaA__ABA54916
augaaccccaaucagaagaucauuaccacaggcagcauaugcauggugaucgggauggucucccugaugcuccaaauuggaaacaucauuucuaucuggguuucacacaguauacagacugguacgcagcauagagccgagccuuguaauaggagcaucauuaacuacgaaaauaacaccugggugaaucagacauauguaaaaaucuccaacacuaauuuccuuaccgagaaggcuguggcaucuguccggcuggugggcaacucgucauugugcccaauuagcgggugggccguuuacaguaaagacaauuccauccgcauaggaucuaagggcgauguguuugucauucgagaaccguucaucagcuguucccacuuagagugccguacauuuuuccugacccaaggugcgcuacucaacgacaaacauucaaaugggacugugaaggauagaagucccuauaggacacugaugagcuguccuguaggagaagcuccaucucccuacaacucccgguuugagucaguugccuggagcgcaagugccugccacgacggcaccucuuggcuuacgauuggcaucuccgggccugauaauggagcuguggcaguccugaaguauaacgguaucauuacugacaccauaaaaagcuggcgcaacaauaucuugagagcccaggagucggaaugugcuugcgugaacggcucuuguuucacagugaugacugaugggccauccaauggacaggccucauacaagauuuuuaaaaucgagaagggcaaagucguuaagaguguggaacucaacgcgcccaauuaucauuacgaggagugcagcuguuacccugacgccggugaaauaaccugcguaugcagggauaacuggcacggguccaaucggccaugggugucuuucaaccagaaucuggaguaucaaauuggauacaucuguagcggcgucuuuggcgacaacccgcgccccaaugaugggacaggaucaugcgguccugugaguccaaacggcgcauaugggguuaagggauucuccuuuaaauacggcaaugguguguggaucgggcgaaccaagagcacgaacucuagaucaggcuucgaaaugauuugggaccccaauggauggacuggcacagauaguaacuuuagcgucaaacaggacaucguggcuauuaccgacugguccggguauucuggaucguucguacagcacccugagcugacuggucucgauuguauaaggccaugcuucuggguugaauuaauccggggccgucccaaggagagcacaauuuggaccuccgggucaaguaucucuuuuuguggagugaacagcgacacggucggcugguccuggccggauggugccgagcugccuuucaccaucgacaaauga

SEQ ID NO: 136460 - RNA, 1413 nt, Artificial Sequence
  derived and/or modified sequence opt3 from neuraminidase__InfluenzaA__ABA87048
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgagaauagcaccugggucaaccacacauauguuaauauuaacaauacuaacgugaucgcagggaaagacaagaccucgguaacacuugccggaaauucaagccuguguaguauuuccggcugggcgaucuacaccaaagauaacucuaucaggauugguagcaagggggacguguucgucauacgggaaccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagcagaucuugagaacacaggagucggagugcguguguguaaauggcucuugcuuuacuauuaugaccgauggucccuccaacagggccgcgucauacaaaaucuucaagauugaaaaggggaaaguuacaaagaguguggagcucaaugcaccuaacuuucacuaugaagaguguagcugcuacccagacaccggaacggucaugugugugugccgggauaauuggcacggcuccaaccgccccugggugucuuucaaucagaaccuggacuaccaaauaggcuauaucugcagcggggucuuuggagauaauccuagaccaaaagacggugagggcucauguaacccgguuacuguggauggggccaauggaguaaagggcuucaguuacaaauaugguaacgggguguggauuggcaggacaaaguccaaucggcugcgcaaaggauuugaaaugaucugggaccccaacggcuggaccgacacugauagcgacuucucugucaagcaggaugugguugcuaucacagacuggucaggguacaguggaucuuuugugcagcauccugagcucaccgguuuagauugcauucgaccauguuucugggucgaacuggugagaggccuucccaaggagaauacgaccauauggacauccgggucuucgaucagcuucugcggaguaaacuccgacacugccaacuggucauggccugauggcgcagaauugccauuuaccauugacaaauga

SEQ ID NO: 136461 - RNA, 1413 nt, Artificial Sequence
  derived and/or modified sequence opt3 from neuraminidase__InfluenzaA__ABA87060
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacgggacagccucauacaaaaucuucaagauugaaaagggaaaaguuaccaagaguauagagcucaaugcgccuaacuuucacuaugaagaguguagcugcuacccagacacgggcacugugaugugugucugccgggauaauuggcacggcuccaaccgccccugggugucuuucaaucagaaccuggacuaccagaucggguauauuugcagcggaguguuuggugauaauccuagaccaaaagacggcaaggggucauguaguccggucacaguugauggagcagacggcgugaaagguuucuccuacaaguaugggaacggcguauggaucggaaggaccaaaagcaaucggcugcgcaagggcuuugagaugaucugggaccccaacggguggacugauacagacucugauuucucagugaagcaagacgucguggccauuaccgauuggaguggauacagcgguuccuuuguucagcauccugaacucacgggcuuagacugcauacgaccauguuucuggguggagcuggucagagggcuucccagggaaaauaccacaaucuggacuucuggaucgagcauuuccuucugcggcguggauucagacaccgcuaacuggaguuggccugauggugccgaguugccauuuacaaucgacaaauga

SEQ ID NO: 136462 - RNA, 1413 nt, Artificial Sequence
  derived and/or modified sequence opt3 from neuraminidase__InfluenzaA__ABA87083
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagaaaauaauuacguacaaaaauucuaccugggugaaccacacauaugucaauaucaacaauacuaacguuguggcagggaaggacaagaccucgguaacacuugccggaaauucaagccuguguaguauuuccggcugggcgaucuacaccaaagauaacucuaucagaauugguagcaagggggacguguucgucauaagggagccuuuuaucuccugcucacauuuggaaugucggacuuucuuuuuaacacaaggagcucugcuaaaugauaagcacaguaacggcaccgugaaagaccgcagcccauaucgagcccucaugucuugcccgcugggcgaggcacccuccccuuacaauucaaaguucgaaagcguugccuggagugcuucugcaugucaugaugggaugggauggcuuacgauugguaucuccggcccagacaacggggccguggcuguccugaaauauaacggaauaauuacugagaccaucaagagcuggaaaaagcguaucuugagaacacaggaaucggagugcguguguguaaauggcucuugcuuuacuauuaugaccgauggucccuccaacggggccgcgucauacaagaucuucaaaauugagaagggaaaaguuacaaagaguauagaacucaaugcaccuaacuuucacuaugaggaauguagcugcuacccagacaccggcacggugaugugugucugcagggauaauuggcacggcuccaaccggcccugggugucuuucaaucagaaccuggacuaccagaucggguauauuugcagcggaguguuuggugauaauccucgcccaaaagacggcgaggggucauguaacccggucacuguugauggagccgacggcgugaaggguuucaguuacaaauaugggaauggcguauggaucggaagaacaaaguccaacaggcugcggaagggcuuugagaugaucugggaccccaauggguggaccgauacugacagcguguucucugucaaacaagaugugguugcuauuacagacuggucaggauacagugguagcuuugugcagcauccugaacucaccggcuuagauugcauacgcccauguuucugggucgagcuggugcgagggcuucccagagaaaacacgaccaucuggacauccggaucuucgauuagcuucugcggcguaaauuccgacacugccaacuggucauggccugauggugcagaguugccauuuaccaucgacaaguga

SEQ ID NO: 136463 - RNA, 1413 nt, Artificial Sequence
  derived and/or modified sequence opt3 from neuraminidase__InfluenzaA__ABA87234
augaacagcaaucagaagaucauuaccauaggcuccaucucuauugccaucgggauuaucucacugaugcuccaaauaggaaacaucauuaguaucugggcuagccacuccauucagacagguucucagaaucauacuggcgugugcaaccagagaaucauaacguacgaaaauucgaccugggucaaccacacauauguuaauauuaacaauacuaacgugaucgcagggaaagacaagaccucaguaacacuugccggaaauagcagucuguguuccauuucuggcugggcgaucuacaccaaagauaacagcaucaggauugguuccaagggggacguguucgucauacgggagcccuuuaucucaugcagucauuuggagugucgcacuuucuuuuuaacacaaggagcucugcuaaaugauaaacacagcaacggcaccgugaaggaccgaucuccuuaucgugcccucauguccugcccacugggcgaagcaccgucacccuacaauagcaaguucgagaguguugccuggucugcuuccgcaugucaugaugggaugggauggcuuacgauugguaucagcggcccugacaacggggccguggcuguccugaaauauaacggaauaauuacugaaaccaucaagucguggaaaaagcagaucuugagaacacaggagucugagugcguguguguaaauggcuccugcuuuacuauuaugaccgaugguccaucaaacggggccgcgaguuacaaaaucuucaagauugaaaagggaaaaguuauaaagagcaucgagcucaaugcacccaacuuucacuaugaagaguguuccugcuacccugacacaggcaccgugaugugugucugcagggauaauuggcacggcucuaaccggccaugggugagcuucaaucagaaccuggacuaccaaauuggguauaucugcucaggaguguuuggugauaauccccgcccuaaagacggcgaggggaguuguaacccagucacgguugauggagccaauggcgugaaggguuucuccuacaaauaugggaacggcguauggaucggaagaacuaagagcaauaggcugcggaaaggcuuugaaaugauuugggacccgaacggguggacagacaccgauucugacuucucagugaagcaggaugucguggcuauaacugacuggaguggauacagcgguuccuuuguucagcaucccgagcucacaggcuuagauugcauccgcccuuguuucuggguggaacugguccgagggcuuccaaaggagaauaccacgauuuggaccucuggaucgagcaucuccuucugcggcgugaacucagacacagccaacuggaguuggcccgauggugcagaauugccuuuuacuauugacaaauga

SEQ ID NO: 136464 - RNA, 1410 nt, Artificial Sequence; identical to SEQ ID NO: 136398
  derived and/or modified sequence opt3 from neuraminidase__InfluenzaA__ABB02784

SEQ ID NO: 136465 - RNA, 1413 nt, Artificial Sequence; identical to SEQ ID NO: 136402
  derived and/or modified sequence opt3 from neuraminidase__InfluenzaA__ABB02795

SEQ ID NO: 136466 - RNA, 1413 nt, Artificial Sequence; identical to SEQ ID NO: 136402
  derived and/or modified sequence opt3 from neuraminidase__InfluenzaA__ABB02806

SEQ ID NO: 136467 - RNA, 1413 nt, Artificial Sequence
  derived and/or modified sequence opt3 from neuraminidase__InfluenzaA__ABB02817
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagcagaucuugagaacacaggagucggagugcguguguguaaauggcucuugcuuuacuauuaugaccgauggucccuccaacggggccgcgucauacaaaaucuucaagauugaaaagggaaaaguuacaaagaguguggagcucaaugcaccuaacuuucacuaugaagaguguagcugcuacccagacaccggcacggucaugugugugugcagggauaauuggcacggcuccaaccggcccugggugucuuucaaucagaaccuggacuaccaaauaggguauaucugcagcggagucuuuggugauaauccucgcccaaaagacggcgaggggucauguaacccgguuacuguggauggagccaauggcguaaaggguuucaguuacaaauaugggaacggcguguggauuggaagaacaaaguccaauaggcugcggaaaggcuuugaaaugaucugggaccccaacggguggaccgacacugauagcgacuucucugucaagcaggaugugguugcuaucacagacuggucaggauacagugguagcuuugugcagcauccugagcucaccggcuuagauugcauucgcccauguuucugggucgaacuggugcgagggcuucccaaggagaauacgaccauauggacauccggaucuucgaucagcuucugcggcguaaacuccgacacugccaacuggucauggccugauggugcagaauugccauuuaccauugacaaauga

SEQ ID NO: 136468 - RNA, 1413 nt, Artificial Sequence; identical to SEQ ID NO: 136467
  derived and/or modified sequence opt3 from neuraminidase__InfluenzaA__ABB02828

SEQ ID NO: 136469 - RNA, 1410 nt, Artificial Sequence
  derived and/or modified sequence opt3 from neuraminidase__InfluenzaA__ABB02839
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguugugcugugugaaccgacuauaaucgagagaaauauuaccgaaaucguauauuugacaaacaccacuauugagaaggaaaucugccccaaauuagcugaguacaggaauuggaguaagccucagugugacauaacaggguucgcaccauuuagcaaagauaacuccauucggcugucugccggaggugacaucugggugacccgcgagcccuaugucucgugcgauccugacaaguguuaccaauucgcgcuaggccaggggacgacucucaauaacgugcauucaaaugauaccguucacgaccgaacaccauaucguacucugcuuaugaacgaacugggagugcccuuucauuugggcaccaagcaggucugcauugcuuggagcaguuccucuugucacgaugguaaagccuggcuccaugugugcguaacaggggacgauaagaaugcaaccgccagcuucaucuacaacggaagacugguugacuccaucgugucauggaguaaagagauucugaggacgcaggaaagcgagugugucugcauaaauggcacuuguacaguggugaugaccgauggcucugcuuccgggaaggcagacacuaaaauccucuuuauugaggaaggaaagaucguccacacaucaaccuuaagcgguagugcccaacacguugaggaaugcucuugcuauccucgguacccaggcgugcgcuguguaugcagagauaacuggaagggguccaacaggccgauaguggacauuaauaucaaagacuacagcaucgucucgucuuauguguguuccggacugguuggcgauacgccccggaagaacgacucaaguagcuccucucauugccuugauccuaauaacgaggaaggugggcacggagugaaaggcugggcuuucgacgauggcaaugacgucuggauggggcgcaccauuagcgagaaguugcgaucaggauacgagacauuuaaagugaucgaagguuggaguaacccaaauuccaagcugcagauuaacagacagguaauaguugauaggggcaaucggagcggguauucuggaaucuucucaguggagggcaaaaguuguauuaaccguugcuuuuacgucgaacuaauccgcgguagaaaggaggaaacugaggugcucuggaccagcaauuccaucgucguguucugugggacaucuggcacuuauggaaccggcucguggcccgacggggccgauauuaaccugaugccuauauga

SEQ ID NO: 136470 - RNA, 1410 nt, Artificial Sequence
  derived and/or modified sequence opt3 from neuraminidase__InfluenzaA__ABB02850
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaaccugcugaguacaggaauuggaguaagccacagugugacauaacaggguucgcacccuuuagcaaagauaacuccauucgguuaucugccggaggugacaucuggguaacccgcgagccuuaugugucgugcgauccagacaaguguuaccaauucgcgcugggccaggggacgacucuaaauaacguccauucaaaugauaccgugcacgaccgaacacccuaucguacucuccugaugaacgaacuuggaguuccuuuucaucugggcaccaaacaggugugcauugcuuggagcaguuccucuugucacgaugguaaggccugguugcaugucugcgugacaggggacgauaagaaugcaaccgccagcuucaucuacaacggaagacucguagacuccaucguuucauggaguaaagagauucugaggacgcaggaaagcgagugugugugcauaaauggcacuugugcugucgugaucacagauggcucugcauccgggaaggccgacaccaaaauucuguuuaucgaggaaggaaagauagugcacacuucaaagcucagcgguagugcucaacacgucgaggaaugcucuugcuauccacgguacccgggcauucgcuguguuugcagagauaacuggaaaggguccaacaggcccaucguggacaucaauauuaaggacuacagcaucguaucgucuuauguguguuccggauuagucggcgauacaccucggaaaaacgacucaaguagcuccucucugugccuugauccaaauaacgaggaaggugggcauggagugaagggcugggccuucgacgauggcaaugacguuuggauggggcgcaccauuagcgagaaauugcgaucaggauacgagacguuuaaggugauagaagguuggaguaaccccaauuccaaacugcagaucaacagacaggucauuguggauaggggcaaucggagcggguauucuggaaucuucucaguagagggcaagaguuguaucaaccguugcuuuuacguugaacuaauucgcgguagaaaggaggaaaccgaggugcucuggacaagcaauuccauagucguguucugugggacuucuggcaccuauggaacaggcucguggccugacggggcggauaucaaccugaugccaauuuga

SEQ ID NO: 136471 - RNA, 1410 nt, Artificial Sequence
  derived and/or modified sequence opt3 from neuraminidase__InfluenzaA__ABB02861
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccggcaaucauagagagaaauaucacugaaauuguauauuuaaccaacacaaccaucgagaaggaaauuugucccaaacuggccgaguacaggaauuggucaaagccucagugcaacaucacuggguucgcgccauuuaguaaagacaauagcauacggcuauccgcuggaggugauauuugggugacacgcgagcccuaugucucuugugacccugauaagugcuaccaauucgcccucggccaggggaccacgcugaacaauggacauucgaacgacacugugcacgaucgaaccccauaucguacacuucugaugaaugaauugggcguucccuuucaucucgguacuagacagguguguaucgcauggucaagcaguuccugccacgacgggaaggccuggcugcaugucugugugaccggagaugacgagaacgcuacagcaucuuucauuuacgauggcaggcugguagacagcaucggcuccuggaguaaaaagauccuccggacccaggaaucagagugcguuuguauuaaugggacgugcacuguggucaugacagauggaagcgccucugguaaagcugacaccaagauauuauuuaucgaggaaggcaaaauugugaacaucuccacucugucagggagcgcccaacacguggaggaaugcaguuguuauccucgcuacccaggagucagaugcguuuguagggauaacuggaagggcucuaaucggccgauaguggacauuaacguaaaggacuacuccaucgugagcucguaugucugcucuggucuugugggggauacaccccgcaaaaaugacuccuucucaaguagccacuguuuggauccuaacaaugaggaaggaggccauggcguuaaggggugggcguuugacgauggaaacgacguguggaugggucgaaccaucuccgagaaacugagaucuggcuacgagacguucaaggucauugaaggguggagcaaaccaaauucaaagcuacagaucaacaggcaagugauuguagagcggggaaaucguaguggcuauuccgguauauuuagcguugaagggaaaucuugcaucaaccgcuguuucuacguggagcucauuagaggcaggaaggaagagaccgaggucugguggacaucaaauaguaucguggucuuuugcggaacuagcggcaccuaugggacaggauccuggcccgauggugcagacaucgaucugaugccuauuuga

SEQ ID NO: 136472 - RNA, 1410 nt, Artificial Sequence; identical to SEQ ID NO: 136269
  derived and/or modified sequence opt3 from neuraminidase__InfluenzaA__ABB02872

SEQ ID NO: 136473 - RNA, 1410 nt, Artificial Sequence; identical to SEQ ID NO: 136269
  derived and/or modified sequence opt3 from neuraminidase__InfluenzaA__ABB02883

SEQ ID NO: 136474 - RNA, 1410 nt, Artificial Sequence
  derived and/or modified sequence opt3 from neuraminidase__InfluenzaA__ABB02894
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaaugguauauuuaacaaacaccacuauugagaaggaaaucugucccaaacuggcagaguacaggaauuggucaaagccucagugcaacauuacaggguucgccccauuuaguaaagacaauagcauccggcuauccgcgggaggugauauaugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguauugccuggucaagcaguuccugccacgacgggaaggcauggcugcaugucugugugacaggagaugacgagaacgccaccgcuucuuucaucuacaauggcagacugguagauagcauuggcuccuggucaaagaaaauccucaggacgcaggaaagugagugcguuuguaucaacgggacuugcacaguggucaugaccgacggaagcgcaucugguaaggccgauacuaaaauuuuauuuauagaggaaggcaagaucgugcacacaucccugcuuucagggagcgcucaacacguggaggaaugcaguuguuauccucgguacccaggaguccgcugcguuuguagagacaacuggaagggcucuaauaggccgauuguggauaucaacguaaaagacuacuccauagugagcucguaugucugcucugguuuggugggggacacuccccggaagaaugauuccucaaguagcucccauugucuggacccuaacaaugaggaaggaggccacggcguuaaagggugggccuucgaugacggaaacgauguguggaugggucgcacgauuucugagaagcuacgaagcggcuacgagaccuuuaaagucaucgaaggguggucaaagccaaauaguaaacuccagaucaacagacaggugauuguagacaggggaaaucgguccggcuauagcgguaucuucucuguugaggggaagucaugcauuaaccguuguuuuuacguggaacugauacgcggcagaaagcaggagacagaaguccuuuggaccaguaauagcaucguggucuucugcggaaccuccggcacauaugggacuggaucuuggcccgauggugcggacauuaaccugaugccuaucuga

SEQ ID NO: 136475 - RNA, 1410 nt, Artificial Sequence; identical to SEQ ID NO: 136077
  derived and/or modified sequence opt3 from neuraminidase__InfluenzaA__ABB02905

SEQ ID NO: 136476 - RNA, 1413 nt, Artificial Sequence
  derived and/or modified sequence opt3 from neuraminidase__InfluenzaA__ABB02916
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagagaaagacaagaccucgguaacacuugccggaaauucaagccuguguaguauuuccggaugggcgaucuacaccaaagauaacucuaucaggauuggcagcaagggugacguguucgucauacgggagccuuuuaucuccugcucacauuuggaaugucgcacuuucuuuuuaacacaaggggcucugcuaaaugauaaacacaguaacggaaccgugaaggaccgaagcccauaucgugcccucaugucuugcccgcugggcgaggcacccuccccuuacaauucaaaguucgaaagcguugccuggagugcuucugcaugucaugauggcaugggguggcuuacgauuggaaucuccgguccagacaacggcgccguggcuguccugaaauauaacgggauaauuacugagaccaucaagagcuggaaaaagcagaucuugagaacacaggagucggaaugcguguguguaaauggaucuugcuuuacuauuaugaccgauggccccuccaacggugccgcgucauacaaaaucuucaagauugagaaggggaaaguuacaaagaguauagaacucaaugcaccuaacuuucacuaugaggaguguagcugcuacccagacaccggaacggugaugugugucugcagggauaauuggcacggcuccaaccggcccugggugucuuucaaucagaaccuggacuaccaaaucggcuauauuugcagcgggguguuuggagauaauccucgcccaagagacggugaaggcucauguaacccggucacuguugauggggccaauggagugaaaggcuucaguuacaaguaugguaacgggguauggaucggcaggacaaaauccaaucggcugcgcaagggauuugagaugaucugggaccccaacggcuggaccgacacugauagcgacuucucugugaaacaggaugucguggcuauuacagacuggucaggguacagugggagcuuuguucagcauccugaacucaccgguuuagauugcauacgaccauguuucuggguggagcuggucagaggccuucccagggaaaauacgaccaucuggacauccgggucuucgauuagcuucugcggagugaacuccgacacugccaacuggucauggccugauggcgcagaguugccauuuaccaucgacaaguga

SEQ ID NO: 136477 - RNA, 1413 nt, Artificial Sequence
  derived and/or modified sequence opt3 from neuraminidase__InfluenzaA__ABB02927
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugugaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcgaggggucauguaacccggucacuguugauggagccgacggcgugaaggguuucaguuacaaauaugggaauggcguauggaucggaaggacaaaguccaacaaacugcggaagggcuuugaaaugaucugggaccccaauggguggaccgauacugacagcgauuucucugugaagcaagacgucguggcuauuacagauuggucaggauacagugguagcuuuguucagcauccugagcucaccggcuuagacugcauacgcccauguuucuggguggaacugguccgagggcuucccagagagaacacgaccaucuggacauccggaucuucgauuagcuucugcggcgucaauuccgauacugccaacuggucauggccugacggugcagaauugccauuuaccaucgauaaauga

SEQ ID NO: 136478 - RNA, 1413 nt, Artificial Sequence
  derived and/or modified sequence opt3 from neuraminidase__InfluenzaA__ABB02939
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccuggaugaaccacacauaugucaauauuaacaauacuaacguuaucgcagggaaagacaagaccucggugacacuugccggaaauucaagccuguguaguauuuccggcugggcgaucuacaccaaagauaacucuaucaggauugguagcaagggggacguauucgugauacgggagccuuuuaucuccugcucacauuuggagugucgcacuuucuuuuuaacacaaggagcucugcuaaaugauaaacacaguaacggcaccgucaaggaccgaagcccauaucgugcccucaugucuugcccgcugggcgaagcacccuccccuuacaauucaaaguucgagagcguggccuggagugcuucugcaugucaugaugggaugggauggcuuacgauugguaucuccggcccagacaacggggccguugcugugcugaaauauaacggaauaauuacugaaaccaucaagagcuggaaaaagcagaucuugagaacacaggagucggagugcgucugugugaauggcucuugcuuuacuauuaugaccgauggucccuccaacggggccgcgucauacaaaaucuucaagauugaaaagggaaaaguaacaaagaguauggagcucaaugcaccuaacuuucacuaugaagaguguagcugcuacccagacaccggcacgguuaugugugugugcagggauaauuggcacggcuccaaccggcccugggucucuuucaaucagaaccuggacuaccaaauaggguauaucugcagcggaguguuuggugauaauccucgcccaaaagacggcgaggggucauguaacccggugacugucgauggagccaauggcguuaaggguuucaguuacaaauaugggaacggcguguggauuggaagaacaaaguccaauaggcugcggaaaggcuuugaaaugaucugggaccccaacggguggaccgacacugauagcgacuucucuguaaagcaggauguggucgcuaucacagacuggucaggauacagugguagcuuugugcagcauccugagcucaccggcuuagauugcauucgcccauguuucuggguugaacuggugcgagggcuucccaaggagaauacgaccauauggacauccggaucuucgaucagcuucugcggcgucaacuccgacacugccaacuggucauggccugauggugcagaauugccauuuaccauugacaaauga

SEQ ID NO: 136479 - RNA, 1410 nt, Artificial Sequence; identical to SEQ ID NO: 136394
  derived and/or modified sequence opt3 from neuraminidase__InfluenzaA__ABB02950

SEQ ID NO: 136480 - RNA, 1410 nt, Artificial Sequence; identical to SEQ ID NO: 136295
  derived and/or modified sequence opt3 from neuraminidase__InfluenzaA__ABB02961

SEQ ID NO: 136481 - RNA, 1410 nt, Artificial Sequence; identical to SEQ ID NO: 136295
  derived and/or modified sequence opt3 from neuraminidase__InfluenzaA__ABB02972

SEQ ID NO: 136482 - RNA, 1410 nt, Artificial Sequence; identical to SEQ ID NO: 136295
  derived and/or modified sequence opt3 from neuraminidase__InfluenzaA__ABB02983

SEQ ID NO: 136483 - RNA, 1410 nt, Artificial Sequence; identical to SEQ ID NO: 136295
  derived and/or modified sequence opt3 from neuraminidase__InfluenzaA__ABB02994

SEQ ID NO: 136484 - RNA, 1410 nt, Artificial Sequence; identical to SEQ ID NO: 136295
  derived and/or modified sequence opt3 from neuraminidase__InfluenzaA__ABB03005

SEQ ID NO: 136485 - RNA, 1410 nt, Artificial Sequence; identical to SEQ ID NO: 136300
  derived and/or modified sequence opt3 from neuraminidase__InfluenzaA__ABB03016

SEQ ID NO: 136486 - RNA, 1410 nt, Artificial Sequence; identical to SEQ ID NO: 136295
  derived and/or modified sequence opt3 from neuraminidase__InfluenzaA__ABB03027

SEQ ID NO: 136487 - RNA, 1410 nt, Artificial Sequence; identical to SEQ ID NO: 136300
  derived and/or modified sequence opt3 from neuraminidase__InfluenzaA__ABB03038

SEQ ID NO: 136488 - RNA, 1410 nt, Artificial Sequence; identical to SEQ ID NO: 136295
  derived and/or modified sequence opt3 from neuraminidase__InfluenzaA__ABB03049

SEQ ID NO: 136489 - RNA, 1410 nt, Artificial Sequence
  derived and/or modified sequence opt3 from neuraminidase__InfluenzaA__ABB03060
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcauacgcuguguuugcagagauaacuggaagggguccaacaggccgauuguggacaucaauaucaaagacuacagcauuguaucgucuuauguguguuccggacuggucggcgauacgccccggaagaacgacucaaguagcuccucucauugccuugauccuaauaacgaggaaggugggcacggagugaaaggcugggcuuucgacgauggcaaugacguuuggauggggcgcaccaucagcgagaaguugcgaucaggauacgagacauuuaaagugauugaagguuggaguaacccaaauuccaagcugcagauaaacagacaggucaucguggauaggggcaaucggagcggguauucuggaauuuucucaguagagggcaaaaguuguaucaaccguugcuuuuacguugaacuaauccgcgguagaaaggaggaaacugaggugcucuggaccagcaauuccauugucguguucugugggacaucuggcacuuauggaaccggcucguggcccgacggggccgauauaaaccugaugccuaucuga

SEQ ID NO: 136490 - RNA, 1410 nt, Artificial Sequence
  derived and/or modified sequence opt3 from neuraminidase__InfluenzaA__ABB03071
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugggauaacaggauucgcaccauuuagcaaagacaacuccauucggcugucugccgguggcgauaucuggguaacccgcgagcccuaugugucgugcgacccugauaaguguuaccaauucgcgcuagggcagggaacgacucucaauaacguccauucaaaugacaccgugcacgaucgaacaccauaucguacucugcuuaugaacgaacugggcguucccuuucauuuggguaccaaacaggugugcauugcuuggagcaguuccucuugucacgacgggaaggccuggcuccaugucugcgugacaggagaugacaagaaugcaaccgccagcuucaucuacaacggcagacugguagauuccaucguuucauggaguaaagagauucugaggacgcaggaaagcgagugugugugcauaaauggcacuuguacagucgugaugaccgacgggucugcuuccggaaaggcagauacuaaaauccucuuuauugaggaagguaagaucgugcacacaucaaccuuaagcggcagugcccaacacgucgaggaaugcucuugcuauccucgguacccagggguucgcugugugugcagagacaacuggaagggauccaacaggccgauaguagauauuaauaucaaagacuacagcaucgugucgucuuaugucuguuccggccuggugggugacacgccccggaagaacgauucaaguagcuccucucauugccuugacccuaauaacgaggaagggggacacggcguuaaaggcugggcuuucgaugacgggaaugauguguggaugggacgcaccauuagcgagaaguugcgaucagguuacgagacauuuaaagucaucgaaggcuggaguaacccaaauuccaagcugcagauuaacagacaggugauaguagacaaagggaauaggagcggauauucuggcaucuucucaguugaggguaagaguuguauuaaccggugcuuuuacguggaacuaauccgugggcgcaaggaggaaacugagguccucuggaccagcaauuccaucguggucuucuguggcacaucuggaacuuauggcaccgggucguggcccgauggagccgacauuaaccugaugccuauauga

SEQ ID NO: 136491 - RNA, 1410 nt, Artificial Sequence
  derived and/or modified sequence opt3 from neuraminidase__InfluenzaA__ABB03093
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacauagaggaaugcucuugcuauccucgguacccaggcguccgcuguguuugcagagauaacuggaagggguccaacaggccgauuguggacaucaauaucaaagacuacagcauuguaucgucuuauguguguuccggacuggucggcgauacgccccggaagaacgacucaaguagcuccucucauugccuugauccuaauaacgaggaaggugggcacggagugaaaggcugggcuuucgacgauggcaaugacguuuggauggggcgcaccaucagcgagaaguugcgaucaggauacgagacauuuaaagugauugaagguuggaguaacccaaauuccaagcugcagauaaacagacaggucaucguggauaggggcaaucggagcggguauucuggaauuuucucaguagagggcaaaaguuguaucaaccguugcuuuuacguugaacuaauccgcgguagaaaggaggaaacugaggugcucuggaccagcaauuccauugucguguucugugggacaucuggcacuuauggaaccggcucguggcccgacggggccgauauaaaccugaugccuaucuga

SEQ ID NO: 136492 - RNA, 1410 nt, Artificial Sequence; identical to SEQ ID NO: 136398
  derived and/or modified sequence opt3 from neuraminidase__InfluenzaA__ABB03104

SEQ ID NO: 136493 - RNA, 1410 nt, Artificial Sequence
  derived and/or modified sequence opt3 from neuraminidase__InfluenzaA__ABB03115
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaagaaaauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagauuaauagacaggugauaguagacaggggcaaccggagcggguauucuggaaucuucucaguugagggcaaaaguuguauuaaucguugcuuuuacguggaacuaauccgcgguagaaagcaggagaacgaaguccucuggacuagcaauuccaucguggucuucugugggaccucuggcacauauggaacuggcucguggcccgauggggccgacauuaaccugaugccuauauga

SEQ ID NO: 136494 - RNA, 1413 nt, Artificial Sequence; identical to SEQ ID NO: 136402
  derived and/or modified sequence opt3 from neuraminidase__InfluenzaA__ABB03126

SEQ ID NO: 136495 - RNA, 1413 nt, Artificial Sequence
  derived and/or modified sequence opt3 from neuraminidase__InfluenzaA__ABB03148
augaaccccaaucagaagaucauuaccauaggcagcaucuccauugccaucgggacaauuucucugaugcuccaaaucggaaacauaaucucaauuugggcuagucacagcauccagacugguucccagaaucauacgggcauuugcaaccagagaaucauaaccuacgaaaauucuacaugggugaaccacacuuaugucaauauuaacaauaccaacguuguggcagggaaagacaagacaucgguaacccuugccggaaauucaagccuguguaguaucuccggcugggcgauuuacacuaaagauaacucuaucaggaucgguagcaagggggacguguucgucauucgggagccuuuuauauccugcucacauuuggagugucgcacauucuuuuuaacccaaggagcucugcuaaaugauaaacacaguaacggcacggugaaggaccgaagcccauaucgugcccucaugucuugcccgcugggcgaagcacccuccccuuacaauucaaaguucgagagcguugccuggagugcuucugcaugucaugaugggaugggauggcuuacuaucgguauuuccggcccagacaacggggccguggcuguccugaaauauaacggaaucauaaccgaaacaauuaagagcuggaaaaagagaaucuugaggacucaggagucggagugcguguguguaaauggcucuugcuuuaccaucaugacagauggucccuccaacggggccgcgucauacaaaauuuucaagaucgaaaagggaaaaguuaccaagaguauugagcucaaugcaccuaacuuucacuaugaagaguguagcugcuacccagacacgggcacugugaugugugucugccgggauaauuggcacggcuccaaccgccccugggugucuuucaaucagaaccuggacuaccagauaggguauaucugcagcggaguguuuggugauaauccuagaccaaaagacggcaaggggucauguaacccggucacaguugauggagccgacggcgugaaagguuucaguuacaaguaugggaauggcguauggauuggaaggaccaaauccaaccggcugcgcaagggcuuugagaugaucugggaccccaauggguggacugauacagacagcgauuucucugugaagcaagacgucguggcuaucaccgauuggucaggauacagugguagcuuuguucagcauccugaacucacgggcuuagacugcauucgaccauguuucuggguggagcuggucagagggcuucccagggaaaacaccacaauauggacuuccggaucuucgaucagcuucugcggcguggauuccgacaccgccaauuggucauggccugauggugcagaguugccauuuacaauugacaaauga

SEQ ID NO: 136496 - RNA, 1410 nt, Artificial Sequence
  derived and/or modified sequence opt3 from neuraminidase__InfluenzaA__ABB04286
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaggcaagugcuaccaauucgcgcuagggcagggaaccacgcucgauaacaaacauucaaaugacacuauucacgaucgaacaccccaucguacccugcuuaugaacgaacugggcguuccuuuucacuuggguacuagacagguguguaucgcuuggagcaguuccucuugccaugacgggaaggccuggcuccacgucugugugaccggauaugauaaaaaugcaacagccagcuucaucuacgacggcaggcugguagauuccauuggcucauggaguaagaacauacugcggacccaggagagcgaaugcguuuguaucaaugggacgugcacuguggucaugacagacggaucugcuuccgagcgcgcagauaccaaaauucucuuuaucgaggaagguaagauagugcacauuucaccauuaagcggcagugcccaacauguggaggaaugcucuuguuauccgagauaccccggggucaggugcguuugucgggacaacuggaagggauccaaucgcccugugguagauaucaacgugaaagacuacagcaucgucucgucuuaugugugcuccggccugguuggugacacuccacgaaagaacgauagaucaaguagcuccuacuguaggaaucccaacaaugagaaagggaaccacggagugaagggcugggcuuucgacgauggcaaugacgucuggauggggcggacaauuucugaagagagccguucaggauaugagaccuuuaaagugaucgguggcuggaguacgccuaacuccaagagccagauuaaucgccagguaauaguugauucugggaacagaucaggauacaguggcaucuucagcguggaagguaaauccugcauuaauagguguuuuuaugucgagcuuauccgggggcgagaacaggagacccgcgugugguggacaucuaacucgaucgucguguucugcggcacuagcggaaccuacggcacaggguccuggccagacggagccgauauuaauuugaugcccauauga

SEQ ID NO: 136497 - RNA, 1410 nt, Artificial Sequence
  derived and/or modified sequence opt3 from neuraminidase__InfluenzaA__ABB04297
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaucccaugcgaaccgauaacuaucgagagaaacauuaccgaaaucguauauuugacaaauaccacuauugagaaggaaaucugucccaaauuaguggaguacaggaacuggucaaagccucagugcaaaauaacaggguucgccccauuuaguaaggauaauagcauucggcuguccgcgggaggugacaucugggucacccgcgagcccuaugugucuugugauccuggcaagugcuaccaauucgcucuagggcagggaacgacucucgacaacaaacauucgaaugauaccauucacgaccgaacaccacaucguacucugcuuaugaacgaacugggcguucccuuucacuuggguaccagacagguguguaucgccuggucaagcaguuccugccaugaugggaaggcauggcuccacgucugugugacaggauaugacaaaaaugccaccgcuucuuucaucuacgauggcaggcugguagacagcauuggcuccuggucacagaacauacugcggacgcaagagagugaaugcguuuguaucaaugggacuugcacaguggucaugaccgauggaagcgcaucuggucgcgccgacacuaagauucucuuuaucgaggagggcaaaauagugcacauuuccccuuuaucagggagcgcucagcauguggaagagugcaguuguuauccaagauacccgggagucaggugcaucugucgggauaacuggaagggcucuaaucgccccguuguggacaucaacguaaaggacuacuccauugauagcucguaugugugcucuggucuggucggggacacaccucgaaacaaugauagauccucaaacaguuacuguaggaauccaaacaaugaaaaaggaaaccacggcgugaagggcugggccuucgacgaugggaaugacguuuggaugggacggaccaucagcgaggauucccguucugguuaugaaacguuuaaagugauuggcggguggagcacccccaacucaaaacuucagauaaaucgccaggucaucguggacagugauaacagauccggauacagcggcauuuucucuguagaggguaagucaugcaucaauagguguuuuuauguugaguugauccgggggcgagaacaagagacacgcgugugguggaccaguaacagcauugucguguucugcggcacuuccggaacauacggcacugggucuuggccugacggagcggauauaaaucugaugccaaucuga

SEQ ID NO: 136498 - RNA, 1410 nt, Artificial Sequence
  derived and/or modified sequence opt3 from neuraminidase__InfluenzaA__ABB04319
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccacuaucauagagagaaacaucaccgaaauuguauauuugacaaauaccacuaucgagaaggaaauuuguccuaaauuaguggaguacaggaacuggaguaagccacagugcaaaaucacaggguucgcacccuuuagcaaggacaauuccauacggcugucugccggaggugauauuugggucacccgcgagccuuaugugucgugugacccaggcaagugcuaccaauucgcgcuagggcagggaacgacucucaacaaucgacauucaaacgauaccguucacgaccguacacccuauagaacucugcuuaugaaugaacugggcgugccuuuucauuuggguaccaaacaggucuguaucgcuuggagcaguuccucuugccacgaugggaaggccuggcuccauguguguguaacaggacacgacaaaaacgcaaccgccagcuucauuuacaauggcaggcugguugauuccaucggcucauggaguaagaacauccugcggacgcaggagagcgaaugcguguguauuaaugggacuugcacagucgugaugaccgacggaucugcuuccgagcgcgcagauacuaaaauacucuuuaucgaggaagguaagauugugcacaucucaccauuaagcggcagugcccaacaugucgaggaaugcucuuguuauccgagauaccccgggguuaggugcgugugucgggacaacuggaagggauccaaccgcccuauaguagauauuaaugugaaagacuacagcaucgucucgucuuaugugugcuccggccugguuggugauacaccacgaaagaacgacagaucaaguagcuccuacugucagaaucccaacaaugagaaagggucucacggagugaagggcugggcuuucgacgauggcaacgacgucuggauggggaggaccaucggagaggaacuucggagcgguuaugagacguuuaaagugauuggcggguggucaaccccuaauaguaaguugcagaucaaccgucagguaauuguugauuccggaaaucgcagcggcuacucugguauauucucaguggaagggaaaaguugcaucaacagauguuuuuaugucgagcugauuaggggccggaagcaagaaacacgagugugguggacuagcaauuccaucgucguguucugcggaaccucuggcacauacgggacuggaucguggccagacggugccgauaucaaccuaaugcccauuuga

SEQ ID NO: 136499 - RNA, 1410 nt, Artificial Sequence
  derived and/or modified sequence opt3 from neuraminidase__InfluenzaA__ABB04341
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcguccggcuguccgcgggaggugacauuugggugacacgcgagcccuauguuucuugugauccuggcaagugcuaccaauucgcucuagggcagggaaccacgcucgacaacaaacauucgaaugauacuauccacgaccgaaccccacaucguacacugcuuaugaacgaacugggcgugcccuuucacuuggguacuagacaggucuguauugccuggucaagcaguuccugccaugaugggaaggcauggcuccacguguguguaaccggauaugacaaaaaugccacagcuucuuucaucuacgauggcaggcugguugacagcaucggcuccuggucacagaacauucugcggacccaagagagugaaugcguguguauaaaugggacgugcacugucgugaugacagauggaagcgcaucuggucgcgccgacaccaagauccucuuuauugaggagggcaaaaucgugcacauauccccuuuaucagggagcgcucagcaugucgaagagugcaguuguuauccaagauacccgggaguuaggugcauuugucgggauaacuggaagggcucuaaucgccccgugguagacaucaacgugaaggacuacuccaucgauagcucguaugucugcucuggucuggugggggacacuccucgaaagaacgauagauccucaaauaguuacuguaggaacccaaauaacgaaaaaggaaaucacggcguuaaaggcugggccuucgacgaugggaacgacguguggaugggacggacaauuagcgaggauucccguucugguuaugaaaccuuuaaggucaucggcggguggagcacgcccaauucaaaacuucagauuaaccgccaggugauaguagacagugauaauagauccggauacagcggcaucuucucuguugaggguaagucaugcauuaacagguguuuuuauguggaguugauccgggggcgagaacaagagacccgcgucugguggacaaguaauagcaucguggucuucugcggcacuuccggaaccuacggcacagggucuuggccugacggagcggauauuaaccugaugccaauauga

SEQ ID NO: 136500 - RNA, 1410 nt, Artificial Sequence
  derived and/or modified sequence opt3 from neuraminidase__InfluenzaA__ABB04352
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaggcaagugcuaccaauucgcgcuagggcagggaaccacgcucaacaauaaacauucaaacgauacuguucacgaccgaacccccuaucguacacugcuuaugaaugaacugggcgugccuuuucauuuggguacuaagcaggucuguauugcuuggagcaguuccucuugccacgaugggaaagccuggcuccauguguguguaaccggacacgacaagaacgcaacagccagcuucaucuacgauggcagacugguugacuccaucggcucauggaguaaaaauauucugaggacccaggagagcgaaugcguguguauaaacgggacgugcacugucgugaugacagauggaucugcuuccgagcgggcagacaccaagauccucuuuauugaggaagguaagaucgugcacauaucaccauuaagcggcagugcccaacaugucgaggaaugcucuuguuauccgcgcuaccccgggguuagaugcguguguagggauaauuggaaaggauccaaccggccuauuguagacaucaacgugaaggauuacagcaucgucucgucuuaugugugcuccggccugguuggugacacuccacgcaaaaaugaccgaucaaguagcuccuacuguagaaaccccaauaacgagaaggggucucacggagugaaaggcugggcuuucgaugacggcaaugaugucuggauggggaggacaauuggagaggaacuucggagcgguuaugagaccuuuaaggugaucggcggguggucaacgccuaacaguaaauugcagauuaaucgucagguaauaguugacuccggaaaccgcagcggcuacucugguaucuucucaguggaagggaagaguugcauuaauagauguuuuuaugucgagcugaucaggggccgggaacaggagacccgagugugguggacaagcaacuccaucgucguguucugcggaacuucuggcaccuacgggacaggaucguggccagauggugccgacauuaaucuaaugcccauauga

SEQ ID NO: 136501 - RNA, 1410 nt, Artificial Sequence
  derived and/or modified sequence opt3 from neuraminidase__InfluenzaA__ABB04374
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaaacaaucagguaaugccaugcgaaccgauuaucauagagagaaacaucacugaaauuguguauuugaccaauacaaccaucgagaaggaaauuugucccaaauuagucgaguacaggaacuggucaaagccucagugcaaaaucacuggguucgccccauuuaguaaggauaauagcauacggcuguccgcgggaggugacauuugggugacacgcgagcccuauguuucuugugauccuggcaagugcuaccaauucgcucuagggcagggaaccacgcucgacaacaaacauucgaaugauacuauccacgaccgaaucccacaucguacccugcuuaugaacgaacugggcgugcccuuucacuuggguacaagacaggucuguauugccuggucaagcaguuccugccaugaugggaaggcauggcuccacguguguguaacuggagacgaugagaaugccaccgcuucuuucaucuaugacggcaggcugguugauagcauuggcuccuggucacagaacauacugcggacacaagaaagugagugcguguguaucaaugggaccugcacggucgugaugacugacggaagcgcaucuggucgcgccgauacaaggauucucuuuaucgaggaaggcaaaauagugcacauuuccccuuuaucagggagcgcucagcaugucgaggaaugcaguuguuacccaagauauccgggaguucggugcaucugucgcgacaacuggaagggcucuaaucgacccgugguagacaucaacgugaaagauuacuccauugacagcagauacgucugcucgggucuggugggggauaccccuaggaacaaugacaagucuuccaacucaaauugucggaacccaaauaacgauaagggaaaucacggcguuaaaggcugggccuucgacgaugggaacgacguguggaugggacguacuaucaguaaggauagccgcuccgguuaugagacauuuaaagucauuggcggguggucuacccccaauagcaagucacagauaaacagacaggugaucguagacagugauaauagguccggauacagcggcauuuucucuguugaagguaaaucaugcaucaaccgguguuuuuauguggagcuuauccgagggcgcgagcaagaaacgaaggucugguggaccaguaauagcauuguggucuucugcggcacauccggaacuuacggcaccgggucuuggccugacggagcggacauaaacuugaugccaaucuga

SEQ ID NO: 136502 - RNA, 1410 nt, Artificial Sequence
  derived and/or modified sequence opt3 from neuraminidase__InfluenzaA__ABB04931
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaagcgcaucuggucgcgccgacaccaagauucucuuuaucgaggagggcaaaauagugcacauuuccccuuuaucagggagcgcucagcauguggaagagugcaguuguuauccaagauacccgggagucaggugcaucugucgggauaacuggaagggcucuaaucgccccguuguggacaucaacguaaaggacuacuccauugauagcucguaugugugcucuggucuggucggggacacuccucgaaacaaugauagauccucaaguagcuacuguaggaacccaaauaacgaaaaaggaaagcacggcgugaaaggcugggccuucgacgaugggaaugacguuuggaugggacggacaaucuccgaggauucucguagcgguuaugaaaccuuuaaggugauuggcggguggucaacgcccaacaguaaacuucagauaaaucgccaggucaucguggacuccgauaacagaagcggauacucuggcauuuucucaguagaggguaagaguugcaucaauagguguuuuuauguugaguugauccgggggcgagaacaagagacccgcgugugguggacaagcaacuccauugucguguucugcggcacuucuggaaccuacggcacagggucguggccugacggagcggauauaaaucugaugccaaucuga

SEQ ID NO: 136503 - RNA, 1410 nt, Artificial Sequence
  derived and/or modified sequence opt3 from neuraminidase__InfluenzaA__ABB04942
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaggcaagugcuaccaauucgcgcuagggcagggaaccacgcucaacaauaaacauucaaacgauacuauucacgaccgaacccccuaucguacacugcuuaugaaugaacugggcguuccuuuucauuuggguacuaaacagguguguaucgcuuggagcaguuccucuugccacgaugggaaggccuggcuccaugucugugugaccggacacgacaagaacgcaacagccagcuucaucuacgauggcagacugguagacuccauuggcucauggaguaaaaauauacugaggacccaggagagcgaaugcguuuguaucaacgggacgugcacuguggucaugacagauggaucugcuuccgagcgggcagacaccaagauucucuuuaucgaggaagguaagauagugcacauuucaccauuaagcggcagugcccaacauguggaggaaugcucuuguuauccgcgcuaccccggggucagaugcguuuguagggauaauuggaaaggauccaaccggccuaucguggacaucaacguaaaggauuacagcauugugucgucuuaugucugcuccggccuggugggugacacuccacgcaaaaaugaccgaucaaguagcuccuacuguagaaaccccaauaacgagaaggggaaucacggaguuaaaggcugggcuuucgaugacggcaacgauguguggauggggaggacaaucggagaggaacuucggucugguuaugagaccuuuaaggucauuggcggguggagcacgccuaauucaaaauugcagauaaaccgucaggugaucguagacagugauaaucgcuccggauacagcggcauuuucucuguugaagguaagucaugcaucaacagauguuuuuauguggagcugaucagggggcgggaacaggagacccgagucugguggacaaguaauagcauuguggucuucugcggcacuuccggaaccuacggcacagggucuuggccagacggagccgauauaaaccuaaugcccaucuga

SEQ ID NO: 136504 - RNA, 1410 nt, Artificial Sequence; identical to SEQ ID NO: 136500
  derived and/or modified sequence opt3 from neuraminidase__InfluenzaA__ABB04953

SEQ ID NO: 136505 - RNA, 1410 nt, Artificial Sequence; identical to SEQ ID NO: 136398
  derived and/or modified sequence opt3 from neuraminidase__InfluenzaA__ABB04975

SEQ ID NO: 136506 - RNA, 1410 nt, Artificial Sequence; identical to SEQ ID NO: 136196
  derived and/or modified sequence opt3 from neuraminidase__InfluenzaA__ABB04986

SEQ ID NO: 136507 - RNA, 1410 nt, Artificial Sequence
  derived and/or modified sequence opt3 from neuraminidase__InfluenzaA__ABB04997
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguacauuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccaaacagguguguaucgccuggucaagcaguuccugccaugacgggaaggcauggcugcacgucugugugacaggagaugacgagaacgccaccgcuucuuucauuuauaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacaucccugcuuucagggagcgcucaacauguggaggaaugcaguuguuacccucgguauccaggaguccgcugcguuuguagagacaacuggaagggcucuaauaggccgaucguggauauaaacguaaaagacuacuccauugugagcucguacgucugcucugguuuggugggggacacuccccggaagaaugauuccucaaguagcucccacugucuggacccuaacaaugaggaaggaggccauggcguuaaagggugggccuucgaugacggaaacgauguguggaugggucgcacgaucucugagaagcuacgaagcggcuaugagaccuuuaaagucaucgaaggguggucaaagccaaauaguaaacuccagauuaacagacaggugaucguagacaggggaaaucgguccggcuacagcgguauuuucucuguugaggggaagucaugcauaaaccguuguuuuuauguggaacugauccgcggcagaaagcaggagacagaaguccuuuggaccaguaauagcauuguggucuucugcggaaccuccggcacauacgggacuggaucuuggcccgauggugcggacaucaaccugaaaccuaucuga

SEQ ID NO: 136508 - RNA, 1410 nt, Artificial Sequence; identical to SEQ ID NO: 136269
  derived and/or modified sequence opt3 from neuraminidase__InfluenzaA__ABB05008

SEQ ID NO: 136509 - RNA, 1410 nt, Artificial Sequence; identical to SEQ ID NO: 136077
  derived and/or modified sequence opt3 from neuraminidase__InfluenzaA__ABB05186

SEQ ID NO: 136510 - RNA, 1410 nt, Artificial Sequence; identical to SEQ ID NO: 136269
  derived and/or modified sequence opt3 from neuraminidase__InfluenzaA__ABB05219

SEQ ID NO: 136511 - RNA, 1410 nt, Artificial Sequence
  derived and/or modified sequence opt3 from neuraminidase__InfluenzaA__ABB46395
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaacaggugaugccaugcgaaccgaucauaaucgagagaaauauuacugaaaucguauauuugaccaacacaaccauugagaaggaaaucugucccaaguuaguggaguacaggaauuggucaaaaccucagugcaagauaacuggguucgccccauuuaguaaggauaacagcauucggcuguccgcgggaggugacaucugggucacacgcgagcccuaugugucuugugauccuggcaaaugcuaccaauucgcucuagggcagggaaccacgcucgacaauaagcauucgaacgauacuauucacgaccgaaccccacaucguacacugcuuaugaaugaacugggcguucccuuucacuuggguacuagacagguguguaucgccuggucaagcaguuccugccaugaugggaaagcauggcuccacgucugugugaccggauaugacaagaacgccacagcuucuuucaucuacgauggcaggcugguagacagcauuggcuccuggucacagaauauacugcggacccaagagagugaaugcguuuguaucaacgggacgugcacuguggucaugacagauggaagcgcaucuggucgcgccgacaccaaaauucucuuuaucgaggagggcaagauagugcacauuuccccuuuaucagggagcgcucagcauguggaagagugcaguuguuauccaagauacccgggagucaggugcaucugucgggauaauuggaagggcucuaaccgccccguuguggacaucaauguaaaagacuacuccauugauagcucguaugugugcucuggucuggucggggacacuccucgaaacaacgauagauccucaaguagcuacuguaggaauccaaacaaugaaaagggaacacacggcgugaaaggcugggccuucgacgaugggaacgacguuuggaugggacggaccaucuccgaggauucucguagcgguuaugaaacguuuaaggugauuggcggguggucaacccccaauaguaaacuucagauaaaccgccaggucaucguggacuccgauaauagaagcggauacucuggcauuuucucaguagaggguaagaguugcaucaacagguguuuuuauguugaguugauccgggggcgagaacaagagacacgcgugugguggacuagcaauuccauugucguguucugcggcaccucuggaacauacggcacugggucguggccugacggagcggauauaaaccugaugccaaucuga

SEQ ID NO: 136512 - RNA, 1410 nt, Artificial Sequence; identical to SEQ ID NO: 136056
  derived and/or modified sequence opt3 from neuraminidase__InfluenzaA__ABB46417

SEQ ID NO: 136513 - RNA, 1410 nt, Artificial Sequence
  derived and/or modified sequence opt3 from neuraminidase__InfluenzaA__ABB46428
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacaucuccccucugucagggagcgcucaacacguggaggaaugcaguuguuauccacgguacccgggaguccgcugcguuuguagagacaacuggaagggcucuaauaggcccauaguggauauuaacguaaaagacuacuccaucgugagcucguaugucugcucuggucuugugggggacacaccucggaagaaugauuccuucucaaguagccauuguuuggacccaaacaaugaggaaggaggccacggcguuaaagggugggccuuugaugacggaaacgauguguggaugggucgcaccaucuccgagaagcugcgaucuggcuacgagacguucaaagucauugaaggguggagcaagcccaauucaaaacuacagaucaacagacaggugauuguagacaggggaaaucggaguggcuauuccgguauauuuagcguugaggggaagucuugcaucaaccguuguuucuacguggaacucauucgcggcagaaaggaggaaaccgaggucugguggacaucaaauaguaucguggucuuuugcggaacuagcggcaccuaugggacaggauccuggccugauggugcggacaucaaccugaugccaauuuga

SEQ ID NO: 136514 - RNA, 1410 nt, Artificial Sequence
  derived and/or modified sequence opt3 from neuraminidase__InfluenzaA__ABB46439
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcgcuuguacugucgugaugacagauggcucugcauccgggaaggccgacaccaaaauccucuuuauugaggaacggcgcaucgugcacacuucaacauuaagcggaagugcucaacacgucgaggaaugcucuugcuauccuagauacccagguguuaggugugugugccgggauaacuggaagggcuccaaccgcccgauaguagacauuaauaucaaggacuacagcaucgugucgucuuaugucuguuccgggcuggugggagauacgccccggaaaaacgacucaaguagcuccucuaauugccuugauccuaacaaugaggaaggcggucaugggguuaagggaugggccuucgacgauggcaacgacguguggaugggcagaaccauuagcgagaaauugaggucaggguacgagaccuuuaaggucaucgaaggauggaguaauccaaacuccaaacugcagauuaaucgacaggugauaguagaucgugguaaccgcagcggcuauucugggaucuucucaguugagggaaagaguuguauuaauagaugcuuuuacguggaacuaaucaggggccggaaagaggaaacagagguccucuggacuagcaacuccaucguggucuucugugguaccucuggggcguauggcacaggaucguggcccgacggcgcagauauuaaucugaugccuauauga

SEQ ID NO: 136515 - RNA, 1410 nt, Artificial Sequence; identical to SEQ ID NO: 136362
  derived and/or modified sequence opt3 from neuraminidase__InfluenzaA__ABB46450

SEQ ID NO: 136516 - RNA, 1410 nt, Artificial Sequence; identical to SEQ ID NO: 136343
  derived and/or modified sequence opt3 from neuraminidase__InfluenzaA__ABB46461

SEQ ID NO: 136517 - RNA, 1410 nt, Artificial Sequence
  derived and/or modified sequence opt3 from neuraminidase__InfluenzaA__ABB46550
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaggcaagugcuaccaauucgcgcuagggcagggaaccacgcucgauaacaaacauucaaaugacacuauucacgaucgaacaccccaucguacccugcuuaugaacgaacugggcguuccuuuucacuuggguacuagacagguguguaucgcuuggagcaguuccucuugccaugacgggaaggccuggcuccacgucugugugaccggauaugauaaaaaugcaacagccagcuucaucuacgacggcaggcugguagauuccauuggcucauggaguaagaacauacugcggacccaggagagcgaaugcguuugugugaaugggacgugcacugucgugaugacagacggaucugcuuccgagcgcgcagauaccaaaauccucuuuauugaggaagguaagaucgugcacauaucaccauuaagcggcagugcccaacaugucgaggaaugcucuuguuauccgagauaccccgggguuaggugcgugugucgggacaacuggaagggauccaaucgcccuguaguggauauuaacgucaaagacuacagcaucgugucgucuuauguuugcuccggccuggugggugacacuccacgaaagaacgauagaucaaguagcuccuacuguaggaaucccaacaaugagaaagggaaccacggagucaagggcugggcuuucgacgauggcaaugacguguggauggggcggacaaucucugaagagagccguucaggauaugagaccuuuaaaguaauugguggcuggaguacgccuaacuccaagagccagaucaaucgccagguuauuguggauucugggaacagaucaggauacaguggcauauucagcgucgaagguaaauccugcaucaauagguguuuuuauguggagcuuauucgggggcgagaacaggagacccgcgucugguggacaucuaacucgaucgugguuuucugcggcacuagcggaaccuacggcacaggguccuggccagacggagccgauaucaauuugaugcccauuuga

SEQ ID NO: 136518 - RNA, 1410 nt, Artificial Sequence
  derived and/or modified sequence opt3 from neuraminidase__InfluenzaA__ABB51955
augaaccccaaucagaagaucauuaccauaggcagcgugucccugacaaucucuacuauuugcuucuuuaugcaaaucgccauucucgucacgaccguuacacuucacuucaaacaguacgaguguaacucaccuccaaauaaccaggugaugcugugcgaaccgacuaucauagagagaaauaucaccgaaauuguauauuugacaaacaccacuaucgagaaggaaauuugucccaaauuagcugaguacaggaauuggaguaagccucagugcaacaucacaggguuugcaccauucagcaaagacaauuccauacggcugucugccggaggugauauuugggugacccgcgagcccuaugucucgugugacccugauaagugcuaccaauuugcgcuaggccaggggacgacucucaacaauggacauucaaacgacaucgugcacgaucgaaccccauaucguacacugcuuaugaaugaacugggcguucccuuccauuuggguacuaaacagguguguauugcuuggagcaguuccucuugccacgacgggaaggccuggcuccaugucugugugaccggagaugacgagaacgcaacagccagcuuuaucuacaauggcagacugguagauuccaucggcucauggaguaagaaauucuuuaggacccaggaaagcgagugcguuuguauucacgggacgugcacuguggucaugacagacggaucugcuucccggaaggcagauaccaaaauacuguucaucgaggaagguaagauugugcacacuucaacacucagcggcagugcccaacauguggaggaaugcucuuguuauccucgcuacccaggggucagaugcguuuguagggacaacuggaagggauccaaccggccgaucguggauauaaauauuaaagacuacagcaucguaucgucuuaugugugcuccggcuuagucggugacacgccccgcaagaacgauucaaguagcuccucucacugucuggacccuaauaacgaggaagggggacauggcgugaaaggcugggcuuuugaugacgggaaugauguuuggaugggacgaaccaucagcgagaaacuuagaucagguuacgagaccuucaaggugauugaaggcuggaguaagccaaacuccaaauugcagaucaauaggcaggucauuguggaccgggggaaccguagcggauauucuggcauauuuucaguagaggguaagaguugcaucaaucgcuguuucuacguugaacugauuagagggaggaagcaggagacagaagugcuauggacuagcaacuccaucgucguguucugcggcaccucuggaacauauggcacugggucguggcccgauggagccgacaucaaucucaugccuauuuga

SEQ ID NO: 136519 - RNA, 1413 nt, Artificial Sequence
  derived and/or modified sequence opt3 from neuraminidase__InfluenzaA__ABB51956
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaacaguggccggaaauucaagccuuuguaguauuuccggcugggcgaucuacaccaaagauaacucuaucaggauugguagcaagggggacgucuucgugauacgggagccuuuuaucuccugcucacaucuggagugucgcacuuucuuuuugacacaaggagcuuuacugaaugauaaacacaguaacggcaccguuaaggaccgaagcccauaucgugcccuaaugucuugcccgcucggcgaagcacccuccccuuacaauucaaaguucgagagcguggccuggagugcuucugcaugucaugaugggaugggauggcugacgauugguaucuccggcccagacaacggggccgucgcugugcuuaaauauaacggaauaauuacugaaaccaucaagagcuggaaaaagcccauccugggcacacaggagucggaguggguaugcguuaaugguucuuguuuuacuauuaugaccgaugacccuuccuacgaagccgcgucauauaaaaucuucaagauugagagagaaagggugacaaagaguauagaguugaacgcaccaaauuuucacuacgaggaaugcagcuguuaccccgauaccgggacggucaugugcgugugucgggacaacuggcacggauccaaucgcccuugggugucuuucaaccagaaucucgauuaucagaucggcuacauuugcagcggcgucuuuggggacaacccaagaccgaaagauggagaggguucaugcaaucccguuacuguggacggcgccaacgggguaaagggauucaguuauaaauacggcaaugguguguggaucgggaggacaaaguccaaccggcugcgcaaaggcuuugaaaugaucugggacccuaauggauggaccgauacugacagcgauuucucugucaagcaagacgugguugcuauuacagauuggucaggcuauagugggagcuuugugcagcauccagagcugaccggacucgacuguauacgacccugcuucugggucgaauuagugagaggucugccuaaagagaacacgaccaucuggacauccgggucuucgauuagcuucuguggcguaaauuccgauacugccaacuggucauggccagacggagcagagcuucccuuuaccaucgauaaguga

SEQ ID NO: 136520 - RNA, 1410 nt, Artificial Sequence
  derived and/or modified sequence opt3 from neuraminidase__InfluenzaA__ABB51957
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcgagaucguacaccauacagaacucuucugaugaaugaauugggcguucccuuucaucucgguacccgacagguguguaucgccuggucaagcaguuccugccacgacgggaaggcauggcugcaugucugugugacaggagaugacaaaaacgccaccgcuucuuucauuuauaauggccggcugguagauagcaucggcuccuggucaaagaaaaucuuucgcacgcagaaguucgagugcguuuguauucacuggacuugcacaguggucaugaccgacgggagugcaagcggaaaagccgauacuaagauacucuuuaucgaagaggguaagauugugcacaucucuacauuauccggcucagcucaacauguggaggaaugcagcuguuacccuagauauccaggggucaggugcguuugucgggacaacuggaaaggaaguaaccgcccgauaguggauauuaauguaaaggacuacucuaucguguccagcuacgucugcucgggccuggugggugacacccccaggaaaaacgauucuuucuccucaagucacugucuugacccuaauaacgaggaagggggacauggcguuaagggcugggccuuugaugacgggaaugauguguggaugggaagaacgaucagcgagaaauugagguccgguuaugaaaccuucaaggucauugagggcuggucuaaaccaaacagcaagcugcagaucaaucgucaggugauuguagagcgggggaaccgcucaggauacaguggcauauuuuccguugaagguaagagcugcaucaauagauguuucuauguggagcuaauuagggggcggaaagaagagacagaagucugguggacuucuaacucaaucguggucuucugcggcaccaguggaacauacggcacugggagcuggcccgacggagcggauaucaaucucaugccuauuuga

SEQ ID NO: 136521 - RNA, 1413 nt, Artificial Sequence
  derived and/or modified sequence opt3 from neuraminidase__InfluenzaA__ABB51958
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuucgauuaauaacacuaaugugaucgcagggaaagacaagaccucaguaacacuugccggaaacagcagucuguguccuauuaggggcugggcgaucuacaccaaagguaauuccauccggauugggucuaagggagauguguucgucauacgcgagccauuuaucagcugcucccauuuggagugucgaacuuucuuuuuaacacaaggcgcucugcuaaacgacaaacacucaaauggcaccgugaaggaucguaguccguauagagcccucaugagcugcccccugggggaagcaccuucuccauacaacuccaaguucgagucaguugccuggagcgcuagugcaugucaugacggaauggguuggcuuacgauuggcaucucugggcccgauaauggagccguggcuguccugaaauauaacggcauaauuacugaaaccaucaaguccuggaaaaagcagaucuugaggacacaggagagcgagugcguguguguaaacgguucgugcuuuacuauuaugaccgacgggccuucuaauggagccgcguccuacaaaaucuucaagauugaaaagggcaaaguuacaaagucaauagagcucaacgcaccaaauuuucacuaugaagaguguagucgguaccccgauaccggcacggugaugugcgucugucgcgacaacuggcacgggagcaauagaccuuggguguccuucaaccagaaucuggauuaccaaaucggauauauuugcucugguguguuuggcgacaacccaaggccgaaagauggggagggaagcugcaaucccgucacuguugacggcgccaacggugugaagggguucucauacaaauauggcaauggaguaggcaucgggcggacaaucaguaaccgccugcgaaagggauuugaaaugauuugggauccuaaugguuggaccgacacugacuccgauuucagcgugaaacaggacgucguggcuauaacagauuggucuggcuacucagggaguuuuguucagcauccagagcucaccggauuagacuguaucagacccugcuucuggguggaacuggucaggggccuuccuaaggagaacacgaccauuuggacaagcgguuccucuaucucguucuguggggugaauagcgauacugccaacugguccuggccagacggcgcagaauugcccuuuaccauugauaaguga

SEQ ID NO: 136522 - RNA, 1410 nt, Artificial Sequence
  derived and/or modified sequence opt3 from neuraminidase__InfluenzaA__ABB51959
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacggacgaacaccauaucguacucugcuuaugaacgaacugggcguucccuuucauuuggguaccaaacaggugugcauugcuuggagcaguuccucuugucacgacgggaaggccuggcuccaugucugcgugacaggagaugacaagaaugcaaccgccagcuucaucuacaacggcagacugguagauuccaucguuucauggaguaaagagauucugaggacgcaggaaagcgagugugugugcauaaauggcacuuguacagucgugaugaccgacgggucugcuuccggaaaggcagauacuaaaauccucuuuaacgaggaagguaagauugugcacacaucaaccugcagcggcagugcccaacacgucgaggaaugcucuuguuauucccgguacccugggguucgcugcguguguagagacaacuggaagggaagcaauaggccaaucguagauauaaacauuaaagacuacucgaucgugucuuccuaugucugcucaggcuuagugggugacacgccgcggaagaaugauaguagcuccucuagccauugucuggaccccaacaaugaggaagggggacacggcguuaaaggccgcgcuuucgaugacgggaacgauguguggaugggacgaaccaucucagagaaacuuagaagugguuacgagacauuuaaggucauugaaggcugguccaauccuaacagcaaguugcagaucaauaggcaagugauuguagaccgggggaaccguucuggauauucaggcauauucaguguugaggguaaaagcugcaucaaucgcuguuuuuacguggaacugauuagagggaggaaggaggaaacugagguccuauggaccuccaacucuaucguggucuucugcggcacaucgggaacuuauggcaccgggagcuggccagauggagccgacaucaaucucaugcccauuuga

SEQ ID NO: 136523 - RNA, 1413 nt, Artificial Sequence
  derived and/or modified sequence opt3 from neuraminidase__InfluenzaA__ABB51960
augaaccccaaucagaagaucauuaccauaggcagcaucuccauugccaucgggauuaucucucugaugcuccaaauaggaaacaucauuccuaucugggcuucacacaguauucagacagguagccagaaucauacuggcgugugcaaccagagaaucauaacguacgaaaauuccaccugggucaaccacacauauguuaauauuaacaauacuaacgugaucgcagggaaagacaagaccucuguaacacuugccggaaauucgucacuguguagcauuaguggcugggcgaucuacaccaaagauaacuccaucaggauugguucuaagggggacguguucgucauacgggagccauuuaucagcugcucccauuuggagugucgcacuuucuuuuuaacacaaggagcucugcuaaaugauaaacacucaaacggcaccgugaaggaccgaaguccguaucgugcccucaugagcugcccccugggcgaagcaccuucuccauacaauuccgaguucgaaucaguugccuggagcgcuagugcaugucaugaugggaugggauggcuuacgauugguaucucuggccccgacaacggggccguggcuguccugaaguauaacggaauaauuacugagaccaucaaauccuggaagaaacagaucuugagaacacaggagagcgaaugcguguguguaaauggcucgugcuuuacuauuaugaccgaugguccuucuaacggggccgcguccuacaagaucuucaaaauugagaagggaaagauaacaaaaucaaucgaacucaaugcaccaaacagucacuaugaggaguguagcugcuaccccgacaccggcacgguuaugugugugugcagggauuccuggcacggcucuaaucggccuugggucagcuuuaaccagaaucuggacuaccaaauuggguauaucugcucaggaguguucggugauaacccacgcccgaaggacggcgaagggaguuguaaucccgugacugucgauggagccaacggcguuaaagguuuuuccuacgaguaugggaauggcgacuggaucggaagaacaaagagcaacaggcugcggaaaggcuucgaaaugauuugggacccugauggguggaccgacacuaauucugauuuuucagugaagcaggacguaguggcuauaacagauuggaguggauacagcgguuccuucguccagcauccagagcucaccggcuuagugugcauccgccccuguuuuuggguugaacuggugcgagggcuuccuaaagagaacacgaccauuuggacaucuggaucgagcaucuccuucugcggcgucaauucagacacugccaacuggaguuggccagauggugcagaguugcccuucaccauugacaaguga

SEQ ID NO: 136524 - RNA, 1410 nt, Artificial Sequence; identical to SEQ ID NO: 136359
  derived and/or modified sequence opt3 from neuraminidase__InfluenzaA__ABB53617

SEQ ID NO: 136525 - RNA, 1410 nt, Artificial Sequence
  derived and/or modified sequence opt3 from neuraminidase__InfluenzaA__ABB53721
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucuucgggaggugacaucuggguaacccgcgagcccuaugugucaugcgauccugacaaguguuaccaauucgcccuaggccaggggacgacucucaauaacguccauagcaaugauaccgugcacgaccgaacaccauaucguacucugcuuaugaacgaacugggaguucccuuucauuugggcaccaaacaggugugcauugcguggaguuccucuagcugucacgaugguaaggcuuggcuccaugucugcgugacaggggacgauaagaaugccaccgcauccuucaucuacaacggaagacugguagacucaaucguuaguuggagcaaagagauucugaggacgcaggaaucugagugugugugcauaaauggcacuuguacagucgugaugaccgauggcuccgccucagggaaggcugacacuaaaauccucuuuauugaggaaggaaagaucgugcacacaagcaccuuaagugguucugcacaacacgucgaggaaugcuccugcuauccucgguacccaggcguucgcugugugugcagagauaacuggaaggggagcaacaggccgauaguagacauuaauaucaaagacuacucgaucgugucuuccuaugucuguucaggacuggugggcgauacgccccggaagaacgacaguagcuccucuagccauugccuugauccuaauaacgaggaaggugggcacggaguuaaaggcugggccuucgacgauggcaaugacguguggauggggcgcaccauuucagagaaguugcgaaguggauacgagacauuuaaagucaucgaagguugguccaacccaaauagcaagcugcagauuaacagacaggugauaguagauaggggcaaucggucuggguauucaggaaucuucaguguugagggcaaaagcuguauuaaccguugcuuuuacguggaacuaauccgcgguagaaaggaggaaacugagguccucuggaccuccaauucuaucguggucuucugugggacaucgggcacuuauggaaccggcagcuggcccgacggggcugauauuaaccugaugccuauauga

SEQ ID NO: 136526 - RNA, 1410 nt, Artificial Sequence
  derived and/or modified sequence opt3 from neuraminidase__InfluenzaA__ABB53754
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaggcaagugcuaccaauucgcgcuagggcagggaaccacgcucgauaacaaacauucaaaugacacuauucacgaucgaacaccccaucguacccugcuuaugaacgaacugggcguuccuuuucacuuggguacuagacagguguguaucgcuuggagcaguuccucuugccaugacgggaaggccuggcuccacgucugugugaccggauaugauaaaaaugcaacagccagcuucaucuacgacggcaggcugguagauuccauuggcucauggaguaagaacauacugcggacccaggagagcgaaugcguuuguaucaaugggacgugcacuguggucaugacagacggaucugcuuccgagcgcgcagauaccaaaauucucuuuaucgaggaagguaagauagugcacauuucaccauuaagcggcagugcccaacauguggaggaaugcucuuguuauccgagauaccccggggucaggugcguuugucgggacaacuggaagggauccaaucgcccugugguagauaucaacgugaaagacuacagcaucgucucgucuuaugugugcuccggccugguuggugacacuccacgaaagaacgauagaucaaguagcuccuacuguaggaaucccaacaaugagaaagggaaccacggagugaagggcugggcuuucgacgauggcaaugacgucuggauggggcggacaauuucugaagagagccguucaggauaugagaccuuuaaagugaucgguggcuggaguacgccuaacuccaaacuucagauuaaucgccagguaauaguugauagcgacaacagaucuggguacucaggaaucuucaguguggaaggcaagagcugcauuaauagguguuuuuaugucgaguugauccggggucgagaacaggagacccgcgugugguggacauccaacucuaucgucguguucugcgggacuucgggcaccuacggaacaggcagcuggccagauggggccgacauuaaucugaugcccauauga

SEQ ID NO: 136527 - RNA, 1410 nt, Artificial Sequence; identical to SEQ ID NO: 136119
  derived and/or modified sequence opt3 from neuraminidase__InfluenzaA__ABB54517

SEQ ID NO: 136528 - RNA, 1410 nt, Artificial Sequence
  derived and/or modified sequence opt3 from neuraminidase__InfluenzaA__ABB59999
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccugauaagugcuaccaauucgcucucggccaggggacgacucugaacaaucgacauucaaacgacaccgugcacgaucguacaccauauagaacucuucugaugaaugaauugggaguucccuuucaucucggcaccaaacagguguguaucgccuggagcaguuccucuugccacgacgguaaggcauggcugcaugucugugugacagggcacgaugagaacgccaccgcuagcuucauuuacgacggaaggcugguagauuccaucggcucauggaguaaaaagauccuccggacgcaggaaagcgagugcguuuguauuaauggcacuugcacaguggucaugaccgacgggucugcauccggacgcgccgauacuaaaauauuauuuaucgaggaagguaagauugugcacaucucaccucugagcggcagugcucaacauguggaggaaugcucuuguuauccaagauacccgggggucaggugcguuugucgggacaacuggaagggauccaaucgccccauaguggauauuaacaucaaagacuacagcaucguaucgucuuaugugugcuccggccuugucggugacacaccucgaaagaacgauucaaguagcuccucucacuguuugaauccaaacaaugaggaagggggacauggcgugaaaggcugggccuucgacgaugggaacgacguuuggaugggaagaaccauuagcgagaaguuuaggucagguuacgagacguucaaagugaucgaaggcuggaguaagcccaauuccaaacugcagauuaaccggcaggucauaguggaucgugggaaucgcagcggauauucuggcaucuuuucaguagaggguaagaguugcauuaacagauguuucuacguugaacuaaucagggggcggaagcaggagaccgaagugugguggacaagcaauuccaucgucacuuuuugcggcaccucuggaacauauggcacugggucguggccugacggagcggauauuaaccucaugccaauauga

SEQ ID NO: 136529 - RNA, 1410 nt, Artificial Sequence
  derived and/or modified sequence opt3 from neuraminidase__InfluenzaA__ABB60010
augaaccccaaucagaagaucauuaccauaggcagcgugucccugacaaucgccacuauuugcuuccucaugcaaaucgcuauucuugucacgaccguuacacugcacuuuaaacaguacgaguauucuucaccuccaaacaaucaggugauguugugugaaccgacuaucauagagagaaacaucaccgaaauuguauacuuaacaaauaccacuaucgagaaggaaauuugccccaaacuggcagaguauaggaacuggaguaagccucaguguaaaaucacaggguucgccccauuuagcaaggacaauuccauacggcuaucugcgggaggugauauuugggugacccgcgagcccuacgucucgugcgacccugauaaguguuaucaauucgcucucggccaggggacgacucugaacaaucgacauucaaacgacaccgugcacgaucguacaccauacagaacucuucugaugaaugaauugggaguucccuuucaucucggcaccaaacaggugugcaucgccuggagcaguuccucuugucacgacgguaaggcauggcugcaugucugcgugacagggcacgaugagaacgccaccgcuagcuucauuuaugacggaaggcugguagauuccaucggcucauggaguaaaaagauccuccggacgcaggaaagcgaguguguuugcauuaauggcacuuguacaguggucaugaccgacgggucugcauccggacgcgccgauacuaaaauauuauuuaucgaggaagguaagauugugcacaucucaccucugagcggcagugcucaacauguggaggaaugcucuugcuacccaagauacccgggggucagguguguuugccgggacaacuggaagggauccaaucgccccauaguggauauuaacguaaaagacuauagcaucgugucgcgauacgucuguucuggccuugugggugacacaccuagaaagaacgauuccucaaguagcucccacugcuugaauccaaacaaugaggaagggggacauggcguuaaaggcugggccuucgacgaugggaacgacguguggaugggaaggaccaucucugagaaguuucggagcgguuaugagacguucaaagucauugaaggcuggucaaagcccaauaguaaacugcagaucaaccgucaggugauuguagaucgcgggaauagauccggauacagcggcauauuuucuguugaggguaagucauguaucaacaggugcuucuauguggaacuaauucgggggcgaaagcaggagaccgaagucugguggacaaguaauagcaucguggucuuuuguggcacuuccggaaccuacggcacagggucuuggccugacggagcggauaucaaccucaugccaauuuga

SEQ ID NO: 136530 - RNA, 1410 nt, Artificial Sequence
  derived and/or modified sequence opt3 from neuraminidase__InfluenzaA__ABB77867
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaacggacauucgaaugacaccgugcacgaucgaacaccauaucguacucuucugaugaacgaauugggcguucccuuucaucucgguaccaaacagguguguaucgccuggucaagcaguuccugccacgacgggaaggcauggcugcaugucugugugacaggacacgaugagaaugccaccgcuucuuucauuuacgacggcagacugguagauagcaucggcuccuggaguaaaaagauccucaggacgcaggaaucagagugcguuuguauuaacgggacuugcacaguggucaugaccgacggaagcgcaucuggucgggccgauacuaaaauauuauuuaucgaggaaggcaagauugugcacaucucccaacugucagggagcgcucagcauguggaggaaugcaguuguuauccucgcuacccaggagucagaugcguuuguagggacaauuggaagggcucuaaccggccgauaguggauauuaacguaaaagaccacuccaucgugagcucguacgucugcucuggucuugugggggacacaccccgcaagaaugauuccucaaguagcucccauuguuugaacccuaauaacgaggaaggaggccacggcguuaaagggugggccuucgacgauggaaaugacguguggaugggucgaaccaucucugagaagcugagaagcggcuaugagacguuuaaagucauugaaggguggucaaagccaaacaguaaacuacagaucaauaggcaagugauuguagaucggggaaaccguuccggcuacagcgguauauucucuguugaggggaagucaugcaucaaucgcuguuuuuauguggaacucauuagaggcaggaagcaggagaccgaagucugguggacaaguaacagcaucguggucuucugcggaacuuccggcaccuacgggacaggaucuuggcccgacggugcggauaucaaucugaugccuauuuga

SEQ ID NO: 136531 - RNA, 1410 nt, Artificial Sequence; identical to SEQ ID NO: 136530
  derived and/or modified sequence opt3 from neuraminidase__InfluenzaA__ABB79719

SEQ ID NO: 136532 - RNA, 1410 nt, Artificial Sequence
  derived and/or modified sequence opt3 from neuraminidase__InfluenzaA__ABB79734
augaaccccaaucagaagaucauuaccauaggcagcgugucccugacacucucuacuaucugcuucuuuaugcaaauugccauccuuauuacgaccgucacacugcacuucaaacaguacgaguuuaacucaccuccaaauaaccagguuauguugugugaaccgacuaucauagagagaaauaucaccgaaauuguguauuuaacaaacaccacuaucgagaaggaaauuugccccaaacuggcugaguacaggaauuggaguaagccucagugugacaucacaggguucgcaccauuuagcaaagauaacuccauacggcuaucugccggaggugacauuuggguaacccgcgagcccuaugugucgugcgauccugacaaguguuaccaauucgcgcucggccaggggacgacucugaauaacguccauucaaaugauaccgugcacgaccgaacaccauaucguacucuucugaugaacgaauugggaguucccuuucaucucggcaccaaacaggugugcaucgcuuggagcaguuccucuugucacgaugguaaggccuggcugcaugucugcgugacaggggacgauaagaaugcaaccgccagcuucauuuacaacggaagacugguagacuccaucguuucauggaguaaaaagauccucaggacgcaggagagcgaaugugugugcauuaauggcacuuguacagucgugaugaccgauggcucugcuuccgggaaagcagacacuaagauauuauuuaucgaggagggaaagauugugcacacaucaacccugagcgguagugcccaacacgucgaagagugcucuugcuauccucgguacccaggcguucgcugugugugcagagauaacuggaaaggguccaacaggccgaucguagacauaaauauuaaggacuacagcaucgugucgucuuaugucuguuccggacuugugggcgauacgccccggaaaaacgacucaaguagcuccucucauugcuuggauccuaauaacgaagagggugggcacggaguuaagggcugggcuuucgacgauggcaaugacguguggauggggcgcaccaucagcgaaaaacugcgaucaggauacgagacauuuaaggucauugaggguuggaguaacccaaauuccaaacuacagaucaacagacaggugauuguagauaggggcaaucggagcggguauucuggaauauucucaguugaaggcaagaguuguaucaaccguugcuuuuacguggagcucauucgcgguagaaaggaagagacugaaguccuguggaccagcaauuccaucguggucuucugugggacaucuggcacuuauggaaccggcucguggcccgacggggccgauaucaaccuuaugccuauuuga

SEQ ID NO: 136533 - RNA, 1410 nt, Artificial Sequence; identical to SEQ ID NO: 136503
  derived and/or modified sequence opt3 from neuraminidase__InfluenzaA__ABB79791

SEQ ID NO: 136534 - RNA, 1410 nt, Artificial Sequence
  derived and/or modified sequence opt3 from neuraminidase__InfluenzaA__ABB79802
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaggcaagugcuaccaauucgcgcuagggcagggaaccacgcucaacaauaaacauucaaacgauacuauucacgaccgaacccccuaucguacacugcuuaugaaugaacugggcguuccuuuucauuuggguacuaaacagguguguaucgcuuggagcaguuccucuugccacgaugggaaggccuggcuccaugucugugugaccggacacgacgagaacgcaacagccagcuucaucuacgauggcagacugguagacuccauuggcucauggaguaagaauauacugaggacccaggaaagcgagugcguuuguaucaacgggacgugcacuguggucaugacagauggaucugcuuccgagcgggcagacaccaaaauucucuuuaucgaagaggguaagauagugcacauuucaccauuaagcggcagugcccaacauguggaagagugcucuuguuauccgcgcuaccccggggucagaugcguuuguagggauaauuggaagggauccaaccggccuaucguggacaucaacguaaaagauuacagcauugugucgucuuaugucugcuccggccuggugggugacacuccacgcaagaaugaccgaucaaguagcuccuacuguagaaaccccaauaacgaaaaagggucucacggaguuaagggcugggcuuucgaugacggcaaugauguguggauggggaggacaaucggagaggagcuucggagcgguuaugaaaccuuuaaagucauuggcggguggucaacgccuaacaguaaguugcagauaaaucgucaggugaucguagacuccggaaaccgcagcggcuacucugguauuuucucaguugaggggaaaaguugcaucaauagauguuuuuauguggaacugaucaggggccgggagcaggaaacccgagucugguggacaagcaacuccauuguggucuucugcggaacuucuggcaccuacgggacaggaucguggccagauggugccgacauaaaucuaaugcccaucuga

SEQ ID NO: 136535 - RNA, 1410 nt, Artificial Sequence
  derived and/or modified sequence opt3 from neuraminidase__InfluenzaA__ABB79813
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaagugugucccaaacuggcagaguacaggaauuggucaaagccucagugcaaaauuacaggguucgccccauuuaguaaggacaacagcauccggcuauccgcgggaggugauauaugggucacccgcgagcccuaugugucuugugacccuggcaagugcuaccaauucgcucucgggcagggaacgacucugaauaaccgacauucgaaugauaccguucacgaccguacaccauauagaacucuucugaugaacgaauugggcgugcccuuucaucucgguaccaaacaggucuguauugccuggucaagcaguuccugccacgaugggaaggcauggcugcauguguguguaacaggacacgacgagaaugccaccgcuucuuucaucuacgauggcaggcugguugacagcauuggcuccuggaguaaaaacauccuccggacgcaggaaucagagugcguguguaucaaugggacuugcacagucgugaugaccgauggaagcgcaucugagcgcgccgacacuaagauuuuauuuauagaagaggguaaaaucgugcacauuuccccucugucaggcagcgcucaacaugucgaagagugcaguuguuauccaagauacccggggguuaggugcgugugucgggauaacuggaagggaucuaaccgccccaucguagacauaaaugugaaggauuacuccauugucagcucguaugugugcucuggccuuguuggugacacaccucgaaagaacgacuccucaaguagcuccuacuguagaaauccaaacaaugaaaaagggucucacggagugaaaggcugggccuucgaugacggcaacgaugucuggauggggaggaccaucagcgaggaguugcggucaggauaugaaacguuuaaggugaucgguggcuggaguaaacccaauuccaagcugcagauuaaccgucagguaaucguugaccgcgggaauagaagcggauacucuggcauuuucucaguggaggguaaaaguugcauaaacagguguuuuuaugucgaacuaauccgggggcgaaagcaggagaccgaagugugguggacaagcaauuccauugucguguucugcggcacuucuggaaccuacggcacagggucguggccugauggagcggacaucaaccucaugccaaucuga

SEQ ID NO: 136536 - RNA, 1410 nt, Artificial Sequence; identical to SEQ ID NO: 136535
  derived and/or modified sequence opt3 from neuraminidase__InfluenzaA__ABB79960

SEQ ID NO: 136537 - RNA, 1410 nt, Artificial Sequence; identical to SEQ ID NO: 136535
  derived and/or modified sequence opt3 from neuraminidase__InfluenzaA__ABB79971

SEQ ID NO: 136538 - RNA, 1413 nt, Artificial Sequence
  derived and/or modified sequence opt3 from neuraminidase__InfluenzaA__ABB79982
augaacgccaaucagaagaucauuaccauaggcagcaucuccauugcuaucgggauuaucucucugaugcuccaaauaggaaacaucauuucaaucugggcaagucacagcauucagacagguucccagaaucauacuggcgugugcaaccagagaaucauaacguacgaaaauucuaccugggucaaccacacauauguuaauauuaacaauacuaacgugaucgccgggaaagacaagaccucgguaacacuugcgggaaauucaagccuguguaguauuuccggcugggcuaucuacaccaaagauaacucuaucaggauugguagcaagggggacguguucgucauacgggagcccuuuaucuccugcucacauuuggagugucgcacuuucuuuuuaacacaaggagcccugcuaaaugauaaacacaguaacggcaccgugaaggaccgaagcccuuaucgugcacucaugucuugcccacugggcgaagccccgucccccuacaauucaaaguucgagagcguugcuuggagugcaucugccugucaugaugggaugggauggcuuacgauugguaucuccggcccugacaacggggcuguggccguccugaaauauaacggaauaauuacugaaaccaucaagagcuggaaaaagcagaucuugagaacacaggagucggagugcguguguguaaauggcucuugcuuuacuauuaugaccgaugguccauccaacggggcggcaucauacaaaaucuucaagauugaaaagggaaaaguuacaaagaguauagagcucaaugcccccaacuuucacuaugaagaguguagcugcuacccugacaccggcacggugaugugugucugcagggauaauuggcacggcuccaaccggccaugggugucuuucaaucagaaccuggacuaccaaaucggguauauuugcagcggaguguuuggugauaauccccgcccuaaagacggcgaggggucauguaacccagucacuguugauggagcuaauggcgugaaggguuucaguuacaaauaugggaacggcguauggaucggaagaacaaaguccaauaggcugcggaaaggcuuugaaaugaucugggacccgaacggguggaccgacacugauagcgacuucucugugaagcaggaugucguggccauuacagacuggucaggauacagugguagcuuuguucagcaucccgagcucaccggcuuagauugcauacgcccuuguuucuggguggaacugguccgagggcuuccaaaggagaauacgaccaucuggacauccggaucuucgauuagcuucugcggcgugaacuccgacacugcaaacuggucauggcccgauggugcugaauugccuuuuaccaucgacaaauga

SEQ ID NO: 136539 - RNA, 1413 nt, Artificial Sequence; identical to SEQ ID NO: 136467
  derived and/or modified sequence opt3 from neuraminidase__InfluenzaA__ABB79993

SEQ ID NO: 136540 - RNA, 1410 nt, Artificial Sequence
  derived and/or modified sequence opt3 from neuraminidase__InfluenzaA__ABB80004
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcacggugucgucuuaugucuguuccggacuggugggcgauacaccccggaagaacgacucaaguagcuccucucauugccuugauccuaauaacgaggaaggugggcacggaguuaaaggcugggcuuucgacgauggcaaugacguguggauggggcgcaccaucagcgagaaguugcgaucaggauacgagacuuuuaaagucauugaagguuggaguaacccaaauuccaagcugcagaucaacagacaggugauuguagauaggggcaaucggagcggguauucuggaauauucucaguugagggcaaaaguuguaucaaccguugcuuuuacguggaacuaauucgcgguagaaaggaggaaaccgagguccucuggacaagcaauuccaucguggucuucugugggacuucuggcaccuauggaacaggcucguggcccgacggggccgauaucaaccugaugccuauuuga

SEQ ID NO: 136541 - RNA, 1410 nt, Artificial Sequence; identical to SEQ ID NO: 136525
  derived and/or modified sequence opt3 from neuraminidase__InfluenzaA__ABB80015

SEQ ID NO: 136542 - RNA, 1410 nt, Artificial Sequence
  derived and/or modified sequence opt3 from neuraminidase__InfluenzaA__ABB80037
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaaacaaucagguaaugccaugcgaaccgauuaucauagagagaaacaucacugaaauuguguauuugaauaacaccacaaucgagaaggaaauuugucccaaauuagucgaguacaggaauuggucaaagccucagugcaaaaucaccggguucgccccauuuaguaaggauaacagcauacggcuguccgcgggaggugacauuugggugacucgcgagcccuauguuucuugugauccuggcaagugcuaccaauucgcucuagggcagggaacaacccucgacaauaaacauucgaacgauacgauccacgaccgaaucccacaucguacucugcuuaugaaugaacugggcgugcccuuucacuuggguaccagacaggucuguauugccuggucaagcaguuccugccaugaugggaaggcauggcuccacguguguguaacaggagacgauaaaaacgccacugcuucuuucaucuaugacggcaggcugguugauagcauuggcuccuggucacagaauauacugcggacccaagagagugaaugcguguguaucaacgggacaugcaccgucgugaugacggacggaagcgcaucuggucgcgccgauacuaggauucucuuuaucgaggagggcaagauagugcacauuuccccuuuaucagggagcgcucagcaugucgaagagugcaguuguuacccaagguauccgggaguucggugcaucugucgcgacaauuggaaaggcucuaaccgacccgugguagacaucaacguggaagauuacuccauugacagcucguacgucugcucuggucuggugggggauacaccuagaaauaacgacagguccucaaauaguaacugucggaauccaaacaaugagcguggaaaccacggcguuaagggcugggccuucgaugacgggaaugauguguggaugggacgcaccaucagcaaggaccuuagauccgguuaugaaacuuuuaaagucauuggcggguggucuacacccaacagcaagucacagauaaauagacaggugaucguagauagugacaaccgguccggauacagcggcauuuucucuguugaggguaaaucaugcaucaaucgauguuuuuauguggaguugauccgcgggagagaacaagagaccagggucugguggacgaguaacagcauuguggucuucugcggcaccuccggaacauacggcacugggucuuggccugauggagcggacauaaaucugaugccaaucuga

SEQ ID NO: 136543 - RNA, 1413 nt, Artificial Sequence
  derived and/or modified sequence opt3 from neuraminidase__InfluenzaA__ABB80048
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagcagaucuugagaacacaggagucggagugcguguguguaaauggcucuugcuuuacuauuaugaccgauggucccuccaacggggccgcgucauacaaaaucuucaagauugaaaagggaaaaguuacaaagaguguggagcucaaugcaccuaacuuucacuaugaagaguguagcugcuacccagacaccggcacggucaugugugugugcagggauaauuggcacggcuccaaccggcccugggugucuuucaaucagaaccuggacuaccaaauaggguauaucugcagcggagucuuuggugauaauccucgcccaaaagacggcgaggggucauguaacccgguuacuguggauggagccaauggcguaaaggguuucaguuacaaauaugggaacggcguguggauuggaagaacaaaguccaauaggcugcggaaaggcuuugaaaugaucugggaccccaacggguggaccgacacugauagcgacuucucugucaagcaggaugugguugcuaucacagacuggucaggauacagugguagcuuugugcagcauccugagcucaccggcuuagauugcauucgcccauguuucugggucgaacuggugcgagggcuucccaaggagaauacgaccauauggacauccggaucuucgaucagcuucugcggcguaaacggugacacugccaacugguccuggccugauggggcagaauugccauuuaccauugacaaauga

SEQ ID NO: 136544 - RNA, 1410 nt, Artificial Sequence
  derived and/or modified sequence opt3 from neuraminidase__InfluenzaA__ABB80084
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuucaaauaaccaggugauguugugcgaaccaacuaucauagagagaaauaucaccgaaauuguauauuuaacaaacaccacuaucgagaaggaaauuuguccgaaacuggcagaguacaggaauuggaguaagccccagugcaaaaucacaggguucgccccuuuuagcaaggacaacuccauacggcuaucugcgggaggugauauuugggugacccgcgagccauaugucucgugugaccccgauaagugcuaccaauucgcucucggccaggggacgacucugaauaacggacauucaaaugacaccgugcacgaucgaacaccuuaucguacucuucugaugaacgaauugggcguuccauuucaucucgguaccaaacagguguguaucgccuggagcaguuccucuugccacgacgggaaggcauggcugcaugucugugugacaggacacgaugagaaugccaccgcuagcuucauuuacgacggcagacugguagauuccaucggcucauggaguaaaaagauccucaggacgcaggaaagcgagugcguuuguauuaacgggacuugcacaguggucaugaccgacggaucugcauccggucgggccgauacuaaaauauuauuuaucgaggaaggcaagauugugcacaucucacaacugagcgggagugcucagcauguggaggaaugcucuuguuauccccgcuacccuggagucagaugcguuuguagggacaauuggaagggcuccaaccggccaauaguggauauuaacguaaaagaccacagcaucgugucgucuuacgucugcuccggucuugugggggacacaccgcgcaagaaugauucaaguagcuccucucauuguuugaaccccaauaacgaggaaggaggccacggcguuaaagggugggccuucgacgauggaaaugacguguggaugggucgaaccaucagcgagaagcugagaucaggcuaugagacguuuaaagucauugaaggguggaguaagccuaacuccaaacuacagaucaauaggcaagugauuguagaucggggaaaccguagcggcuacucugguauauucucaguugaggggaagaguugcaucaaucgcuguuuuuauguggaacucauuagaggcaggaagcaggagaccgaagucugguggacaagcaacuccaucguggucuucugcggaacuucuggcaccuacgggacaggaucguggccagacggugcggauaucaaucugaugcccauuuga

SEQ ID NO: 136545 - RNA, 1410 nt, Artificial Sequence; identical to SEQ ID NO: 136530
  derived and/or modified sequence opt3 from neuraminidase__InfluenzaA__ABB80095

SEQ ID NO: 136546 - RNA, 1410 nt, Artificial Sequence; identical to SEQ ID NO: 136530
  derived and/or modified sequence opt3 from neuraminidase__InfluenzaA__ABB80162

SEQ ID NO: 136547 - RNA, 1410 nt, Artificial Sequence; identical to SEQ ID NO: 136530
  derived and/or modified sequence opt3 from neuraminidase__InfluenzaA__ABB80199

SEQ ID NO: 136548 - RNA, 1410 nt, Artificial Sequence
  derived and/or modified sequence opt3 from neuraminidase__InfluenzaA__ABB80210
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccugauaagugcuaccaauucgcucucggccaggggacgacucugaacaaucgacauucaaacgacaccgugcacgaucguacaccauauagaacucuucugaugaaugaauugggaguucccuuucaucucggcaccaaacagguguguaucgccuggagcaguuccucuugccacgacgguaaggcauggcugcaugucugugugacagggcacgaugagaacgccaccgcuagcuucauuuacgacggaaggcugguagauuccaucggcucauggaguaaaaagauccuccggacgcaggaaagcgagugcguuuguauuaauggcacuugcacaguggucaugaccgacgggucugcauccggacgcgccgauacuaaaauauuauuuaucgaggaagguaagauugugcacaucucaccucugagcggcagugcucaacauguggaggaaugcucuuguuauccaagauacccgggggucaggugcguuugucgggacaacuggaagggauccaaucgccccauaguggauauuaacguaaaagacuacagcaucgugucgucuuaugucugcuccggccuugugggugacacaccucgaaagaacgauucaaguagcuccucucacuguuugaauccaaacaaugaggaagggggacauggcguuaaaggcugggccuucgacgaugggaacgacguguggaugggaagaaccaucagcgagaaguuuaggucagguuacgagacguucaaagucauugaaggcuggaguaagcccaauuccaaacugcagaucaaccgucaggugauuguagaucgggggaaucgcagcggauauucuggcauauuuucaguugaggguaagaguugcaucaacagauguuucuacguggaacuaauuagggggcggaagcaggagaccgaagucugguggacaagcaauuccaucguggucuuuugcggcacuucuggaaccuauggcacagggucguggccugacggagcggauaucggucucaugccaauuuga

SEQ ID NO: 136549 - RNA, 1410 nt, Artificial Sequence
  derived and/or modified sequence opt3 from neuraminidase__InfluenzaA__ABB80232
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuagcggcuggaggugauauuugggugacccgcgagcccuaugucuccugugacccugauaagugcuaccaauucgcccucggccaggggacgacucugaauaaccgacauucuaaugacaccgugcacgaucguacaccauauagaacucuucugaugaacgaauugggaguucccuuucaucucggcaccaaacagguguguaucgcauggucgucaagcaguugccacgacgguaaggccuggcugcaugucugugugacagggcacgaugagaaugcuaccgcauccuucauuuacgacggaaggcugguagauucuaucggcagcugguccaaaaagauccuccggacgcaggaaucagagugcguuuguauuaacggcacuugcacaguggucaugaccgacgggagugccagcggacgcgcugauacuaaaauauuauuuaucgaggaagguaagauugugcacaucucucaacuguccggcucagcccagcauguggaggaaugcagcuguuauccuagauacccaggggucaggugcguuugucgggacaauuggaagggaaguaaccgcccgauaguggauauuaacguaaaagacuacucuaucguguccagcuaugucugcucgggccuugugggugacacaccccgaaagaaugauucuuccucaaguagccacuguuugaacccuaauaacgaggaagggggacauggcguuaaaggcugggcguucgacgauggggacgauguguggaugggaagaaccaucuccgagaagcugaggucugguuacgagacguuuaaagucauugaaggcuggagcaagccaaauucaaaacuacagaucaaccgucaggugauuguagaccgggggaaucgcaguggauauuccggcauauucagcguugaggguaagucuugcaucaacagauguuuuuacguggaacucauuagggggcggaagcaagagaccgaagucugguggacaucaaauaguaucguggucuucugcggcacuagcggaaccuauggcacaggguccuggcccgauggagcagacaucaaccugaugccuauuuga

SEQ ID NO: 136550 - RNA, 1410 nt, Artificial Sequence
  derived and/or modified sequence opt3 from neuraminidase__InfluenzaA__ABB80243
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaacggacauucgaaugacaccgugcacgaucgaacaccauaucguacucuucugaugaacgaauugggcguucccuuucaucucgguaccaaacagguguguaucgccuggucaagcaguuccugccacgacgggaaggcauggcugcaugucugugugacaggacacgaugagaaugccaccgcuucuuucauuuacgacggcagacugguagauagcaucggcuccuggaguaaaaagauccucaggacgcaggaaucagagugcguuuguauuaacgggacuugcacaguggucaugaccgacggaagcgcaucuggucgggccgauacuaaaauauuauuuaucgaggaaggcaagauugugcacaucucccaacugucagggagcgcucagcauguggaggaaugcaguuguuauccucgcuacccaggagucagaugcguuuguagggacaauuggaagggcucuaaccggccgauaguggauauuaacguaaaagaccacuccaucgugagcucguacgucugcucuggucuugugggggacacaccccgcaagaaugauuccucaaguagcucccauuguuugaacccuaauaacgaggaaggaggccacggcguuaaagggugggccuucgacgauggaaaugacguguggaugggucgaaccaucucugagaagcugagaagcggcuaugagacguuuaaagucauugaaggguggucaaagccaaacaguaaacuacagaucaauaggcaagugauuguagaucggggaaaccguuccggcuacagcgguauauucucuguugaggggaagucaugcaucaaucgcuguuuuuauguggaacucauuagaggcaggaagaaagagaacgaagucugguggaccaguaauagcaucguggucuucugcggaacauccggcacuuacgggaccggaucuuggcccgacggugcggauaucaaccugaugccuauuuga

SEQ ID NO: 136551 - RNA, 1410 nt, Artificial Sequence
  derived and/or modified sequence opt3 from neuraminidase__InfluenzaA__ABB80254
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucguguggcccugacaagugcuaccaauucgcucucgggcagggaacgacucugaacaaucgacauucaaacgauaccgugcacgaccguacaccauauagaacucuucugaugaaugaauugggcguucccuuucaucucgguaccaaacagguguguaucgccuggagcaguuccucuugccacgaugggaaggcauggcugcaugucugugugacaggacacgacgagaacgccaccgcuagcuucauuuacgauggcaggcugguagacuccaucggcucauggaguaaaaagauccuccggacgcaggaaagcgagugcguuuguauuaaugggauaugcacuguggucaugacagauggaucugcauccggucgcgccgacaccaaaaucuuauuuauugaggaaggcaagaucgugcacauaucaccucugagcgggagugcucaacauguggaggaaugcucuuguuauccaagauacccgggagucaggugcguuugucgggauaacuggaagggcuccaaucgccccauuguggacaucaacguaaaagauuacagcaucgugucgucuuaugucugcuccggucuugugggggacacuccucgaaagaacgacucaaguagcuccucucacuguuugaauccaaacaaugaggaaggaggccauggcguuaaagggugggccuucgaugacggaaacgauguguggauggguagaacaauuagcgagaaguuuaggucaggcuacgagaccuucaaagucaucgaaggguggaguaagcccaauuccaaacugcagauuaaccgucaggugauaguagaccggggaaaucgcagcggcuauucugguaucuuuucaguugaggggaagaguugcauuaacagauguuucuacguggaacuaaucaggggccggaagcaggagacggaagucugguggaccagcaauuccaucguggucuuuugcggaacaucuggcacuuaugggaccggaucguggccugauggugcggacauuaaccucaugccaauauga

SEQ ID NO: 136552 - RNA, 1410 nt, Artificial Sequence; identical to SEQ ID NO: 136143
  derived and/or modified sequence opt3 from neuraminidase__InfluenzaA__ABB80495

SEQ ID NO: 136553 - RNA, 1410 nt, Artificial Sequence; identical to SEQ ID NO: 136530
  derived and/or modified sequence opt3 from neuraminidase__InfluenzaA__ABB80506

SEQ ID NO: 136554 - RNA, 1410 nt, Artificial Sequence; identical to SEQ ID NO: 136530
  derived and/or modified sequence opt3 from neuraminidase__InfluenzaA__ABB80517

SEQ ID NO: 136555 - RNA, 1410 nt, Artificial Sequence; identical to SEQ ID NO: 136530
  derived and/or modified sequence opt3 from neuraminidase__InfluenzaA__ABB80532

SEQ ID NO: 136556 - RNA, 1410 nt, Artificial Sequence
  derived and/or modified sequence opt3 from neuraminidase__InfluenzaA__ABB80644
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccugauaagugcuaccaauucgcucucggccaggggacgacucugaacaaucgacauucaaacgacaccgugcacgaucguacaccauauagaacucuucugaugaaugaauugggaguucccuuucaucucggcaccaaacagguguguaucgccuggagcaguuccucuugccacgacgguaaggcauggcugcaugucugugugacagggcacgaugagaacgccaccgcuagcuucauuuacgacggaaggcugguagauuccaucggcucauggaguaauaaaauccuccggacgcaggaaagcgagugcguuuguauuaacggcacuugcacaguggucaugaccgacgggucugcauccggacgcgccgauacuaagauauuauuuaucgaggaagguaaaauugugcacaucucaccucugagcggcagugcucaacauguggaggaaugcucuuguuauccaagauacccgggggucaggugcguuugucgggacaauuggaagggauccaaccgccccauaguggauauuaacguaaaggacuacagcaucgugucgucuuaugucugcuccggccuugugggugacacaccucggaaaaaugauucaaguagcuccucucacuguuugaacccaaauaacgaggaagggggacauggcguuaagggcugggccuucgacgaugggaaugacguguggaugggaagaaccaucagcgagaaauuuaggucagguuacgagacguucaaggucauugaaggcuggaguaaacccaacuccaagcugcagaucaaucgacaggugauuguagaucgugggaaccgcagcggauauucuggcauauuuucaguugaggguaaaaguugcaucaauagauguuucuacguggaacuaauuagggggcggaagcaggagaccgaagucugguggacaagcaacuccaucguggucuuuugcggcacuucuggaaccuauggcacagggucguggccugacggagcggauaucaaucucaugccaauuuga

SEQ ID NO: 136557 - RNA, 1410 nt, Artificial Sequence
  derived and/or modified sequence opt3 from neuraminidase__InfluenzaA__ABB80664
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccugauaagugcuaccaauucgcucucggccaggggacgacucugaacaaucgacauucaaacgacaccgugcacgaucguacaccauauagaacucuucugaugaaugaauugggaguucccuuucaucucggcaccaaacagguguguaucgccuggagcaguuccucuugccacgacgguaaggcauggcugcaugucugugugacagggcacgaugagaacgccaccgcuagcuucauuuacgacggaaggcugguagauuccaucggcucauggaguaaaaagauccuccggacgcaggaaagcgagugcguuuguauuaauggcacuugcacaguggucaugaccgacgggucugcauccggacgcgccgauacuaaaguguuauuuauagaggaagguaagaucgugcacauuucaccucugagcggcagugcucaacaugucgaggaaugcucuuguuauccaagauacccggggguuaggugcgugugucgggacaacuggaagggauccaaucgccccaucguagauauaaacgugaaagacuacagcauugucucgucuuaugugugcuccggccuuguuggugacacaccucgaaagaacgauucaaguagcuccucucacuguuugaauccaaacaaugaggaagggggacauggcgugaaaggcugggccuucgacgaugggaacgacgucuggaugggaagaaccaucagcgagaaguuuaggucagguuacgagacguucaaagugaucgaaggcuggaguaagcccaauuccaaacugcagauuaaccggcagguaaucguugaucgugggaaucgcagcggauauucuggcauauuuucaguggaggguaagaguugcauuaacagauguuucuacgucgaacuaaucagggggcggaagcaggagaccgaagugugguggacaagcaauuccauugucguguuuugcggcacuucuggaaccuauggcacagggucguggccugacggagcggauaucaaccucaugccaaucuga

SEQ ID NO: 136558 - RNA, 1410 nt, Artificial Sequence
  derived and/or modified sequence opt3 from neuraminidase__InfluenzaA__ABB80675
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuagcggcuggaggugauauuugggugacccgcgagcccuaugucuccugugacccugauaagugcuaccaauucgcccucggccaggggacgacucugaauaaccgacauucuaaugacaccgugcacgaucguacaccauauagaacucuucugaugaacgaauugggaguucccuuucaucucggcaccaaacagguguguaucgcauggucgucaagcaguugccacgacgguaaggccuggcugcaugucugugugacagggcacgaugagaaugcuaccgcauccuucauuuacgacggaaggcugguagauucuaucggcagcugguccaaaaagauccuccggacgcaggaaucagagugcguuuguauuaacggcacuugcacaguggucaugaccgacgggagugccagcggacgcgcugauacuaaaauauuauuuaucgaggaagguaagauugugcacaucucucaacuguccggcucagcccagcauguggaggaaugcagcuguuauccuagauacccaggggucaggugcguuugucgggacaauuggaagggaaguaaccgcccgauaguggauauuaacguaaaagacuacucuaucguguccagcuaugucugcucgggccuugugggugacacaccccgaaagaaugauucuuccucaaguagcuacuguuugaacccuaauaacgaggaagggggacacggcguuaaaggcugggcguucgacgauggggacgauguguggaugggaagaaccaucuccgagaagcugaggucugguuaugagacguuuaaagucauugaaggcuggagcaagccaaauucaaaacuacagaucaaccgucaggugauuguagaccgggggaaucgcaguggauacuccggcauauucagcguugaggguaagucuugcaucaacagauguuuuuauguggaacucauuagggggcggaagcaagagaccgaagucugguggacaucaaauaguaucguggucuucugcggcacuagcggaaccuacggcacaggguccuggcccgauggagcagacaucaaccugaugccuauuuga

SEQ ID NO: 136559 - RNA, 1410 nt, Artificial Sequence
  derived and/or modified sequence opt3 from neuraminidase__InfluenzaA__ABB80685
augaaccccaaucagaagaucauuaccauaggcagcgugucccugacaaucgccacuauuugcuuccucaugcaaaucgcuauucuugucaucacgguuacccugcacuuuaaacaguacgaguguaacucuccuccaaauaaccaggugauguugugcgaaccgacaauaaucgagagaaauauuacugaaaucguauauuuaaccaacacaaccauugagaaggaaaucugucccaaacuggcagaguacaggaauuggucaaagccucagugcaaaauaacuggguucgccccauuuaguaaggacaacagcauucggcuauccgcgggaggugauaucugggugacacgcgagcccuaugucucuugugacccugauaagugcuaccaauucgcucucggccaggggaccacgcugaauaacggacauucgaaugacacugugcacgaucgaaccccauaucguacacuucugaugaacgaauugggcguucccuuucaucucgguacuaaacagguguguauugccuggucaagcaguuccugccacgacgggaaggcauggcugcaugucugugugaccggacacgaugagaaugccacagcuucuuucaucuacgacggcagacugguagauagcaucggcuccuggaguaaaaagauucucaggacccaggaaucagagugcguuuguauaaacgggacgugcacuguggucaugacagacggaagcgcaucuggucgggccgauaccaaaaucuuauuuauugaggaaggcaagaucgugcacauaucccaacugucagggagcgcucagcauguggaggaaugcaguuguuauccucgcuacccaggagucagaugcguuuguagggacaauuggaagggcucuaaccggccgauuguggauaucaacguaaaagaccacuccaucgugagcucguacgucugcucuggucuugugggggacacuccccgcaagaaugauuccucaaguagcucccauuguuugaacccuaauaacgaggaaggaggccacggcguuaaagggugggccuucgacgauggaaaugacguguggaugggucgaacaauuucugagaagcugagaagcggcuaugagaccuuuaaagucaucgaaggguggucaaagccaaacaguaaacuacagauuaauaggcaagugauaguagaucggggaaaccguuccggcuacagcgguaucuucucuguugaggggaagucaugcauuaaucgcuguuuuuauguggaacucaucagaggcaggaagcaggagacggaagucugguggaccaguaacagcaucguggucuucugcggaacauccggcacuuacgggaccggaucuuggcccgacggugcggauauuaaucugaugccuauauga

SEQ ID NO: 136560 - RNA, 1410 nt, Artificial Sequence; identical to SEQ ID NO: 136530
  derived and/or modified sequence opt3 from neuraminidase__InfluenzaA__ABB80696

SEQ ID NO: 136561 - RNA, 1410 nt, Artificial Sequence
  derived and/or modified sequence opt3 from neuraminidase__InfluenzaA__ABB80707
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucguguggcccugacaagugcuaccaauucgcucucgggcagggaacgacucugaacaaucgacauucaaacgauaccgugcacgaccguacaccauauagaacucuucugaugaaugaauugggcguucccuuucaucucgguaccaaacagguguguaucgccuggagcaguuccucuugccacgaugggaaggcauggcugcaugucugugugacaggacacgacgagaacgccaccgcuagcuucauuuacgauggcaggcugguagacuccaucggcucauggaguaaaaagauccuccggacgcaggaaagcgagugcguuuguauuaaugggacuugcacaguggucaugaccgauggaucugcauccggucgcgccgacacuaaaauauuauuuaucgaggaaggcaagauugugcacaucucaccucugagcgggagugcucaacauguggaggaaugcucuuguuauccaagauacccgggagucaggugcguuugucgggauaacuggaagggcuccaaucgccccauaguggacauuaacguaaaagauuacagcaucgugucgucuuaugucugcuccggucuugugggggacacaccucgaaagaacgacucaaguagcuccucucacuguuugaauccaaacaaugaggaaggaggccauggcguuaaagggugggccuucgaugacggaaacgauguguggauggguagaaccaucagcgagaaguuuaggucaggcuacgagacguucaaagucauugaaggguggaguaagcccaauuccaaacugcagaucaaccgucaggugauuguagaccggggaaaucgcagcggcuauucugguauauuuucaguugaggggaagaguugcaucaacagauguuucuacguggaacuaauuaggggccggaagcaggagaccgaagucugguggacaagcaauuccaucguggucuuuugcggaacuucuggcaccuaugggacaggaucguggccugauggugcggacaucaaccucaugccaauuuga

SEQ ID NO: 136562 - RNA, 1410 nt, Artificial Sequence; identical to SEQ ID NO: 136530
  derived and/or modified sequence opt3 from neuraminidase__InfluenzaA__ABB80716

SEQ ID NO: 136563 - RNA, 1410 nt, Artificial Sequence
  derived and/or modified sequence opt3 from neuraminidase__InfluenzaA__ABB80725
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugauguugugcgaaccgacuguaaucgagagaaacauaaccgaaaucguguauuuaacaaauaccacuauugagaaggaaaucugucccaaacuggcagaguacaggaacuggaguaagccucagugcaaaauuacaggguucgccccauuuagcaaggacaauuccauccggcuaucugcgggaggugauauaugggucacccgcgagcccuaugugucgugugacccugauaagugcuaccaauucgcucucggccaggggacgacucugaacaaucgacauucaaacgacaccguucacgaucguacaccauauagaacucuucugaugaaugaauugggagugcccuuucaucucggcaccaaacaggucuguauugccuggagcaguuccucuugccacgacgguaaggcauggcugcauguguguguaacagggcacgaugagaacgccaccgcuagcuucaucuacgacggaaggcugguugauuccauuggcucauggaguaaaaagauccuccggacgcaggaaagcgagugcguguguaucaauggcacuugcacagucgugaugaccgacgggucugcauccggacgcgccgauacuaaaauuuuauuuauagaggaagguaagaucgugcacauuucaccucugagcggcagugcucaacaugucgaggaaugcucuuguuauccaagauacccggggguuaggugcgugugucgggacaacuggaagggauccaaucgccccaucguagauauaaacgugaaagacuacagcauugucucgucuuaugugugcuccggccuuguuggugacacaccucgaaagaacgauucaaguagcuccucucacuguuugaauccaaacaaugaggaagggggacauggcgugaaaggcugggccuucgacgaugggaacgacgucuggaugggaagaaccaucagcgagaaguuuaggucagguuacgagacguucaaagugaucgaaggcuggaguaagcccaauuccaaacugcagauuaaccggcagguaaucguugaucgugggaaucgcagcggauauucuggcauauuuucaguggaggguaagaguugcauuaacagauguuucuacgucgaacuaaucagggggcggaagcaggagaccgaagugugguggacaagcaauuccauugucgcguuuugcggcacuucuggaaccuauggcacagggucguggccugacggagcagauaucaaccucaugccaaucuga

SEQ ID NO: 136564 - RNA, 1410 nt, Artificial Sequence
  derived and/or modified sequence opt3 from neuraminidase__InfluenzaA__ABB80740
augaaccccaaucagaagaucauuaccauaggcagcgugucccugacaaucgccacuauuugcuuccucaugcaaaucgcuauucuugucacgaccguuacacugcacuuuaaacaguacgaguguugcucuccuccaaacaaucaggugauguugugugaaccgacuaucauagagagaaacaucaccgaaauuguauauuuaacaaauaccacuaucgagaaggaaauuugccccaaacuggcagaguacaggaacuggucaaagccucaguguaaaaucacaggguucgccccauuuaguaaggacaauagcauacggcuauccgcgggaggugauauuugggugacccgcgagcccuaugucucuugcgacccugauaaguguuaccaauucgcucucggccaggggacgacucugaacaaucgacauucgaacgacaccgugcacgaucguacaccauauagaacucuucugaugaaugaauugggaguucccuuucaucucggcaccaaacaggugugcaucgccuggucaagcaguuccugucacgacgguaaggcauggcugcaugucugcgugacagggcacgaugagaacgccaccgcuucuuucauuuacgacggaaggcugguagauagcaucggcuccuggaguaaaaagauccuccggacgcaggaaucagaguguguuugcauuaauggcacuugcacaguggucaugaccgacgggagcgcaucuggacgcgccgauacuaaaauauuauuuaucgaggaagguaagauugugcacaucuccccucugucaggcagcgcucaacauguggaggaauguaguugcuauccaagauacccgggggucagguguguuugccgggacaacuggaagggaucuaaucgccccauaguggauauuaacguaaaagacuacuccaucgugagcucguaugucuguucuggccuugugggugacacaccucgaaagaacgauuccucaaguagcucccacugcuugaauccaaacaaugaggaagggggacauggcguuaaaggcugggccuucgacgaugggaacgacguguggaugggaagaaccaucucugagaaguuuaggagcgguuacgagacguucaaagucauugaaggcuggucaaagcccaauaguaaacugcagaucaaccgucaggugauuguagaucgggggaaucgcuccggauauagcggcauauuuucuguugaggguaagucauguaucaacagaugcuucuacguggaacuaauuagggggcggaagcaggagaccgaagucugguggacaaguaauagcaucguggcguuuuguggcacuuccggaaccuauggcacagggucuuggccugacggagcagauaucaaccucaugccaauuuga

SEQ ID NO: 136565 - RNA, 1410 nt, Artificial Sequence; identical to SEQ ID NO: 136530
  derived and/or modified sequence opt3 from neuraminidase__InfluenzaA__ABB80751

SEQ ID NO: 136566 - RNA, 1410 nt, Artificial Sequence; identical to SEQ ID NO: 136249
  derived and/or modified sequence opt3 from neuraminidase__InfluenzaA__ABB82186

SEQ ID NO: 136567 - RNA, 1413 nt, Artificial Sequence; identical to SEQ ID NO: 136412
  derived and/or modified sequence opt3 from neuraminidase__InfluenzaA__ABB82197

SEQ ID NO: 136568 - RNA, 1413 nt, Artificial Sequence; identical to SEQ ID NO: 136402
  derived and/or modified sequence opt3 from neuraminidase__InfluenzaA__ABB82208

SEQ ID NO: 136569 - RNA, 1413 nt, Artificial Sequence
  derived and/or modified sequence opt3 from neuraminidase__InfluenzaA__ABB82219
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuauugcagagaaagacaagaccucggugacacuugccggaaauucaagccuguguaguaucuccggaugggcgaucuacaccaaagauaacucuauuaggauaggcagcaagggugacguauucgugauccgggagccuuuuauuuccugcucaaauuuggaaugucgcacuuucuuuuuaacacaaggggcucugcuaaacgauaaacauaguaauggaaccgucaaggaccgaagcccauaucgugcccucaugucuugcccgcugggcgaggcacccuccccuuacaacucaaaguucgaaagcguggccuggagugcuucugcaugucacgauggcaugggguggcuuacgaucggaauauccgguccagacaacggcgccguugcugugcugaaauauaaugggauuaucacugagaccaucaagagcuggaaaaagagaauuuugaggacacaggagucggaaugcgucugugugaacggaucuugcuuuacuaucaugaccgauggccccuccaauggugccgcgucauacaaaauuuucaagauagagaaggggaaaguaacaaagaguaucgaacucaacgcaccuaauuuucauuaugaggaguguagcugcuacccagacaccggaacgguuaugugugugugccgggauaacuggcacggcuccaaucgccccugggucucuuucaaccagaaucuggacuaccagauuggcuauaucugcagcgggguguuuggagauaacccuagaccaaaagacggugaaggcucauguaauccggugacugucgauggggccgacggaguuaagggcuucaguuacaaauaugguaacgggguguggaucggcaggacaaaguccaaucggcugcgcaaaggauuugagaugauuugggaccccaacggcuggaccgauacugacagcgauuucucuguaaagcaagacguggucgcuauaacagauuggucaggguacagugggagcuuugugcagcacccugaacucaccgguuuagacugcauccgaccauguuucuggguugagcuggugagaggccuucccagggaaaauacgaccauuuggacauccgggucuucgaucagcuucugcggagucaacuccgaugccgcagacuggucauggccugauggcgcugaguugccauuuacuauugacaaguga

SEQ ID NO: 136570 - RNA, 1410 nt, Artificial Sequence
  derived and/or modified sequence opt3 from neuraminidase__InfluenzaA__ABB82230
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaaacaaucagguaaugccaugcgaaccgauuaucauagagagaaacaucacugaaauuguguauuugaccaauacaaccaucgagaaggaaauuugucccaaauuagucgaguacaggaacuggucaaagccucagugcaaaaucacuggguucgccccauuuaguaaggauaauagcauacggcuguccgcgggaggugacauuugggugacacgcgagcccuauguuucuugugauccuggcaagugcuaccaauucgcucuagggcagggaaccacgcucgacaacaaacauucgaaugauacuauccacgaccgaaucccacaucguacccugcuuaugaacgaacugggcgugcccuuucacuuggguacaagacaggucuguauugccuggucaagcaguuccugccaugaugggaaggcauggcuccacguguguguaacuggagacgauaaaaaugccaccgcuucuuucaucuaugacggcaggcugguugauagcauuggcuccuggucacagaacauacugcggacacaagagagugaaugcguguguaucaaugggaccugcacggucgugaugacugacggaagcgcaucuggucgcgccgauacaaggauucucuuuaucgaggagggcaagauagugcacauuuccccuuuaucagggagcgcucagcaugucgaagagugcaguuguuacccaagauauccgggaguucggugcaucugucgcgacaacuggaaaggcucuaaucgacccaucguggacauuaacguaaaggauuacuccaucgacagcagauacgugugcucgggucuggucggggauaccccuaggaacaaugaccggucuuccaacucaaauugucguaacccaaauaacgauaagggaaaucacggcgugaaaggcugggccuucgacgaugggaacgacguuuggaugggacgcacuauuaguaaggauagcagauccgguuaugaaacauuuaaagugauaggcggguggucuacccccaauagcaagucacagaucaacaggcaggucauuguggacagugauaaucgguccggauacagcggcaucuucucuguagaggguaaaucaugcaucaaccgauguuuuuauguugaacuuauucgcgggagagagcaagagacgagggugugguggaccaguaauagcauagucguguucugcggcacauccggaacuuacggcaccgggucuuggccugacggagcggacaucaacuugaugccaauuuga

SEQ ID NO: 136571 - RNA, 1410 nt, Artificial Sequence
  derived and/or modified sequence opt3 from neuraminidase__InfluenzaA__ABB83018
augaaccccaaucagaagaucauuaccauaggcagcgugucccugacaaucgccacuauuugcuuccucacgcaaaucgcuauucuugucaccacaguuacucugcacuuuaaacaguacggguguaacucuccuccaaauaaccaggugauguugugcgagccgaccaucauagaaagaaauaucacagagauuguauauuuaaccaacacuacaaucgaaaaggagauuugucccaaacuggcagaauacaggaauuggucaaagccucagugcaacaucaccggauucgccccauuuaguaaagacaauagcauacggcuauccgcggguggcgauauuugggugacgcgcgagcccuaugucucuugugacccugauaagugcuaccaauucgcucucgggcagggaacuacccugaacaauggccauucgaacgacacagugcacgaucgaacuccauaucguacccuucugaugaaugaguuggguguucccuuucaucucgggacaaaacagguguguaucgccuggucaagcaguuccugccacgacggaaaagcauggcugcaugucugugugaccggcgaugacaagaacgccacggcuucuuucauuuacaauggcagacugguagauagcaucggguccuggucaaagaagauccucaggacucaggaaagugagugcguuuguauuaacggaacaugcaccguggucaugacugacgguagcgcaucuggcaaagccgauacaaagauauuauuuaucgaagaggggaagauugugcacaccucccugcuuucaggaagcgcucaacacguggaggaaugcaguuguuauccucgguacccaggcguccgcugcguuuguagagacaacuggaaagguucuaauaggccgaucguggauauaaacguaaaggacuacuccauugugagcucguaugucugcucuggguuggugggagacacgccccggaaaaaugauuccucaaguagcucccauugucuggacccuaacaaugaggaaggcggccacgggguuaagggaugggccuucgaugacgguaacgauguguggaugggccgcaccaucucugagaaacuacgaagcggguacgaaacauuuaaggucaucgagggauggucaaaaccaaauaguaagcuccagauuaacagacaggugaucguagacaggggcaaucgguccgguuauagcgggauuuucucuguugagggcaagucaugcauaaaccguuguuuuuacguggaacugauccgcggaagaaaucaggagacugaaguccuuuggaccaguaacagcauuguggucuucugcggcacauccgggacuuauggaaccgguucuuggcccgauggcgcggacaucaaucugaugccuaucuga

SEQ ID NO: 136572 - RNA, 1410 nt, Artificial Sequence; identical to SEQ ID NO: 136571
  derived and/or modified sequence opt3 from neuraminidase__InfluenzaA__ABB83029

SEQ ID NO: 136573 - RNA, 1410 nt, Artificial Sequence; identical to SEQ ID NO: 136398
  derived and/or modified sequence opt3 from neuraminidase__InfluenzaA__ABB83130

SEQ ID NO: 136574 - RNA, 1410 nt, Artificial Sequence
  derived and/or modified sequence opt3 from neuraminidase__InfluenzaA__ABB83141
augaaccccaaucagaagaucauuaccauaggcagcgugucccugacaaucgccacuauuugcuuccucucucaaaucgcuauucuugucacgaccguuacacugcacuuuaaacaguacgaguguaacucaccuccaaauaaccaggugauguugugcgaaccgacuaucauagagagaaauaucaccgaaauuguauauuuaacaaacaccacuaucgagaaggaaauuugucccaaacuggcagaguacaggaauuggaguaagccucagugcaacaucacaggguucgccccauuuagcaaagacaauuccauacggcuaucugcgggaggugauauuugggugacccgcgagcccuaugucucgugugacccugauaagugcuaccaauucgcucucggccaggggacgacucugaacaauggacauucaaacgacaccgugcacgaucgaacaccauaucguacucuucugaugaaugaauugggcguucccuuucaucucgguaccaaacagguguguaucgccuggagcaguuccucuugccacgacgggaaggcauggcugcaugucugugugacaggagaugacaagaacgccaccgcuagcuucauuuacaauggcagacugguagauuccaucggcucauggaguaaaaagauccucaggacgcaggagagcgaaugcguuuguauuaacgggacuugcacaguggucaugaccgacggaucugcauccgguaaagccgauacuaagauauuauuuaucgaggagggcaagauugugcacacaucacugcuuagcgggagugcucaacacguggaagagugcucuuguuauccucgguacccaggaguccgcugcguuuguagagacaacuggaaaggcuccaauaggccgaucguggauauaaacguaaaggacuacagcauugugucgucuuaugucugcuccgguuuggugggggacacgccccggaaaaaugauucaaguagcuccucucauugucuggacccuaacaaugaagagggaggccacggcguuaaggggugggccuucgaugacggaaacgauguguggaugggucgcaccaucagcgaaaaacuacgaucaggcuacgagaccuuuaaggucaucgagggguggaguaaaccaaauuccaagcuccagauuaacagacaggugaucguagacagggauaaucggagcggauauucuggcauuuucucaguugaagguaagaguugcauaaaccguuguuuuuacguggagcugauccgcgggagaaaucaggaaacagagguccuuuggacuagcaacuccauuguggucuucugcggcaccucuggaacauauggcacugggucguggcccgacggagcggauaucaaucugaugccuaucuga

SEQ ID NO: 136575 - RNA, 1410 nt, Artificial Sequence
  derived and/or modified sequence opt3 from neuraminidase__InfluenzaA__ABB86876
augaacaccaaucagagaaucauuacaauaggcacugugugccugaucgucgggauuaucagccuccuucugcaaauuggaaacaucguuuccuuguggauaucucacucaauccagacggguggcaagaaucauagugagauguguaaccagaaugugauuaccuacguaaacaauacaugggugaacaggacuuaugucaauaucagcaacaccaauauugccacagugcaggacguuaccuccgugaucuuagcugggaacucuucgcugugcucagucagcggaugggcaauauacaguaaagauaauuccauucggaucggcucuaagggugacauuuucgugauccgcgaacccuuuaucagcuguucccaccuagagugccgaacuuucuuucucacacaaggggcccugcuuaacgauaaacauucaaauggaaccguaaaggaccguaguccuuauagaacgcugaugagcuguccaauuggcgaagcgccgucucccuacaacuccagguucgagucaguugcuuggagcgccagugcaugccacgauggcauggggugguugacuauaggaaucucugguccugacaacggcgccguggcuguccucaaauauaaugggauuaucaccgauacaauaaaguccuggcggaacaagauucugcgcacucaggaaagcgagugugugugcaugaauggaucguguuuuaccgugcugacagacggcccaucuaacggucaggcauccuacaaaaucuucaaggucgagaaagggaagaucauuaaaucaaucgaacucgaugcccccaauuaucauuacgaggaaugcaguuguuacccugacaccggaaagguuaugugcgugugcagagauaacuggcacgcuagcaauaggccauggguauccuuugaccagaacuuagauuaucaaauuggcuacauauguucuggcguguucggggacaauccccggagcaacgacggaaaggguaauugcggcccuguccugucaaacggggccaauggagugaaaggcuuuaguuuccgcuaugguaacgggguuuggaucggccgaacgaaguccauuaauagcagaucuggauuugagaugaucugggauccaaacggcuggacugggacagacucaaguuucagcaugaaacaggauaucauugcgcuuaccgacugguccggauacucugguucguuugugcagcacccggaguugacuggcaugaacuguauaaggcccugcuucugggucgaacugauccgggggcagccuaaggagagcacaauuugggcauccggaucaaguaucucuuucuguggcguggauagcgaaaccacguccuggucauggccagacggugccgaucuacccuuuaccauugacaaauga

SEQ ID NO: 136576 - RNA, 1410 nt, Artificial Sequence
  derived and/or modified sequence opt3 from neuraminidase__InfluenzaA__ABB86886
augaacaccaaucagagaaucauuacaauaggcacugccugccuggcuaucgggauugugagccuccuucugcaaaucggaaacauugucuccuuguggaucucucacucaauacagacggaggaaaagaaucauagugagaccuguagccagaacuucaucacacacgaaaauaacacuuggguuaaucagaccuacauuaacaucuccaauacaaacaaugugguaggucaaggcgugaccucuauuauguuagcagggaacucgucacugugccccaucagcggaugggccauauauaguaaagacaauuccauuaggaucggcucuaagggugauauuuuugucauccgggagccuuucaucagcuguucccaucuagaaugccgcacguuuuuccucacacagggggcgcugcuuaacgacaaacacucaaauggaaccgugaaggaucgaaguccauaccguacgcugaugagcuguccgauuggcgaggcucccucuccuuauaacuccagauuugagucaguugccuggagcgcaagugccugccaugacggcauggggugguugacuauaggaaucucugguccagauaacggcgcuguggcagucuucaaauacaaugggauuaucaccgacacaauaaaguccuggaggaacaagauucuccggacucaggaaagcgagugugugugcaucaauggaucguguuuuaccaucaugacagauggccccucuaacggucaggccuccuauaaaauuuucaagauggaaaaagggaagaucauuaaaucaguagagcuggacgcuccuaauuaccacuaugaggaaaguagcugcuacccagauaccggaaagguugugugugucugccgcgacaacuggcacgccuccaauagacccugggugucuuuugaucaaaaccuggacuaccagauaggcuauaucugcagcggcguguucggggauaauccuaggucaaacgacggaaaggguaauuguggcccaguccucaguaacggggcgaauggaguuaaagagguguccuuucgguacggcaacgguguauggauugggcgcacuaagagcaucucuucacgaaguggcuucgaaaugaucugggacccgaauggauggacugagacagauagcuccuuuucuauuaaacaggacauaaucgcauuaaccgauuggucgggcuauagcggguccuucgugcagcaucccgaacugacuggaaugaacugcauuaagccuuguuucugggucgagcuuaucagaggucaaccaaaagagucaacaauuuggaccaguggcucuagcaucuccuuuugcgggguggacucagaaacggccagcuggucuuggcccgauggagcugacuugccuuucaccauagauaaguga

SEQ ID NO: 136577 - RNA, 1410 nt, Artificial Sequence
  derived and/or modified sequence opt3 from neuraminidase__InfluenzaA__ABB86898
augaaccccaaucagaagaucauuaccauaggcagcgugucccugacacucgccacuaucugcuuccuuaugcaaauugcuauccuggucacgaccguuacauugcacuuuaaacagcaggaguguaacucuccuccaaauaaccaggugauguuaugcgaaccgacuauuaucgagagaaauauaaccgaaaucguauaccugacaaacaccacuauugagaaggaaaucugucccaaacuagcagaguauaggaauuggucaaagccucaaugcaacauuacaggguucgccccauuuaguaaagacaauagcauccggcucuccgcgggaggugauauaugggugacccgcgagcccuacgucucuugugacccugauaagugcuaucaguucgcucugggccaggggacgacucuuaacaauggacauucgaacaauaccgugcacgaccgaacaccauaccguacucuguugaugaacgaacucggcguucccuuucaucuggguaccagacagguguguauugccuggucaagcaguuccugccacgaugggaaggcauggcugcaugucuguaucacaggagacgauaaaaaugccaccgcuucuuucauuuauaacggcaggcucguggacagcaucggcuccuggucaaagaaaaucuuacggacgcaagagagugaaugcguauguauuaacgggacuugcacaguugugaugaccgauggaagcgcaucugguaaggccgacacuaaaauacuguuuaucgaggagggcaagauuguccacaucuccacacuuucagggagcgcucagcacguggaagagugcaguuguuacccucgcuauccaggagugagaugcgucuguagggauaauuggaagggcucuaaccggccgauaguugacauuaaugugaaagauuacuccaucguaagcucguacgugugcucugguuuggucggggacacuccccgcaagaacgacuccuucucaaguagccauugucuggauccuaauaacgaagagggaggccacggcgugaaagggugggccuuugacgauggaaaugacguuuggaugggucgaacgaucuccgaaaagcuaagaucuggcuaugagaccuucaaagugauugagggguggagcaagccaaacucaaaacuccagaucaauaggcaggucauuguggaacggggaagucguuccggcuacagcgguauauuuucuguagaggggaagucaugcaucaaccgcuguuucuauguugaacugauuagaggcaggaaggaggaaacaaaagugugguggaccaguaauagcaucgucguguuuugcggaaccuccggcacauacgggacuggaucuuggcccgauggugcggacaucaaccuuaugccuauuuga

SEQ ID NO: 136578 - RNA, 1410 nt, Artificial Sequence
  derived and/or modified sequence opt3 from neuraminidase__InfluenzaA__ABB86906
augaacaccaaucagagaaucauuacaauaggcacugugugccugaucgucgggauuaucagccuccuucugcaaauuggaaacaucguuuccuuguggauaucucacucaauccagacggguggcaagaaucauagugagauguguaaccagaaugugauuaccuacguaaacaauacaugggugaacaggacuuaugucaauaucagcaacaccaauauugccacagugcaggacguuaccuccgugaucuuagcugggaacucuucgcugugcucagucagcggaugggcaauauacaguaaagauaauuccauucggaucggcucuaagggugacauuuucgugauccgcgaacccuuuaucagcuguucccaccuagagugccgaacuuucuuucucacacaaggggcccugcuuaacgauaaacauucaaauggaaccguaaaggaccguaguccuuauagaacgcugaugagcuguccaauuggcgaagcgccgucucccuacaacuccagguucgagucaguugcuuggagcgccagugcaugccacgauggcauggggugguugacuauaggaaucucugguccugacaacggcgccguggcuguccucaaauauaaugggauuaucaccgauacaauaaaguccuggcggaacaagauucugcgcacucaggaaagcgagugugugugcaugaauggaucguguuuuaccgugcugacagacggcccaucuaacggucaggcauccuacgagaucuucaaagucgaaaaggggaaaaucauuaagucaaucgagcucgaugcccccaauuaucauuacgaagagugcaguuguuacccugacaccggaaaaguuaugugcgugugcagagauaacuggcacgcuagcaauaggccauggguauccuuugaccagaacuuaaauuaucaaauuggcuacauauguucuggcguguucggggauaacccccggagcaaugacggaaaggguaacugcggcccuguccugucaaauggggccaacggagugaagggcuuuaguuuccgcuaugguaaugggguuuggaucggccgaacgaaauccauuagcucuagaucaggauuugagauggugugggacccaaacggcuggacugggacagauaguagguucagcaugaagcaggacaucaucgcgcuuaccgauugguccggauacucugguucguuuguccagcacccggaauugacuggcaugaacuguauucggcccugcuucuggguggagcugauacgugggcagccuaaagaaagcacaaucugggcauccggaucaaguauuucuuucuguggcguaaauagcgagaccgccuccuggucauggccagacggugcugaucuacccuuuacgaucgacaaguga

SEQ ID NO: 136579 - RNA, 1410 nt, Artificial Sequence
  derived and/or modified sequence opt3 from neuraminidase__InfluenzaA__ABB86916
augaaccccaaucagaagaucauuaccauaggcagcgugucccugacaaucgccacuauuugcuuccucacgcaaaucgcuauucuugucaccacaguuacucugcacuuuaaacaguacgaguguaacucuccuccaaauaaccaggugauguugugcgaaccgaccaucauagagagaaauaucacagaaauuguauauuuaaccaacacuacaaucgagaaggaaauuugucccaaacuggcagaguacaggaauuggucaaagccucagugcaacaucaccggguucgccccauuuaguaaagacaauagcauacggcuauccgcgggaggugauauuugggugacgcgcgagcccuaugucucuugugacccugauaagugcuaccaauucgcucucggccaggggacuacccugaacaauggacauucgaacgacacagugcacgaucgaacuccauaucguacccuucugaugaaugaauugggcguucccuuucaucucgguacaaaacagguguguaucgccuggucaagcaguuccugccacgacgggaaggcauggcugcaugucuguauuaccggagaugacaagaacgccacggcuucuuucaucuacaauggcagacugguggauagcaucuccucauggaguaaaaagauucucaggacucaggagagcgaaugcguauguauaaacggcacaugcaccguugugaugacugacgggucugcauccggaaaagccgauacaaagaucuuauuuauugaggaggguaagaucguccacaccucacugcuuagcggcagugcucaacacguggaagagugcucuuguuauccucgguacccaggggugcgcugcgucuguagagacaacuggaaaggauccaauaggccgauaguugauauuaacgugaaggacuacagcaucguaucgucuuaugugugcuccggcuuggucggugacacgccccggaaaaaugauucaaguagcuccucucauugucuggacccuaacaaugaagaagggggacacggcgugaagggcugggccuucgaugacgggaacgauguuuggaugggacgcaccaucagcgagaaacuacgaucagguuacgagacauuuaaggugauugagggcuggaguaaaccaaauuccaagcuccagaucaacagacaggucauuguggacagggauaaucggagcggguauucuggaauauucucaguagaaggcaagaguugcaucaaccguuguuuuuacguugagcugauucgcgguagaaaucaggaaacugaggugcuuuggaccagcaacuccaucgucguguucugcgggacaucuggcacuuauggaaccggcucguggcccgacggggcggauaucaaucugaugccuauuuga

SEQ ID NO: 136580 - RNA, 1410 nt, Artificial Sequence
  derived and/or modified sequence opt3 from neuraminidase__InfluenzaA__ABB86928
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucuguauuacaggagaugacaaaaacgccaccgcuucuuucaucuacaauggcaggcugguggauagcaucggcuccuggucaaagaaaauucuccggacgcaggagagugaaugcguauguauaaacgggacuugcacaguugugaugaccgacggaagcgcaucugguaaggccgauacuaaaaucuuauuuauugaggagggcaagaucguccacauauccacacugucagggagcgcucaacacguggaagagugcaguuguuauccucgcuacccaggagugagaugcgucuguagggacaacuggaagggcucuaaucggccgauuguugauaucaacgugaaagacuacuccaucguaagcucguaugugugcucuggucuugucggggacacgccccgcaagaaugauuccuucucaaguagccauuguuugaacccuaauaacgaagagggaggccacggcgugaaagggugggccuuugacgauggaaaugacguuuggaugggucgaaccauuuccgaaaagcugagaucuggcuacgagaccuucaaagugaucgagggguggagcaagccaaacucaaaacuacagauuaauaggcaggucauaguggaacggggaaaccguaguggcuauuccgguaucuuuagcauugaggggaagucuugcaucaaucgcuguuucuacguagaacucaucagaggcaggaaggaggaaacaaaaguuugguggacuucaaacaguauuguggucuuuugcggaaccagcggcacauaugggacuggauccuggcccgauggugcggacauaaaucugaugccuaucuga

SEQ ID NO: 136581 - RNA, 1410 nt, Artificial Sequence
  derived and/or modified sequence opt3 from neuraminidase__InfluenzaA__ABB86936
augaacaccaaucagagaaucauuacaauaggcacugugugccugaucgucgggauuaucagccuccuucugcaaauuggaaacaucguuuccuuguggauaaaucacucuauccagacggaggguaagaaccauucagaaauguguaaucagaacgugauuaccuacguaaauaacacaugggugaauaggacuuaugucaacaucaguaauaccaacauugccacagugcaggacguuaccagcgugaucuuagcuggcaauuccucucugugccccgucucggggugggcaauauacucaaaagauaacagcauucggaucggaaguaagggcgacauuuucgugauccgcgagccuuuuaucuccuguucucaccuagaaugccgaacuuucuuucucacacaaggugcccugcuuaaugauaaacauagcaacgggaccguacgugacagauccccauauaggacgcugaugucauguccgacuggagaggcgcccaguccuuacaacagccgguucgaaucuguugcuugguccgccucagcaugccacgauggcaugggcugguugaccauugggauaagcggaccagacaauggugccguggcuguccucaaguauaacggcaucauuacagauacuaucaaaaguuggcgcaauaagauacugagaacccaggagucugagugugugugcaugaacggguccuguuuuacagugcugaccgacggacccagcaauggccaggcaucguacaagauuuucaaagucgaaaaggguaaaaucaucaagucuauugagcucgaugccccuaacuaucauuacgaagagugcuccuguuacccagacacggggaaaguuaugugcgugugcagggauaauuggcacgcuucaaaccggcccuggaucuauuuugaccagaauuuagauuaccaaauuggauauauauguaguggcguauucggcgacaacccucgcagcaaugacgggaagggaaacugcgguccagugcuguccaauggcgccaacggggucaagggauuuucuuuccgauacggcaaugguguguggaucgggagaacuaaaagcauuaacucaaggaguggcuuugagaugaucugggauccgaacggauggacaggcaccgacuccagcuucucuaugaagcaggauauccuugcgacuacagacuggucaggguauagugguagcuuuguucagcaccccgaauugaccggaaugaauuguauucggccuugcuucuggguggagcugauacguggccagccaaaagaauccacgaucugggcaucugggucgagcauuuccuucuguggagucaacucagagaccgccaauuggaguuggcccgauggcgcugaccuaccuuuuacaaucgauaaguga

SEQ ID NO: 136582 - RNA, 1410 nt, Artificial Sequence
  derived and/or modified sequence opt3 from neuraminidase__InfluenzaA__ABB86947
augaacaccaaucagagaaucauuacaauaggcacugugugccugaucgucgggauuaucagccuccuuucccaaauuggaaacaucguuucucuguggauaauccacucaauucagacggguggcaagaaucauagugagauguguaaccagaaugugaucaccuacguaaacaauacaugggugaacaggacuuauauuaauaucagcaacaccaauauagccacagucaaagacgugaccuccguuauuuuggcugggaacucuucguuaugccccgugucaggaugggcaaucuacagcaaggauaauaguauucggaucggcuccaaaggugacaucuucgucauucgcgaaccuuuuauaucuuguagccaccuggagugccgaacuuucuuucuaacacagggggcccuccugaacgauaagcauuccaauggaaccgugaaagaccguucaccauauagaacgcuuaugaguuguccgaucggcgaagcgcccagcccuuacaacucuagguucgaguccguagcuuggucagccagcgcaugccacgauggcaugggguggcugacuauuggaaucagugguccagacaacggcgccguugcuguguugaaguauaaugggauaauuaccgauacaaucaagucuuggcggaacaaaauccuccgcacucaagaauccgagugugucugcaugaauggaagcuguuuuaccgugcugacagacggccccucgaacggucaggcaucuuacaagauuuucaaaguggagaaggggaaaaucauuaaguccauagaacuggaugccccuaauuaucauuacgaggaaugcucauguuacccagacgcuggaaaggucaugugcguuugcagagauaacuggcacgccaguaauaggcccugggugagcuuugaccagaaccucgauuaucagaugggcuacaucuguuccggcguauucggggacaauccucggucuaacgacggaaaagguaauugcggcccaguguuaagcaacggggcgaauggagucaagggcuuuucauuccgcuaugguaacgggguguggauuggccgaaccaaaaguaucaauuccagaagcggauuugagaugaucugggauccgaacggcuggacggggacugacucuucauucaguaugaagcaagauauuauagcacugacagacuggagcggauacuccgguucuuuuguucagcaccccgagcuuaccggcaugaacuguaucaggccuugcuucuggguggaauugauucgggggcagccaaaagagucgacuaucugggccagcggauccucaauuaguuucuguggcgucaauucugaaacagcuagcugguccuggcccgauggugccgaccugccuuuuaccaucgauaaguga

SEQ ID NO: 136583 - RNA, 1410 nt, Artificial Sequence
  derived and/or modified sequence opt3 from neuraminidase__InfluenzaA__ABB86957
augaacaccaaucagagaaucauuacagugggcacugucugccugauaguugggaucgugagccuccuucugcaaauuggaaacaucguauccuuguggauuucucacucaauccagacgggugagaagaaucauagugaaguguguaaccagaauauaaucaccuacgagaacaaaacaugggucaaucagacuuaugugaacauuagcaauaccaacaucgccgaaggccaagggguuacauccauuaucauggcuggaaauucuucguuaugccccgugucaggcugggcaauauacagcaaggacaacaguauuaggaucgguuccaaaggggauauuuucgucauccgggagccuuuuaucucuuguagccaccuggaaugccgcaccuucuuucuaacucagggagcccuccugaaugaccgacauuccaacggcacagugaaggaucguucaccauauagaacccuuaugaguuguccgauuggcgaggcgcccagcccuuacaauucuagguucgaguccguagcuuggucagccagcgcaugccacgacgggaugggauggcugacgauagguaucaguggcucugauaacgaagccguugcuguguugaaauauaacgggauuaucacugacaccauaaaguccuggcggaauaagauucuccgcacacaggagagcgaaugugucugcaucaacggaucguguuuuacuaucaugaccgauggcccaucuaauggucaggcauccuacaaaauuuucaagauggagaaagggaagaucauuaaaucaguggagcuggaagcccccaacuaucauuacgaggaaugcaguuguuacccugacacaggaaagguggucugcguuugcagagauaauuggcacgcuagcaacaggccauggguguccuuuaaucaaaaccuggacuaucagauaggcuacaucuguucuggcguauucggggauaauccccggagcaacgacggaaaggguaauugcggcccugugccaucaaacggggccaauggagucaaaggcuuuaguuuccgcuaugguaacgggguguggauuggccgaaccaaguccaucuuuagcagaucuggauucgagaugaucugggauccgaauggcuggacggaaacugacucaaguuuuagcauuaaacaggacauaaucgcgcucacagauugguccggguacucuggaucguucguucagcaccccgaguuaaccgguaugaacuguauuaggccuugcuucuggguggagcugauccggggccaaccaaaggaaagcacuauuuggacauccgggucaaguaucucuuuuuguggagucgacagcgagaccgcauccuggucauggcccgauggcgccgaccuuccuuucacgauagauaaauga

SEQ ID NO: 136584 - RNA, 1410 nt, Artificial Sequence
  derived and/or modified sequence opt3 from neuraminidase__InfluenzaA__ABB96333
augaaccccaaucagaagaucauuaccauaggcagcgugucccugacaaucgccacuauuugcuuccucaugcaaaucgcuauucuugucacgaccguuacacugcacuuuaaacaguacgacugugauucuccugcaaacaaucaggugaugccaugcgagccgaucauaaucgaaagaaacauuacugagaucguauauuugaccaauacaaccauugaaaaggagaucugucccaaauuaguggaauacaggaacuggucaaagccucagugcaaaauaacuggguucgccccauuuaguaaggacaauagcauucggcuguccgcgggaggugauaucugggucacacgcgagcccuaugugucuugugacccuggcaagugcuaccaauucgcucuagggcagggaaccacgcucgauaacaaacauucgaaugacacuauucacgaucgaaccccacaucguacacugcuuaugaacgagcugggcguucccuuucacuuggguacuagacagguguguaucgccuggucaagcaguuccugccaugacgggaaggcauggcuccacgucugugugaccggauaugauaaaaaugccacagcuucuuucaucuacgacggcaggcugguagauagcauuggcuccuggucaaagaacauacugcggacccaggaaagugagugcguuuguaucaaugggacgugcacuguggucaugacagacggaagcgcaucugaacgcgccgauaccaaaauucucuuuaucgaggaggguaagauagugcacauuuccccuuuaucaggcagcgcucaacauguggaagagugcaguuguuauccaagauacccgggggucaggugcguuugucgggacaacuggaagggaucuaaucgccccgugguagacaucaacgugaaagauuacuccaucgccagcucguaugucugcucuggccuggugggugacacuccucgaaagaacgauagauacuccucaaguuauuguaggaauccaaacaaugaaaaagggaaccacggaguuaagggcugggcguucgacgauggcaaugacguguggauggggcggacaauuagcgaugagucccguucuggauacgaaaccuuuaaagucaucgguggcuggagcacgcccaacucaaaacuucagauuaaucgccaggugauaguagacagugauaacagauccggguauagcggaaucuucucuguugagggcaagucaugcauuaauagguguuuuuacguggaguugauccggggucgagaacaggagacccgcgucugguggacaaguaacagcaucguggucuucugcgggacuuccggcaccuauggaacaggcucuuggccugacggggcagauauuaaucugaugccaauauga

SEQ ID NO: 136585 - RNA, 1410 nt, Artificial Sequence
  derived and/or modified sequence opt3 from neuraminidase__InfluenzaA__ABB96344
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggccgaugcuaccaauucgcucuagggcagggaaccacgcucgacaacaagcauucgaaugauacuauucacgaccguaccccacauagaacacugcuuaugaacgaacugggcguucccuuucacuuggguacuagacagguguguaucgccuggucaagcaguuccugccaugaugggaaagcauggcuccacgucugugugaccggauaugacaagaaugccacagcuucuuucaucuacgauggccggcugguagacagcauuggcuccuggaguaaaaacauacugcgcacccaggagucagaaugcguuuguaucaaugggacgugcacuguggucaugacagauggaagcgcaucugagagagccgacaccaaggugcucuuuauugaggaagguaaaaucgugcacauauccccuuuaucaggcagcgcucaacaugucgaggaaugcaguuguuauccaagguacccggggguucggugcgugugucgcgauaacuggaagggaucuaaucgacccguaguggacauuaacgucaaggacuacuccaucgccagcucguaugugugcucuggccugguuggugauacuccuaggaaaaacgacagguacuccucaaguuauugucggaauccaaacaaugagaaggggaaccacggagugaaaggcugggcguucgaugacggcaaugaugucuggauggggcguacaaucagcgacgaaucccgcucuggauacgagaccuuuaaggugauugguggcuggagcacgcccaacucaaaacuucagaucaauagacagguaauuguugauagugacaacagguccggguauagcggaauauucucuguggagggcaagucaugcaucaaucgguguuuuuacgucgaauugauucgaggucgcgagcaggaaaccagagugugguggacaaguaacagcaucgucguguucugcgggacuuccggcaccuauggaacaggcucuuggccugauggggcagacaucaaucugaugccaauuuga

SEQ ID NO: 136586 - RNA, 1410 nt, Artificial Sequence
  derived and/or modified sequence opt3 from neuraminidase__InfluenzaA__ABB96398
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaacuugucccaaauuaguggaguacaggaacuggucaaagccucagugcaaaaucacaggguucgccccauuuaguaaggauaauagcauacggcuguccgcgggaggugacauuugggucacccgcgagcccuaugugucuugugauccuggcaagugcuaccaauucgcucuagggcagggaacgacucucgacaacaaacauucgaaugauaccauccacgaccgaacaccauaucguacucugcuuaugaacgaacugggcguucccuuucauuuggguaccagacagguguguauugccuggucaagcaguuccugccacgaugggaaggcauggcuccaugucugugugacaggauacgacaaaaaugccaccgcuucuuucaucuaugauggcaggcugguagacagcaucggcuccuggucaaagaacauucugcggacgcaggagagugaaugcguuuguauaaaugggacuugcacaguggucaugaccgauggaagcgcaucugagcgcgccgacacuaaaauccucuuuauugaggaagguaagaucgugcacauauccccuuuaucaggcagcgcucaacacguggaggaaugcaguuguuacccaagauacccgggggucaggugcguuugucgggauaacuggaagggaucuaaucgccccgugguagacauuaacgugaaagacuauuccaucgccagcucguacgucugcucuggccuggugggugauacaccucgaaagaacgacagauccucaaguagcuauuguaggaauccaaacaaugagaaagggaaccauggaguuaagggcugggcguucgaugacggcaaugauguguggauggggcggaccaucuccgaagagucucguagcggauacgagacguuuaaagucauugguggcuggucaacccccaacaguaaacuucagaucaaucgccaggugauuguagacuccgauaacagaagcggguauucuggaauauucucaguugaaggcaagaguugcaucaauagguguuuuuacguggaguugauucggggucgagaacaggagacacgcgucugguggacuagcaacuccaucguggucuucugcgggaccucuggcacauauggaacuggcucguggccugacggggcagauaucaaucugaugccaauuuga

SEQ ID NO: 136587 - RNA, 1410 nt, Artificial Sequence; identical to SEQ ID NO: 136398
  derived and/or modified sequence opt3 from neuraminidase__InfluenzaA__ABB96490

SEQ ID NO: 136588 - RNA, 1410 nt, Artificial Sequence
  derived and/or modified sequence opt3 from neuraminidase__InfluenzaA__ABB96501
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaucaaagugcuaccaauucgcgcuaggccaggggaccacgcucgauaacaaacauagcaaugacacuauucacgaucgaacaccccaucguacccugcuuaugaacgaacugggaguuccuuuucacuugggcacuagacagguguguaucgcuuggaguuccucuagcugccaugacgguaaggccuggcuccacgucugugugaccggguaugauaaaaaugcaacagccuccuucaucuacgacggaaggcugguagauucaauuggcaguuggagcaagaacauacugcggacccaggagucugaaugcguuuguaucaauggcacgugcacuguggucaugacagacggguccgcuucagagcgcgcagauaccaaaauucucuuuaucgaggaaggaaagauagugcacauuagcccauuaagugguucugcccaacauguggaggaaugcuccuguuauccgagauaccccggcgucaggugcguuugucgggacaacuggaaggggagcaaucgcccugugguagauaucaacgugaaagacuacucgaucgucucuuccuaugugugcucaggacugguuggcgacacuccacgaaagaacgauagaaguagcuccucuuacuguaggaaucccaacaaugagaaagguaaccacggggugaagggaugggcuuucgacgauggcaaugacgucuggaugggccggacaauuagcgaagagucacguaguggguaugagaccuuuaaagugaucggagguugguccacgccuaacagcaagucucagauuaaucgccagguaauaguugauucaggcaacagaaguggguacagcggaaucuucuccguggaaggcaaaucuugcauuaauagguguuuuuaugucgagcuuauccggggucgagaacaggagacccgcgugugguggacaucgaacagcaucgucguguucugcgggacuuccggcaccuacggaacaggcucauggccagacggggccgauauuaauuugaugcccauauga

SEQ ID NO: 136589 - RNA, 1410 nt, Artificial Sequence
  derived and/or modified sequence opt3 from neuraminidase__InfluenzaA__ABB96534
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccugauaagugcuaccaauucgcucucggccaggggacgacucugaacaaucgacauucaaacgacaccgugcacgaucguacaccauauagaacucuucugaugaaugaauugggaguucccuuucaucucggcaccaaacagguguguaucgccuggagcaguuccucuugccacgacgguaaggcauggcugcaugucugugugacagggcacgaugagaacgccaccgcuagcuucauuuacgacggaaggcugguagauuccaucggcucauggaguaaaaagauccuccggacgcaggaaagcgagugcguuuguauuaauggcacuugcacaguggucaugaccgacgggucugcauccggacgcgccgauacuaaaauauuauuuaucgaggaagguaagauugugcacaucucaccucugagcggcagugcucaacauguggaggaaugcucuuguuauccaagauacccgggggucaggugcguuugucgggacaacuggaagggauccaaucgccccauaguggauauuaacguaaaagacuacagcaucgugucgucuuaugucugcuccggccuugugggugacacaccucgaaagaacgauucaaguagcuccucucacuguuugaauccaaacaaugaggaagggggacauggcguuaaaggcugggccuucgacgaugggaacgacguguggaugggaagaaccaucagcgagaaguuuaggucagguuacgagacguucaaagucauugaaggcuggaguaagcccaauuccaaacugcagaucaaccgucaggugauuguagaucgggggaaucgcagcggauauucuggcauauuuucaguugaggguaagaguugcaucaacagauguuucuacguggaacuaauuagggggcggaagcaggagaccgaagucugguggacaagcaauuccaucguggucuuuugcggcacuucuggaaccuauggcacagggucguggccugacggagcggauaucaaccucaugccaauuuga

SEQ ID NO: 136590 - RNA, 1410 nt, Artificial Sequence
  derived and/or modified sequence opt3 from neuraminidase__InfluenzaA__ABC02237
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccugauaagugcuaccaauucgcucucggccaggggacgacucugaacaaucgacauucaaacgacaccgugcacgaucguacaccauauagaacucuucugaugaaugaauugggaguucccuuucaucucggcaccaaacagguguguaucgccuggagcaguuccucuugccacgacgguaaggcauggcugcaugucugugugacagggcacgaugagaacgccaccgcuagcuucauuuacgacggaaggcugguagauuccaucggcucauggaguaaaaagauccuccggacgcaggaaagcgagugcguuuguauuaauggcacuugcacaguggucaugaccgacgggucugcauccggacgcgccgauacuaaaauauuauuuaucgaggaagguaagauugugcacaucucacaacugagcggcagugcucagcauguggaggaaugcucuuguuauccuagauacccaggggucaggugcguuugucgggacaacuggaagggauccaaucgcccgauaguggauauuaacaucaaagacuacagcaucguaucgucuuaugugugcuccggccuugucggugacacaccccgaaagaacgauucaaguagcuccucucacuguuugaauccuaacaaugaggaagggggacauggcgugaaaggcugggccuucgacgaugggaacgacguuuggaugggaagaaccauuagcgagaaguuuaggucagguuacgagacguucaaagugaucgaaggcuggaguaagccaaauuccaaacugcagauuaaccggcaggucauaguggaucgugggaaucgcagcggauauucuggcaucuuuucaguagaggguaagaguugcauuaacagauguuucuacguugaacuaaucagggggcggaagcaagagaccgaagugugguggacaagcaauuccaucgucgcguuuugcggcacuucuggaaccuauggcacagggucguggcccgacggagcagauauuaaccucaugccuauauga

SEQ ID NO: 136591 - RNA, 1410 nt, Artificial Sequence
  derived and/or modified sequence opt3 from neuraminidase__InfluenzaA__ABC02258
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucagaucaugccaugcgaaccgacuauaaucgagagaaacauuaccgaaaucguguauuugacaaauauuaccaucgagaaggaaauaugucccaaauuaguagaguacaggaacuggucaaagccucagugcaaaauuacuggguucgccccauuuaguaaggauaauagcauccggcuguccgcgggaggugacauuugggugacacgcgagcccuaugucucuugugauccuucgaagugcuaccaauucgcucuaggccaggggaccacgcucgacaacaaacauucaaaugauacuauccacgaccgaaccccacaucguacacugcuuaugaacgaacugggagugcccuuucacuugggcacuagacagguuuguaucgccuggagcaguuccucuugccaugaugguaaggcauggcuccacgugugugucaccggguaugacaaaaaugccacagcuagcuucauuuacgauggaaggcugguggacuccauaggcucauggagucagaacauccugcggacccaagagagcgaaugcguauguauuaauggcacgugcacuguugugaugacagaugggucugcauccggacgcgccgacaccaagauccucuuuauagaggaggguaaaauuguccacaucucaccuuuaagcggcagugcucagcauguggaagagugcucuuguuauccaagauacccgggggugaggugcaucugucgggauaacuggaagggauccaaucgccccgucguugacauuaacgugaaggacuacagcaucgauucgucuuauguaugcuccggccuggugggugacacuccucgaaagaacgauagaucaaguaauagcuacuguaggaacccaaauaacgaaaaagggaaucacggagucaaaggcugggccuucgacgauggcaacgacguguggauggggcggacaauuuccgaggauucucguagcggauaugaaaccuuuaagguuauagguggcuggucaacgcccaauaguaaacuucagaucaaccgccaggugauugucgacuccgauaauagaagcggguacucuggaaucuucucaguggagggcaagaguugcaucaacagguguuuuuauguagaguugauucggggucgagaacaagagacccgcguuugguggacaagcaauuccauaguggucuucugcgggacuucuggcaccuacggagcgggcucguggccugacggggcagauaucaaccugaugccaauuuga

SEQ ID NO: 136592 - RNA, 1410 nt, Artificial Sequence
  derived and/or modified sequence opt3 from neuraminidase__InfluenzaA__ABC02269
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaagcgcaucuggucgcgccgacaccaagauucucuuuaucgaggagggcaaaauagugcacacuuccccuuuaucagggagcgcucagcauguggaagagugcaguuguuauccaagauacccgggagucaggugcauuugucgggauaacuggaagggcucuaaucgccccguuguggacaucaacguaaaggacuacuccaucgauagcucguaugugugcucuggucuggucggggacacaccucgaaacaaugauagauccucaaguagcuacuguaggaacccaaauaacgaaaaaggaacccacggcgugaagggcugggccuucgacgaugggaaugacguuuggaugggacggacgauuuccgaggauucucguagcgguuaugaaaccuuuaaagugaucggcggguggucaacacccaacaguaaacuucagauuaaucgccaggucauaguggacuccgauaacagaagcggauacucuggcaucuucucaguagaggguaagaguugcauuaauagguguuuuuauguugaguugauccgggggcgagaacaagagacucgcgugugguggaccagcaacuccaucgucguguucugcggcacaucuggaacuuacggcaccgggucguggccugacggagcggauauuaaucugaugccaauauga

SEQ ID NO: 136593 - RNA, 1413 nt, Artificial Sequence
  derived and/or modified sequence opt3 from neuraminidase__InfluenzaA__ABC02280
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggaagucugcuaaaugauaaacacagcaacggcaccgugaaggaccgaucuccauaucgugcucucauguccugcccgcugggcgaagcccccucaccuuacaauagcaaguucgagaguguugcauggucugccuccgcuugucaugaugggaugggauggcuuacgauugguaucagcggcccagacaacggggcaguggccguccugaaauauaacggaauaauuacugaaaccaucaagucguggaaaaagcagaucuugagaacacaggagucugagugcguguguguaaauggcuccugcuuuacuauuaugaccgauggucccucaaacggggcugccaguuacaaaaucuucaagauugaaaagggaaaaguuacaaagagcauagagcucaaugcgccuaacuuucacuaugaagaguguuccugcuacccagacaccggcacggugaugugugucugcagggauaauuggcacggcucuaaccggcccugggugagcuucaaucagaaccuggacuaccaaaucggguauauuugcucaggaguguuuggugauaauccucgcccaaaagacggcgaggggaguuguaacccggucacuguugauggagcaaauggcgugaaggguuucuccuacaaauaugggaacggcguauggaucggaagaacaaagagcaauaggcugcggaaaggcuuugaaaugaucugggaccccaacggguggaccgacacugauucugacuucucagugaagcaggaugucguggccauuacagacuggaguggauacagcgguuccuuuguucagcauccugagcucaccggcuuagauugcauacgcccauguuucuggguggaacugguccgagggcuucccaaggagaauacgaccaucuggacaucuggaucgagcauuuccuucugcggcgugaacucagacacugcuaacuggaguuggccugauggugccgaauugccauuuaccaucgacaaauga

SEQ ID NO: 136594 - RNA, 1410 nt, Artificial Sequence; identical to SEQ ID NO: 136589
  derived and/or modified sequence opt3 from neuraminidase__InfluenzaA__ABC02302

SEQ ID NO: 136595 - RNA, 1410 nt, Artificial Sequence; identical to SEQ ID NO: 136586
  derived and/or modified sequence opt3 from neuraminidase__InfluenzaA__ABC02313

SEQ ID NO: 136596 - RNA, 1410 nt, Artificial Sequence; identical to SEQ ID NO: 136591
  derived and/or modified sequence opt3 from neuraminidase__InfluenzaA__ABC02324

SEQ ID NO: 136597 - RNA, 1410 nt, Artificial Sequence
  derived and/or modified sequence opt3 from neuraminidase__InfluenzaA__ABC02335
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaagcgcaucuggucgcgccgacaccaagauucucuuuaucaaagagggcaagauagugcacauuuccccuuuaucagggagcgcucagcauguggaggaaugcaguuguuauccaagauacccgggagucaggugcaucugucgggauaacuggaagggcucuaaucgccccguuguggacaucaacguaaaagacuacuccauugauagcucguaugugugcucuggucuggucggggacacuccucgaaacaaugauagauccucaaacaguuacuguaggaauccaaacaaugagaagggaaaccacggcgugaaaggcugggccuucgacgaugggaaugacguuuggaugggacggacaaucagcgaagauucccguucugguuaugagaccuuuaaggugauuggcggguggagcacgcccaacucaaaacuucagauaaaucgccaggucaucguggacagugauaacagauccggauacagcggcauuuucucuguagaagguaagucaugcaucaauagguguuuuuauguugaguugauccgggggcgagagcaagaaacccgcgugugguggacaaguaacagcauugucguguucugcggcacuuccggaaccuacggcacagggucuuggccugacggagcggauauaaaucugaugccaaucuga

SEQ ID NO: 136598 - RNA, 1410 nt, Artificial Sequence
  derived and/or modified sequence opt3 from neuraminidase__InfluenzaA__ABC39808
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaucaaagugcuaccaauucgcgcuaggccaggggaccacgcucgauaacaaacauagcaaugacacuauucacgaucgaacaccccaucguacccugcuuaugaacgaacugggaguuccuuuucacuugggcacuagacagguguguaucgcuuggaguuccucuagcugccaugacgguaaggccuggcuccacgucugugugaccggguaugauaaaaaugcaacagccuccuucaucuacgacggaaggcugguagauucaauuggcaguuggagcaagaacauacugcggacccaggagucugaaugcguuuguaucaauggcacgugcacuguggucaugacagacggguccgcuucagagcgcgcagauaccaaaauucucuuuaucgaggaaggaaagauagugcacauuagcccauuaagugguucugcccaacauguggaggaaugcuccuguuauccgagauaccccggcgucaggugcguuugucgggacaacuggaaggggagcaaucgcccugugguagauaucaacgugaaagacuacucgaucgucucuuccuaugugugcucaggacugguuggcgacacuccacgaaagaacgauagaaguagcuccucuuacuguaggaaucccaacaaugagaaaggugaccacggggugaagggaugggcuuucgaugacggcaacgaugucuggaugggccggacaauuagcgaagagucacguaguggguaugagaccuuuaaagugaucggagguugguccacgccuaauagcaagucucagauuaaccgccagguaauaguugacucaggcaauagaaguggguacagcggaaucuucuccguggaaggcaaaucuugcauuaacagguguuuuuaugucgagcuuauccggggucgaaagcaggaaacccgcgugugguggacaucgaauagcaucgucguguucugcgggacuuccggcaccuacggaacaggcucauggccagauggggccgacauuaacuugaugcccauauga

SEQ ID NO: 136599 - RNA, 1410 nt, Artificial Sequence; identical to SEQ ID NO: 136398
  derived and/or modified sequence opt3 from neuraminidase__InfluenzaA__ABC40525

SEQ ID NO: 136600 - RNA, 1413 nt, Artificial Sequence
  derived and/or modified sequence opt3 from neuraminidase__InfluenzaA__ABC40536
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagcagaucuugagaacacaggagucggagugcguguguguaaauggcucuugcuuuacuauuaugaccgauggucccuccaacggggccgcgucauacaaaaucuucaagauugaaaagggaaaaguuauaaagaguaucgagcucaaugcaccuaacuuucacuaugaagaguguagcugcuacccagacacaggcaccgugaugugugucugcagggauaauuggcacggcuccaaccggcccugggugucuuucaaucagaaccuggacuaccaaauuggguauaucugcagcggaguguuuggugauaauccucgcccaaaagacggcgaggggucauguaacccggucacgguugauggagccaauggcgugaaggguuucaguuacaaauaugggaacggcguauggaucggaagaacuaaguccaauaggcugcggaaaggcuuugaaaugauuugggaccccaacggguggacagacaccgauagcgacuucucugugaagcaggaugucguggcuauaacugacuggucaggauacagugguagcuuuguucagcauccugagcucacaggcuuagauugcauccgcccauguuucuggguggaacugguccgagggcuucccaaggagaauaccacgauuuggaccuccggaucuucgaucagcuucugcggcgugaacuccgacacagccaacuggucauggccugauggugcagaauugccauuuacuauugacaaauga

SEQ ID NO: 136601 - RNA, 1410 nt, Artificial Sequence; identical to SEQ ID NO: 136592
  derived and/or modified sequence opt3 from neuraminidase__InfluenzaA__ABC40547

SEQ ID NO: 136602 - RNA, 1410 nt, Artificial Sequence
  derived and/or modified sequence opt3 from neuraminidase__InfluenzaA__ABC40558
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaggcaagugcuaccaauucgcgcuagggcagggaaccacgcucgauaacaaacauucaaaugacacuauucacgaucgaacccccuaucguacacugcuuaugaacgaacugggcguuccuuuucauuuggguacuagacagguguguaucgcuuggagcaguuccucuugccacgacgggaaggccuggcuccaugucugugugaccggacacgauaaaaaugcaacagccagcuucaucuacgacggcaggcugguagauuccauuggcucauggaguaagagcauacugcggacccaggagucugaaugcguuuguaucaacgggacgugcacuguggucaugacagacggauccgcuucagagcgcgcagauaccaaaauucucuuuaucgaggaagguaagauagugcacauuagcccauuaaguggcucugcccaacauguggaggaaugcuccuguuauccgagauaccccggggucaggugcguuugucgggacaauuggaagggaagcaaccgcccugugguagauaucaaugugaaagacuacucgaucgucucuuccuaugugugcucaggccugguuggugacacuccacgaaagaacgauagaaguagcuccucuuacugucagaaccccaauaacgagaaagggaaucacggagugaagggcugggcuuucgacgauggcaacgacgucuggauggggaggacaauuagcgaagagucacggaguggauaugagaccuuuaaagugaucgguggcugguccacgccuaauagcaaacuucagauuaaccgucagguaauaguugauaucgacaaucgcucuggguacucaggaauuuucaguguggaaggcaagagcugcaucaacagauguuuuuaugucgaguugaucaggggucgggaacaagagacccgagugugguggacauccaauucuauugucguguucugcgggacuucgggcaccuacggaacaggcagcuggccagauggggccgacauaaaccugaugcccaucuga

SEQ ID NO: 136603 - RNA, 1410 nt, Artificial Sequence
  derived and/or modified sequence opt3 from neuraminidase__InfluenzaA__ABC40611
augaaccccaaucagaagaucauuaccauaggcagcaucucccugacaauugccacuaucugcuuccucaugcaaauugcuauccuugugacgaccgucacacugcacuuuaaacaguacgaguguaacucuuugccuaauaaccagguuauguuaugcgaaccaacuauaaucgagagaaauauuaccgaaaucguguaucugacaaacaccacuauugagaaggaaaucuguccgaaacuagcagaguacaggaauuggucaaagccccagugcaaaauaacaggguucgccccuuuuaguaaggacaacagcauucggcucuccgcgggaggugauaucuggguaacccgcgagccauaugugucuugugaccccgauaagugcuaccaauucgcucugggccaggggacgacucuuaauaaccgacauucgaaugacaccguccacgaucguacaccuuauagaacucuguugaugaacgaacucggagugccauuucaucugggcaccaaacagguuuguauugccuggucaagcaguuccugccacgacgguaaggcauggcugcaugugugugucacagggcacgaugagaaugccaccgcuucuuucaucuacgacggaaggcucguggauagcaucggcuccuggaguaaaaagauuuuacggacgcaggaaucagagugcguauguauaaacggcacuugcacaguugugaugaccgacgggagcgcaucuggacgcgccgauacuaaaauccuguuuauugaggaagguaagaucauacacauuucccaacuuucaggcagcgcucagcaugucgaggaaugcaguuguuaucccagauacccuggggugaggugcgugugucgggacaauuggaagggaucuaaccgcccaaucgucgauaucaacguuaaagacuacuccauugugagcucguauguaugcucuggcuuggugggugacacaccgcgaaagaaugauuccucaaguagcucccacugucugaaccccaauaacgaggaagggggacauggcgucaaaggcugggccuucgacgaugggaaugacguguggaugggaagaaccaucucugagaaguuuaggagcgguuacgagacguucaaaguuauugaaggcuggucaaagccuaacaguaaacuacagauaaaucgucaggugaucgucgaucgggacaaccgcuccggguauagcggaaucuuuucuguggagggcaagucaugcauuaauagauguuucuacguagaacucaucaggggucggaagcaagagaccgaaguuugguggacaaguaacagcauuguggucuuuugcgggacuuccggcaccuauggaacaggcucuuggccagauggggcggacauaaaucugaugcccaucuga

SEQ ID NO: 136604 - RNA, 1410 nt, Artificial Sequence
  derived and/or modified sequence opt3 from neuraminidase__InfluenzaA__ABC40622
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaaacgcaagcggucgcgccgacaccaagauucucuuuaucgaggagggcaaaauagugcacauuucuccuuuauccgggucagcucagcauguggaagagugcagcuguuauccaagauacccgggagucaggugcaucugucgggauaauuggaagggcaguaaccgccccguuguggacaucaacguaaaggacuacucuauugauuccagcuaugugugcucgggucuggucggggacacuccucgaaauaacgauagaucuuccaauucauacuguaggaacccaaauaacgaaaaaggaaaucacggcgugaagggcugggccuucgacgaugggaacgacguuuggaugggacggacaaucagugaggauagccguuccgguuaugaaaccuuuaaagugauuggcggguggucuacgcccaauagcaaacuucagauaaaccgccaggucaucguggacucagauaauagaaguggauacuccggcauuuucagcguagaggguaagucuugcaucaacagguguuuuuauguugaguugauccgggggcgagaacaagagacccgcgugugguggacaucaaauaguauugucguguucugcggcacuagcggaaccuacggcacaggguccuggccugacggagcggauauaaaccugaugccaaucuga

SEQ ID NO: 136605 - RNA, 1410 nt, Artificial Sequence
  derived and/or modified sequence opt3 from neuraminidase__InfluenzaA__ABC40634
augaaccccaaucagaagaucauuaccauaggcagcgugucccugacaaucgccacuauuugcuuccucacgcaaaucgcuauucuugucaccacaguuacucugcacuuuaaacaguacgaguguaacucuccuccaaauaaccaggugauguugugcgaaccgaccaucauagagagaaauaucacagaaauuguauauuuaaccaacacuacaaucgagaaggaaauuugucccaaacuggcagaguacaggaauuggucaaagccucagugcaacaucaccggguucgccccauuuaguaaagacaauagcauacggcuauccgcgggaggugauauuugggugacgcgcgagcccuaugucucuugugacccugauaagugcuaccaauucgcucucggccaggggacuacccugaacaauggacauucgaacgacacagugcacgaucgaacuccauaucguacccuucugaugaaugaauugggcguucccuuucaucucgguacaaaacagguguguaucgccuggucaagcaguuccugccacgacgggaaagcauggcugcaugucugugugaccggagaugacaagaacgccacggcuucuuucauuuacaauggcagacugguagauagcaucggcuccuggucaaagaagauccucaggacucaggagagugaaugcguuuguauugacgggacaugcaccguggucaugacugauggaagcgcaucugguaaagccgacacaaagauauuauuuaucgaggagggcaagauugugcacaccucccugcuuucagggagcgcucaacacguggaagagugcaguuguuauccucgguacccaggaguccgcugcguuuguagagauaacuggaaaggcucuaacaggccgaucguggacauaaauguaaaggacuacuccauugugagcucguaugucugcucugguuuggugggggauacgccccggaaaaacgacuccucaaguagcucccauugucuggauccuaauaacgaagagggaggccacggcguuaaggggugggccuucgacgauggaaaugacguguggaugggucgcaccaucucugaaaaacuacgaagcggcuacgagacauuuaaggucaucgagggguggucaaaaccaaacaguaagcuccagauuaauagacaggugaucguagauaggggaaaccgguccggcuauagcgguauuuucucuguugaagggaagucaugcauaaaucguuguuuuuacguggagcugauccgcggcagaaaccaggaaacugagguccuuuggaccaguaauagcauuguggucuucugcggaacauccggcacuuaugggaccggaucuuggcccgacggugcggauaucaaccugaugccuaucuga

SEQ ID NO: 136606 - RNA, 1410 nt, Artificial Sequence
  derived and/or modified sequence opt3 from neuraminidase__InfluenzaA__ABC40645
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccguugugucauggaguaagaaaauccugaggacgcaggaaagcgagugugucugcauuaacggcacuuguacaguggugaugaccgacggcucugcuuccgggaaggcagauacuaaaauacucuuuaucgaggaaggaaagauuguccacacaucaaccuuaagcgguagugcccaacacguugaggaaugcucuugcuauccucgguacccaggcgugcgcuguguaugcagagacaacuggaagggguccaauaggccgaucguggauauaaacauuaaagacuacagcaucgucucgucuuauguguguuccggacugguuggcgacacgccccggaagaaugauucaaguagcuccucucauugccuugacccuaacaaugaggaaggugggcacggagugaaaggcugggcuuucgaugacggcaacgaugucuggauggggcgcaccaucagcgagaaguugcgaucaggauacgagacauuuaaagugauugaagguuggaguaauccaaacuccaagcugcagaucaauagacagguaauuguugacaggggcaaccggagcggguauucuggaauauucucaguggagggcaaaaguuguaucaaucguugcuuuuacgucgaacuaauucgcgguagaaagcaggagacugaagugcucuggaccagcaacuccaucgucguguucugugggacaucuggcacuuauggaaccggcucguggcccgauggggccgacaucaaucugaugccuauuuga

SEQ ID NO: 136607 - RNA, 1410 nt, Artificial Sequence
  derived and/or modified sequence opt3 from neuraminidase__InfluenzaA__ABC41706
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacugguggaguauaggaauuggucaaagccucagugcaacaucacaggguucgcaccauuuaguaaagacaauagcauacggcuauccgccggaggugauauuugggucacccgcgagcccuacgugucuugugacccugauaagugcuaucaauucgcgcucggccaggggacgacucugaacaauggacacucgaacgacaccguucaugaucgaacaccauaccguacucuucugaugaaugaauugggcgugcccuuucaccucgguaccagacaggucuguaucgcuuggucaagcaguuccugccaugacgggaaggccuggcugcacguguguguaacaggagaugacaaaaacgcaaccgccucuuucauuuauaauggcaggcugguugauagcaucggcuccuggucaaagaaaauccuccggacgcaggagagugaaugcguguguauuaacgggacuugcacagucgugaugaccgacggaagcgcuucugguaaggcagauacuaaaauauuauuuaucgaggagggcaagauugugcacaucuccacacugucagggagcgcccaacaugucgaagagugcaguuguuacccucgcuauccaggaguuagaugcguguguagggacaacuggaagggcucuaaucggccgauaguagauauuaacgugaaagacuacuccaucgucagcucguacgugugcucuggucuuguuggggacacgccccgcaagaaugauuccuucucaaguagccacuguuuggacccuaacaaugaagagggaggccauggcgugaaagggugggcuuuugaugacggaaacgaugucuggaugggucgaaccaucuccgaaaagcugagaucuggcuaugagaccuucaaagugauugagggguggagcaagccaaauucaaaacuacagaucaacaggcagguaauuguugaacggggaaaucguaguggcuacuccgguauauuuagcguggaggggaagucuugcaucaaccgcuguuucuaugucgaacucauuagaggcaggaaggaggaaacagaggugugguggacuucaaauaguaucgucguguuuugcggaaccagcggcacauacgggacuggauccuggcccgacggugccgauaucaaccugaugccuauuuga

SEQ ID NO: 136608 - RNA, 1413 nt, Artificial Sequence
  derived and/or modified sequence opt3 from neuraminidase__InfluenzaA__ABC41717
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcaaggggucauguaacccggucacuguugauggagccgacggcgugaaagguuucaguuacaaguaugggaauggcguauggaucggaaggacaaaauccaaccggcugcgcaagggcuuugagaugaucugggaccccaauggguggaccgauacugacagcgauuucucugugaagcaagacgucguggcuguuacagauuggucaggauacagugguagcuuugugcagcauccugaacucaccggcuuagacugcauucgaccauguuucugggucgagcuggugagagggcuucccagggaaaacacgaccauauggacauccggaucuucgaucagcuucugcggcguagauuccgacacugccaauuggucauggccugauggugcagaguugccauuuaccauugacaaauga

SEQ ID NO: 136609 - RNA, 1410 nt, Artificial Sequence
  derived and/or modified sequence opt3 from neuraminidase__InfluenzaA__ABC41728
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacugguggaguauaggaauuggucaaagccucagugcaacaucacaggguucgcaccauuuaguaaagacaauagcauacggcuauccgccggaggugauauuugggucacccgcgagcccuacgugucuugugacccugauaagugcuaucaauucgcgcucggccaggggacgacucugaacaauggacacucgaacgacaccguucaugaucgaacaccauaccguacucuucugaugaaugaauugggcgugcccuuucaccucgguaccagacaggucuguaucgcuuggucaagcaguuccugccaugacgggaaggccuggcugcacguguguguaacaggagaugacaaaaacgcaaccgccucuuucauuuauaauggcaggcugguugauagcaucggcuccuggucaaagaacauccuccggacgcaggagagugaaugcguguguauuaacgggacuugcacagucgugaugaccgacggaagcgcuucugguaaagcagauacuaagauauuauuuaucgaggagggcaaaauugugcacaucuccacacugucagggagcgcccaacaugucgaagagugcaguuguuacccucgcuauccaggaguuagaugcguguguagggacaauuggaagggcucuaaccggccgauaguagauauuaaugugaaggacuacuccaucgucagcucguacgugugcucuggucuuguuggggacacgccccgcaaaaacgauuccuucucaaguagccacuguuuggacccuaauaacgaagagggaggccauggcgugaaggggugggcuuuugaugacggaaaugaugucuggaugggucgaaccaucuccgaaaaacugagaucuggcuaugagaccuucaaggugauugagggguggagcaaaccaaacucaaagcuacagaucaauaggcagguaauuguugaacggggaaaccguaguggcuacuccgguauauuuagcguggaggggaaaucuugcaucaaucgcuguuucuaugucgaacucauuagaggcaggaaggaggaaacagaggugugguggacuucaaacaguaucgucguguuuugcggaaccagcggcacauacgggacuggauccuggcccgacggugccgauaucaaucugaugccuauuuga

SEQ ID NO: 136610 - RNA, 1410 nt, Artificial Sequence; identical to SEQ ID NO: 136607
  derived and/or modified sequence opt3 from neuraminidase__InfluenzaA__ABC41742

SEQ ID NO: 136611 - RNA, 1410 nt, Artificial Sequence; identical to SEQ ID NO: 136607
  derived and/or modified sequence opt3 from neuraminidase__InfluenzaA__ABC41956

SEQ ID NO: 136612 - RNA, 1410 nt, Artificial Sequence; identical to SEQ ID NO: 136607
  derived and/or modified sequence opt3 from neuraminidase__InfluenzaA__ABC41967

SEQ ID NO: 136613 - RNA, 1410 nt, Artificial Sequence; identical to SEQ ID NO: 136607
  derived and/or modified sequence opt3 from neuraminidase__InfluenzaA__ABC42017

SEQ ID NO: 136614 - RNA, 1410 nt, Artificial Sequence; identical to SEQ ID NO: 136607
  derived and/or modified sequence opt3 from neuraminidase__InfluenzaA__ABC42117

SEQ ID NO: 136615 - RNA, 1410 nt, Artificial Sequence; identical to SEQ ID NO: 136607
  derived and/or modified sequence opt3 from neuraminidase__InfluenzaA__ABC42128

SEQ ID NO: 136616 - RNA, 1410 nt, Artificial Sequence; identical to SEQ ID NO: 136607
  derived and/or modified sequence opt3 from neuraminidase__InfluenzaA__ABC42139

SEQ ID NO: 136617 - RNA, 1410 nt, Artificial Sequence
  derived and/or modified sequence opt3 from neuraminidase__InfluenzaA__ABC42150
augaaccccaaucagaagaucauuaccauaggcagcgugucccugacaaucgccacuauuugcuuccucaugcaaaucgcuauucuugcaacgaccgucacacugcacuuuaaacagcaugaguguaacucuccuccaaauaaccagguuauguugugcgaaccgacuaucauagagagaaauaucaccgaaauuguguacuuaacaaacaccacuaucgagaaggaaauuugucccaaacugguagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacaaaaacgccaccgcuucuuucauuuauaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauugugcacaucuccacacugucagggagcgcucaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacccccaggaagaaugauuccuucucaaguagccacuguuuggacccuaacaaugaagagggaggccauggcguuaaagggugggccuuugaugacggaaacgauguguggaugggucgaacgaucuccggcaagcugagaucuggguaugaaaccuucaaagucauugagggauggagcaagccaaauucaaaacuacagaucaaccgccaggugauuguagagcggggcaaucguagugguuacuccgggauauuuagcguugaaggcaagucuugcaucaaccgcuguuucuauguggagcucauuagaggaaggaaggaagagacagaagucugguggacuucaaauaguaucguggucuuuugcggcaccagcgggacauacggaacugguuccuggcccgacggcgcggauaucaaccugaugccuauuuga

SEQ ID NO: 136618 - RNA, 1410 nt, Artificial Sequence; identical to SEQ ID NO: 136607
  derived and/or modified sequence opt3 from neuraminidase__InfluenzaA__ABC42161

SEQ ID NO: 136619 - RNA, 1410 nt, Artificial Sequence
  derived and/or modified sequence opt3 from neuraminidase__InfluenzaA__ABC42172
augaaccccaaucagaagaucauuaccauaggcagcgugucccugacaaucgccacuauuugcucucucaugcaaaucgcuauucuugucacgaccguuacacugcacuucaaacagcaugaguguaacucaccuccaaauaaccaggugauguugugcgaaccgacuaucauagagagaaauaucaccgaaauuguauacuuaacaaacaccacuaucgagaaggaaauuugucccaaacugguggaguauaggaauuggaguaagccucagugcaacaucacaggguuugcaccauucagcaaagacaauuccauacggcuaucugccggaggugauauuugggucacccgcgagcccuacgugucgugugacccugauaagugcuaucaauuugcgcucggccaggggacgacucugaacaauggacacucaaacgacaccguucaugaucgaacaccauaccguacucuucugaugaaugaauugggcgugcccuuccaccucgguaccagacaggucuguaucgcuuggagcaguuccucuugccaugacgggaaggccuggcugcacguguguguaacaggagaugacaaaaacgcaaccgccagcuuuauuuauaauggcaggcugguugauuccaucggcucauggaguaagaaaauccuccggacgcaggagagcgaaugcguguguauuaacgggacuugcacagucgugaugaccgacggaucugcuuccgguaaggcagauacuaaaauauuauucaucgaggagggcaagauugugcacaucucaacacugagcgggagugcccaacaugucgaagagugcucuuguuacccucgcuauccaggaguuagaugcguguguagggacaacuggaagggcuccaaucggccgauaguagauauuaacgugaaagacuacagcaucgucucgucuuacgugugcuccggucuuguuggggacacuccccgcaagaaugauucauuuaguagcucccacuguuuggacccuaacaaugaagagggaggccauggcgugaaagggugggcuuucgaugacggaaacgaugucuggaugggucgaacgaucucugaaaagcugagaagcggcuaugagaccuuuaaagugauugagggguggucaaagccaaauaguaaacuacagaucaacaggcagguaauuguugaacggggaaaucguuccggcuacagcgguauauucucuguggaggggaagucaugcaucaaccgcuguuuuuaugucgaacucauuagaggcaggaaggaggaaacagaggugugguggaccaguaauagcaucgucguguucugcggaaccuccggcacauacgggacuggaucuuggcccgacggugccgauaucaaccugaugccuauuuga

SEQ ID NO: 136620 - RNA, 1410 nt, Artificial Sequence; identical to SEQ ID NO: 136607
  derived and/or modified sequence opt3 from neuraminidase__InfluenzaA__ABC42183

SEQ ID NO: 136621 - RNA, 1410 nt, Artificial Sequence; identical to SEQ ID NO: 136607
  derived and/or modified sequence opt3 from neuraminidase__InfluenzaA__ABC42195

SEQ ID NO: 136622 - RNA, 1410 nt, Artificial Sequence; identical to SEQ ID NO: 136607
  derived and/or modified sequence opt3 from neuraminidase__InfluenzaA__ABC42310

SEQ ID NO: 136623 - RNA, 1410 nt, Artificial Sequence; identical to SEQ ID NO: 136607
  derived and/or modified sequence opt3 from neuraminidase__InfluenzaA__ABC42321

SEQ ID NO: 136624 - RNA, 1410 nt, Artificial Sequence; identical to SEQ ID NO: 136607
  derived and/or modified sequence opt3 from neuraminidase__InfluenzaA__ABC42349

SEQ ID NO: 136625 - RNA, 1410 nt, Artificial Sequence; identical to SEQ ID NO: 136607
  derived and/or modified sequence opt3 from neuraminidase__InfluenzaA__ABC42464

SEQ ID NO: 136626 - RNA, 1410 nt, Artificial Sequence; identical to SEQ ID NO: 136607
  derived and/or modified sequence opt3 from neuraminidase__InfluenzaA__ABC42497

SEQ ID NO: 136627 - RNA, 1410 nt, Artificial Sequence; identical to SEQ ID NO: 136607
  derived and/or modified sequence opt3 from neuraminidase__InfluenzaA__ABC42508

SEQ ID NO: 136628 - RNA, 1410 nt, Artificial Sequence; identical to SEQ ID NO: 136607
  derived and/or modified sequence opt3 from neuraminidase__InfluenzaA__ABC42519

SEQ ID NO: 136629 - RNA, 1410 nt, Artificial Sequence; identical to SEQ ID NO: 136607
  derived and/or modified sequence opt3 from neuraminidase__InfluenzaA__ABC42530

SEQ ID NO: 136630 - RNA, 1410 nt, Artificial Sequence; identical to SEQ ID NO: 136607
  derived and/or modified sequence opt3 from neuraminidase__InfluenzaA__ABC42577

SEQ ID NO: 136631 - RNA, 1410 nt, Artificial Sequence; identical to SEQ ID NO: 136607
  derived and/or modified sequence opt3 from neuraminidase__InfluenzaA__ABC42588

SEQ ID NO: 136632 - RNA, 1410 nt, Artificial Sequence; identical to SEQ ID NO: 136343
  derived and/or modified sequence opt3 from neuraminidase__InfluenzaA__ABC42599

SEQ ID NO: 136633 - RNA, 1410 nt, Artificial Sequence; identical to SEQ ID NO: 136343
  derived and/or modified sequence opt3 from neuraminidase__InfluenzaA__ABC42610

SEQ ID NO: 136634 - RNA, 1410 nt, Artificial Sequence; identical to SEQ ID NO: 136343
  derived and/or modified sequence opt3 from neuraminidase__InfluenzaA__ABC42621

SEQ ID NO: 136635 - RNA, 1410 nt, Artificial Sequence; identical to SEQ ID NO: 136343
  derived and/or modified sequence opt3 from neuraminidase__InfluenzaA__ABC42632

SEQ ID NO: 136636 - RNA, 1410 nt, Artificial Sequence; identical to SEQ ID NO: 136343
  derived and/or modified sequence opt3 from neuraminidase__InfluenzaA__ABC42643

SEQ ID NO: 136637 - RNA, 1410 nt, Artificial Sequence; identical to SEQ ID NO: 136343
  derived and/or modified sequence opt3 from neuraminidase__InfluenzaA__ABC42654

SEQ ID NO: 136638 - RNA, 1410 nt, Artificial Sequence; identical to SEQ ID NO: 136343
  derived and/or modified sequence opt3 from neuraminidase__InfluenzaA__ABC42665

SEQ ID NO: 136639 - RNA, 1410 nt, Artificial Sequence; identical to SEQ ID NO: 136343
  derived and/or modified sequence opt3 from neuraminidase__InfluenzaA__ABC42676

SEQ ID NO: 136640 - RNA, 1410 nt, Artificial Sequence; identical to SEQ ID NO: 136343
  derived and/or modified sequence opt3 from neuraminidase__InfluenzaA__ABC42687

SEQ ID NO: 136641 - RNA, 1410 nt, Artificial Sequence; identical to SEQ ID NO: 136343
  derived and/or modified sequence opt3 from neuraminidase__InfluenzaA__ABC42698

SEQ ID NO: 136642 - RNA, 1410 nt, Artificial Sequence; identical to SEQ ID NO: 136343
  derived and/or modified sequence opt3 from neuraminidase__InfluenzaA__ABC42709

SEQ ID NO: 136643 - RNA, 1410 nt, Artificial Sequence; identical to SEQ ID NO: 136343
  derived and/or modified sequence opt3 from neuraminidase__InfluenzaA__ABC42720

SEQ ID NO: 136644 - RNA, 1410 nt, Artificial Sequence
  derived and/or modified sequence opt3 from neuraminidase__InfluenzaA__ABC42742
augaaccccaaucagaagaucauuaccauaggcagcgugucccugacaaucucuacuauuugcuucuuuaugcagaucgccauucucaugacgaccgucacacuucacuucaaacaguacgaguuuaacucaccuccaaauaaccagguuaugcugugugaaccgacuaucauagagagaaauaucaccgaaauuguguauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcaucgcuuggagcaguuccucuugucacgaugguaaggccuggcuccaugucugcgugacaggggacgauaagaaugcaaccgccagcuucauuuacaacggaagacugguagacuccaucguuucauggaguaaagagauccugaggacgcaggaaagcgagugugugugcauuaauggcacuuguacagucgugaugaccgauggcucugcuuccgggaaggcagacacuaaaauacucuuuaucgaggaaggaaagauugugcacacaucaaccuuaagcgguagugcccaacacgucgaggaaugcucuugcuauccucgguacccaggcguucgcugugugugcagagauaacuggaagggguccaacaggccgaucguagacauaaauauuaaagacuacagcaucgugucgucuuaugucuguuccggacuggugggcgauacgccccggcgcaacgacucaaguagcuccucucauugccuugauccuaauaacgaggaaggugggcacggaguuaagggcugggcuuucgacgauggcaaugacguguggauggggcgaaccaucagcgagaaauugagaucaggauacgagacauuuaaggucauugaagguuggaguaacccaaauuccaaacugcagaucaacaggcaagugauuguagaucggggcaaucguagcggguauucuggaauauucucaguugagggcaagaguuguaucaaccgcugcuuuuacguggaacuaauuagagguaggaaagaggaaacugagguccucuggaccagcaauuccaucguggucuucugugggacaucuggcacuuauggaaccggcucguggcccgacggggccgauaucaaccugaugccuauuuga

SEQ ID NO: 136645 - RNA, 1410 nt, Artificial Sequence; identical to SEQ ID NO: 136343
  derived and/or modified sequence opt3 from neuraminidase__InfluenzaA__ABC42764

SEQ ID NO: 136646 - RNA, 1410 nt, Artificial Sequence; identical to SEQ ID NO: 136343
  derived and/or modified sequence opt3 from neuraminidase__InfluenzaA__ABC42775

SEQ ID NO: 136647 - RNA, 1410 nt, Artificial Sequence; identical to SEQ ID NO: 136343
  derived and/or modified sequence opt3 from neuraminidase__InfluenzaA__ABC42786

SEQ ID NO: 136648 - RNA, 1410 nt, Artificial Sequence; identical to SEQ ID NO: 136343
  derived and/or modified sequence opt3 from neuraminidase__InfluenzaA__ABC42797

SEQ ID NO: 136649 - RNA, 1410 nt, Artificial Sequence; identical to SEQ ID NO: 136343
  derived and/or modified sequence opt3 from neuraminidase__InfluenzaA__ABC42808

SEQ ID NO: 136650 - RNA, 1410 nt, Artificial Sequence; identical to SEQ ID NO: 136343
  derived and/or modified sequence opt3 from neuraminidase__InfluenzaA__ABC42819

SEQ ID NO: 136651 - RNA, 1410 nt, Artificial Sequence
  derived and/or modified sequence opt3 from neuraminidase__InfluenzaA__ABC42841
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuucccggaaggcagacacuaaaauccucuuuauugaggaagggaagaucgugcacacaucaaccuuaagcggaagugcccaacacgucgaggaaugcucuugcuauccucgcuacccagguguuagaugugugugcagggauaacuggaagggcuccaaccggccgauaguagacauuaauaucaaagacuacagcaucgugucgucuuaugucuguuccgggcuggugggagauacgccccgcaagaacgacucaaguagcuccucucauugccuugauccuaauaacgaggaaggcggucacgggguuaaaggaugggcuuucgacgauggcaaugacguguggaugggccgaaccauuagcgagaaguugagaucaggguacgagacauuuaaagucaucgaaggauggaguaacccaaauuccaagcugcagauuaacaggcaagugauaguagaucgggguaaucguagcggcuauucugggaucuucucaguugagggaaaaaguuguauuaaccgcugcuuuuacguggaacuaaucagaggcaggaaggaggaaacugagguccucuggaccagcaauuccaucguggucuucugugguacaucugggacuuauggcaccggaucguggcccgacggcgccgauauuaaccugaugccuauauga

SEQ ID NO: 136652 - RNA, 1410 nt, Artificial Sequence; identical to SEQ ID NO: 136343
  derived and/or modified sequence opt3 from neuraminidase__InfluenzaA__ABC42852

SEQ ID NO: 136653 - RNA, 1410 nt, Artificial Sequence; identical to SEQ ID NO: 136343
  derived and/or modified sequence opt3 from neuraminidase__InfluenzaA__ABC42863

SEQ ID NO: 136654 - RNA, 1410 nt, Artificial Sequence; identical to SEQ ID NO: 136182
  derived and/or modified sequence opt3 from neuraminidase__InfluenzaA__ABC42874

SEQ ID NO: 136655 - RNA, 1410 nt, Artificial Sequence; identical to SEQ ID NO: 136182
  derived and/or modified sequence opt3 from neuraminidase__InfluenzaA__ABC42885

SEQ ID NO: 136656 - RNA, 1410 nt, Artificial Sequence; identical to SEQ ID NO: 136182
  derived and/or modified sequence opt3 from neuraminidase__InfluenzaA__ABC42896

SEQ ID NO: 136657 - RNA, 1410 nt, Artificial Sequence; identical to SEQ ID NO: 136607
  derived and/or modified sequence opt3 from neuraminidase__InfluenzaA__ABC42914

SEQ ID NO: 136658 - RNA, 1410 nt, Artificial Sequence; identical to SEQ ID NO: 136607
  derived and/or modified sequence opt3 from neuraminidase__InfluenzaA__ABC42932

SEQ ID NO: 136659 - RNA, 1410 nt, Artificial Sequence
  derived and/or modified sequence opt3 from neuraminidase__InfluenzaA__ABC42943
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggugggguauaggaauuggucaaagccucagugcaacaucacaggauucgcaccauuuaguaaagacaauagcauacggcuauccgccgguggcgauauuugggucacccgcgagcccuacgugucuugugacccugauaagugcuaucaauucgcgcucgggcagggaacgacucugaacaauggccacucgaacgacaccguucaugaucgaacaccauaccguacucuucugaugaaugaguugggugugcccuuucaccucgggaccagacaggucuguaucgcuuggucaagcaguuccugccaugacggaaaggccuggcugcacguguguguaacaggcgaugacaaaaacgcaaccgccucuuucauuuauaauggcaggcugguugauagcaucggguccuggucaaagaaaauccuccggacgcaggaaagugagugcguguguauuaacggaacuugcacagucgugaugaccgacgguagcgcuucuggcaaggcagauacuaaaauauuauuuaucgaagaggggaagauugugcacaucuccacacugucaggaagcgcccaacaugucgaggaaugcaguuguuacccucgcuauccaggcguuagaugcguguguagggacaacuggaaggguucuaaucggccgauaguagauauuaacgugaaagacuacuccaucgucagcucguacgugugcucugggcuuguuggagacacgccccgcaagaaugauuccuucucaaguagccacuguuuggacccuaacaaugaggaaggcggccauggggugaaaggaugggcuuuugaugacgguaacgaugucuggaugggccgaaccaucuccgagaagcugagaucuggguaugaaaccuucaaagugauugagggauggagcaagccaaauucaaaacuacagaucaacaggcagguaauuguugagcggggcaaucguagugguuacuccgggauauuuagcguggaaggcaagucuugcaucaaccgcuguuucuaugucgagcucauuagaggaaggaaggaagagacagaagugugguggacuucaaauaguaucgucguguuuugcggcaccagcgggacauacggaacugguuccuggcccgacggcgccgauaucaaccugaugccuauuuga

SEQ ID NO: 136660 - RNA, 1410 nt, Artificial Sequence; identical to SEQ ID NO: 136607
  derived and/or modified sequence opt3 from neuraminidase__InfluenzaA__ABC42954

SEQ ID NO: 136661 - RNA, 1410 nt, Artificial Sequence; identical to SEQ ID NO: 136607
  derived and/or modified sequence opt3 from neuraminidase__InfluenzaA__ABC42965

SEQ ID NO: 136662 - RNA, 1410 nt, Artificial Sequence
  derived and/or modified sequence opt3 from neuraminidase__InfluenzaA__ABC42976
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggcaauguugugcgaaccgacuaucauagagagaaauaucaccgaaauuguguacuuaacaaacaccacuaucgagaaggaaauuugucccaaacugguagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacaaaaacgccaccgcuucuuucauuuauaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauugugcacaucuccacacugucagggagcgcucaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacccccaggaagaaugauuccuucucaaguagccacuguuuggacccuaacaaugaagagggaggccauggcguuaaagggugggccuuugaugacggaaacgauguguggaugggucgaacgaucuccgaaaagcugagaucuggcuaugagaccuucaaagucauugagggguggagcaagccaaauucaaaacuacagaucaaccgccaggugauuguagaacggggaaaucguaguggcuacuccgguauauuuagcguugaggggaagucuugcaucaaccgcuguuucuauguggaacucauuagaggcaggaaggaggaaacagaggucugguggacuucaaauaguaucguggucuuuugcggaaccagcggcacauacgggacuggauccuggcccgacggugcggauaucaaccugaugccuauuuga

SEQ ID NO: 136663 - RNA, 1410 nt, Artificial Sequence; identical to SEQ ID NO: 136607
  derived and/or modified sequence opt3 from neuraminidase__InfluenzaA__ABC42987

SEQ ID NO: 136664 - RNA, 1410 nt, Artificial Sequence; identical to SEQ ID NO: 136607
  derived and/or modified sequence opt3 from neuraminidase__InfluenzaA__ABC42998

SEQ ID NO: 136665 - RNA, 1410 nt, Artificial Sequence; identical to SEQ ID NO: 136607
  derived and/or modified sequence opt3 from neuraminidase__InfluenzaA__ABC43009

SEQ ID NO: 136666 - RNA, 1410 nt, Artificial Sequence; identical to SEQ ID NO: 136607
  derived and/or modified sequence opt3 from neuraminidase__InfluenzaA__ABC43020

SEQ ID NO: 136667 - RNA, 1410 nt, Artificial Sequence
  derived and/or modified sequence opt3 from neuraminidase__InfluenzaA__ABC43042
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacugguggaguauaggaauuggucaaagccucagugcaacaucacaggguucgcaccauuuaguaaagacaauagcauacggcuauccgccggaggugauauuugggucacccgcgagcccuacgugucuugugacccugauaagugcuaucaauucgcgcucggccaggggacgacucugaacaauggacacucgaacgacaccguucaugaucgaacaccauaccguacucuucugaugaaugaauugggcgugcccuuucaccucgguaccagacaggucuguaucgcuuggucaagcaguuccugccaugacgggaaggccuggcugcacguguguguaacaggagaugacaaaaacgcaaccgccucuuucauuuauaauggcaggcugguugauagcaucggcuccuggucaaagaaaauccuccggacgcaggagagugaaugcguguguauuaacgggacuugcacagucgugaugaccgacggaagcgcuucugguaaggcagauacuaaaauauuauuuaucgaggagggcaagauugugcacaucuccacacugucagggagcgcccaacaugucgaagagugcaguuguuacccucgcuauccaggaguuagaugcguguguagggacaacuggaagggcucuaaucggccgauaguagauauuaacgugaaagacuacuccaucgucagcucguacgugugcucuggucuuguuggggacacgccccgcaagaaugauuccuucucaaguagccacuguuuggacccuaacaaugaagagggaggccauggcgugaaagggugggcuuuugaugacggaaacgaugucuggaugggucgaaccaucuccgaaaagcugagaucuggcuaugagaccuucaaagugauugagggguggagcaagccaaauucaaaacuacagaucaacaggcagguaauuguugaacggggaaaucguaguggcuacuccgguauauuuagcguggaggggaagucuugcaucaaccgcuguuucuaugucgaacucauuagaggcaggaaggaggaaacagaggugugguggacuucaaauaguaucgucguguuuugcggaaccagcggcacauacgggacuggauccuggcccgacggugccgauaucaaccugaugucuauuuga

SEQ ID NO: 136668 - RNA, 1410 nt, Artificial Sequence; identical to SEQ ID NO: 136607
  derived and/or modified sequence opt3 from neuraminidase__InfluenzaA__ABC43053

SEQ ID NO: 136669 - RNA, 1410 nt, Artificial Sequence
  derived and/or modified sequence opt3 from neuraminidase__InfluenzaA__ABC43064
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacugguggaguauaggaauuggucaaagccucagugcaacaucacaggguucgcaccauuuaguaaagacaauagcauacggcuauccgccggaggugauauuugggucacccgcgagcccuacgugucuugugacccugauaagugcuaucaauucgcgcucggccaggggacgacucugaacaauggacacucgaacgacaccguucaugaucgaacaccauaccguacucuucugaugaaugaauugggcgugcccuuucaccucgguaccagacaggucuguaucgcuuggucaagcaguuccugccaugacgggaaggccuggcugcacguguguguaacaggagaugacaaaaacgcaaccgccucuuucauuuauaauggcaggcugguugauagcaucggcuccuggucaaagaaaauccuccggacgcaggagagugaaugcguguguauuaacgggacuugcacagucgugaugaccgacggaagcgcuucugguaaggcagauacuaaaauauuauuuaucgaggagggcaagauugugcacaucuccacacugucagggagcgcccaacaugucgaagagugcaguuguuacccucgcuauccaggaguuagaugcguguguagggacaacuggaagggcucuaaucggccgauaguagauauuaacgugaaagacuacuccaucgucagcucguacgugugcucuggucuuguuggggacacgccccgcaagaaugauuccuucucaaguagccacuguuuggacccuaacaaugaagagggaggccauggcgugaaagggugggcuuuugaugacggaaacgaugucuggaugggucgaaccaucuccgaaaagcugagaucuggcuaugagaccuucaaagugauugagggguggagcaagccaaauucaaaacuacagaucaacaggcagguaauuguugaacggggaaaucguaguggcuacuccgguauauuuagcguggaggggaagucuugcaucaaccgcuguuucuaugucgaacucauuagaggcaggaaggagaaaacagaagugugguggacuucaaauaguaucgucguguuuugcggaaccagcggcacauacgggacuggauccuggcccgacggugccgauaucaaccugaugccuauuuga

SEQ ID NO: 136670 - RNA, 1410 nt, Artificial Sequence; identical to SEQ ID NO: 136607
  derived and/or modified sequence opt3 from neuraminidase__InfluenzaA__ABC43075

SEQ ID NO: 136671 - RNA, 1410 nt, Artificial Sequence
  derived and/or modified sequence opt3 from neuraminidase__InfluenzaA__ABC43086
augaaccccaaucagaagaucauuaccauaggcagcgugucccugaucauugccacaaucugcuuccucaugcaaauugcuauccuugucacuacgguuacccugcacuuuaaacagcaugaguguaacucuccuccaaauaaccaggugauguugugcgaaccgacaauaaucgagagaaauauuacugaaaucguauacuuaaccaacacaaccauugagaaggaaaucugucccaaacugguggaguauaggaauuggucaaagccucagugcaacauaacuggguucgcaccauuuaguaaagacaauagcauucggcuauccgccggaggugauaucugggucacacgcgagcccuacgugucuugugacccugauaagugcuaucaauucgcgcucggccaggggaccacgcugaacaauggacacucgaacgacacuguucaugaucgaaccccauaccguacacuucugaugaaugaauugggcgugcccuuucaccucgguacuagacaggucuguauugcuuggucaagcaguuccugccaugacgggaaggccuggcugcacguguguguaaccggagaugacaaaaacgcaacagccucuuucaucuauaauggcaggcugguugauagcaucggcuccuggucaaagaaaauucuccggacccaggagagugaaugcguguguauaaacgggacgugcacugucgugaugacagacggaagcgcuucugguaaggcagauaccaaaaucuuauuuauugaggagggcaagaucgugcacauauccacucugucagggagcgcccaacaugucgaagagugcaguuguuacccucgcuauccaggaguuagaugcguguguagggacaacuggaagggcucuaaucggccgauuguagauaucaacgugaaagacuacuccaucgucagcucguacgugugcucuggucuuguuggggacacaccccgcaagaaugauuccuucucaaguagccacuguuuggacccuaacaaugaagagggaggccauggcgugaaagggugggcuuuugaugacggaaacgaugucuggaugggucgaaccauuuccgaaaagcugagaucuggcuaugagacguucaaagugaucgagggguggagcaagccaaauucaaaacuacagauuaacaggcagguaauaguugaacggggaaaucguaguggcuacuccgguaucuuuagcguggaggggaagucuugcauuaaccgcuguuucuaugucgaacucaucagaggcaggaaggaggaaaccgaggugugguggacaucaaauaguaucgucguguuuugcggaacuagcggcaccuacgggacaggauccuggcccgacggugccgauauuaaccugaugccuauauga

SEQ ID NO: 136672 - RNA, 1410 nt, Artificial Sequence; identical to SEQ ID NO: 136607
  derived and/or modified sequence opt3 from neuraminidase__InfluenzaA__ABC43097

SEQ ID NO: 136673 - RNA, 1410 nt, Artificial Sequence; identical to SEQ ID NO: 136607
  derived and/or modified sequence opt3 from neuraminidase__InfluenzaA__ABC43108

SEQ ID NO: 136674 - RNA, 1410 nt, Artificial Sequence; identical to SEQ ID NO: 136607
  derived and/or modified sequence opt3 from neuraminidase__InfluenzaA__ABC43119

SEQ ID NO: 136675 - RNA, 1410 nt, Artificial Sequence; identical to SEQ ID NO: 136343
  derived and/or modified sequence opt3 from neuraminidase__InfluenzaA__ABC43130

SEQ ID NO: 136676 - RNA, 1410 nt, Artificial Sequence; identical to SEQ ID NO: 136343
  derived and/or modified sequence opt3 from neuraminidase__InfluenzaA__ABC43141

SEQ ID NO: 136677 - RNA, 1410 nt, Artificial Sequence; identical to SEQ ID NO: 136343
  derived and/or modified sequence opt3 from neuraminidase__InfluenzaA__ABC43152

SEQ ID NO: 136678 - RNA, 1410 nt, Artificial Sequence; identical to SEQ ID NO: 136343
  derived and/or modified sequence opt3 from neuraminidase__InfluenzaA__ABC43163

SEQ ID NO: 136679 - RNA, 1410 nt, Artificial Sequence; identical to SEQ ID NO: 136343
  derived and/or modified sequence opt3 from neuraminidase__InfluenzaA__ABC43174

SEQ ID NO: 136680 - RNA, 1410 nt, Artificial Sequence
  derived and/or modified sequence opt3 from neuraminidase__InfluenzaA__ABC43185
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacucggauccucuuuauugaggaaggaaaaaucgugcacacaucaaccuuaagcgguagugcccaacacgucgaggaaugcucuugcuauccucgcuacccaggcguuagaugugugugcagggauaacuggaagggguccaaccggccgauaguagacauuaauaucaaggacuacagcaucgugucgucuuaugucuguuccggacuggugggcgauacgccccgcaaaaacgacucaaguagcuccucucauugccuugauccuaauaacgaggaaggugggcacggaguuaagggcugggcuuucgacgauggcaaugacguguggauggggcgaaccauuagcgagaaauugagaucaggauacgagacauuuaaggucaucgaagguuggaguaacccaaauuccaaacugcagauuaacaggcaagugauaguagaucggggcaaucguagcggguauucuggaaucuucucaguugagggcaagaguuguauuaaccgcugcuuuuacguggaacuaaucagagguaggaaagaggaaacugagguccucuggaccagcaauuccaucguggucuucugugggacaucuggcacuuauggaaccggcucguggcccgacggggccgauauuaaccugaugccuauauga

SEQ ID NO: 136681 - RNA, 1410 nt, Artificial Sequence; identical to SEQ ID NO: 136343
  derived and/or modified sequence opt3 from neuraminidase__InfluenzaA__ABC43478

SEQ ID NO: 136682 - RNA, 1410 nt, Artificial Sequence; identical to SEQ ID NO: 136343
  derived and/or modified sequence opt3 from neuraminidase__InfluenzaA__ABC43489

SEQ ID NO: 136683 - RNA, 1410 nt, Artificial Sequence; identical to SEQ ID NO: 136343
  derived and/or modified sequence opt3 from neuraminidase__InfluenzaA__ABC43500

SEQ ID NO: 136684 - RNA, 1410 nt, Artificial Sequence
  derived and/or modified sequence opt3 from neuraminidase__InfluenzaA__ABC43511
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaacuaccauaaucgagagaaauauuacagaaaucguguauuugaccaacacuacaauugagaaggaaaucugcccgaaauuagcugaguacaggaauuggaguaagccccagugugacauaaccggguucgcaccuuuuagcaaagauaacuccauucggcugucugccggaggugacaucuggguaacgcgcgagccauaugugucgugcgaucccgacaaguguuaccaauucgcgcuaggccaggggacuacccucaauaacguccauucaaaugauacagugcacgaccgaacuccuuaucguacccugcuuaugaacgaacugggaguuccauuucauuugggcacaaaacaggugugcauugcuuggagcaguuccucuugucacgaugguaaggccuggcuccaugucugcgugaccggggacgauaagaaugcaacggccagcuucaucuacaacggaagacugguagacuccaucguuucauggaguaaagagauucugaggacucaggaaagcgagugugugugcauaaauggcacauguaccgucgugaugacugauggcucugcuuccgggaaggcagacacaaaaauccucuuuauugaggaaggaaagaucgugcacaccucaacguuaagcgguagugcccaacacgucgaggaaugcucuugcuauccccgguacccuggcguucgcugugugugcagagauaacuggaagggguccaacaggccaauaguagacauuaauaucaaagacuacagcaucgugucgucuuaugucuguuccggacuggugggcgauaccccgcggaagaacgacucaaguagcuccucucauugccuugaucccaauaacgaggaaggugggcacggaguuaaaggcugggcuuucgacgauggcaaugacguguggauggggcgcacaauuagcgagaaguugcgaucaggauacgagacuuuuaaagucaucgaagguuggaguaacccuaauuccaagcugcagauuaacagacaggugauaguagauaggggcaaucggagcggguauucuggaaucuucucaguugagggcaaaaguuguauuaaccguugcuuuuacguggaacuaauccgcgguagaaaggaggaaaccgagguccucuggacaagcaauuccaucguggucuucugugggacuucuggcaccuauggaacaggcucguggccagacggggccgauauuaaccugaugcccauauga

SEQ ID NO: 136685 - RNA, 1410 nt, Artificial Sequence; identical to SEQ ID NO: 136343
  derived and/or modified sequence opt3 from neuraminidase__InfluenzaA__ABC43522

SEQ ID NO: 136686 - RNA, 1410 nt, Artificial Sequence; identical to SEQ ID NO: 136343
  derived and/or modified sequence opt3 from neuraminidase__InfluenzaA__ABC43533

SEQ ID NO: 136687 - RNA, 1410 nt, Artificial Sequence; identical to SEQ ID NO: 136343
  derived and/or modified sequence opt3 from neuraminidase__InfluenzaA__ABC43544

SEQ ID NO: 136688 - RNA, 1410 nt, Artificial Sequence; identical to SEQ ID NO: 136343
  derived and/or modified sequence opt3 from neuraminidase__InfluenzaA__ABC43555

SEQ ID NO: 136689 - RNA, 1410 nt, Artificial Sequence; identical to SEQ ID NO: 136586
  derived and/or modified sequence opt3 from neuraminidase__InfluenzaA__ABC46557

SEQ ID NO: 136690 - RNA, 1410 nt, Artificial Sequence
  derived and/or modified sequence opt3 from neuraminidase__InfluenzaA__ABC46579
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaggcaagugcuaccaauucgcgcuagggcagggaaccacgcucgauaacaaacauucaaaugacacuauucacgaucgaacccccuaucguacacugcuuaugaacgaacugggcguuccuuuucauuuggguacuagacagguguguaucgcuuggagcaguuccucuugccacgacgggaaggccuggcuccaugucugugugaccggacacgauaaaaaugcaacagccagcuucaucuacgacggcaggcugguagauuccauuggcucauggaguaagaacauacugcggacccaggagagcgaaugcguuuguaucaaugggacgugcacuguggucaugacagacggaucugcuuccgagcgcgcagauaccaaaauucucuuuaucgaggaagguaagauagugcacauuucaccauuaagcggcagugcccaacauguggaggaaugcucuuguuauccgagauaccccggggucaggugcguuugucgggacaacuggaagggauccaaucgcccugugguagauaucaacgugaaagacuacagcaucgucucgucuuaugugugcuccggccugguuggugacacuccacgaaagaacgauagaucaaguagcuccuacuguaggaaucccaacaaugagaaagggaaccacggagugaagggcugggcuuucgacgauggcaaugacgucuggauggggcggacaauuucugaagagagccguucaggauaugagaccuuuaaagugaucgguggcuggaguacgccuaacuccaaacuucagauuaaucgccagguaauaguugauagcgacaacagaucuggguacucaggaaucuucaguguggaaggcaagagcugcauuaauagguguuuuuaugucgaguugauccggggucgagaacaggagacccgcgugugguggacauccaacucuaucgucguguucugcgggacuucgggcaccuacggaacaggcagcuggccagauggggccgacauuaaucugaugcccauauga

SEQ ID NO: 136691 - RNA, 1410 nt, Artificial Sequence; identical to SEQ ID NO: 136530
  derived and/or modified sequence opt3 from neuraminidase__InfluenzaA__ABC50170

SEQ ID NO: 136692 - RNA, 1410 nt, Artificial Sequence; identical to SEQ ID NO: 136530
  derived and/or modified sequence opt3 from neuraminidase__InfluenzaA__ABC50181

SEQ ID NO: 136693 - RNA, 1410 nt, Artificial Sequence; identical to SEQ ID NO: 136530
  derived and/or modified sequence opt3 from neuraminidase__InfluenzaA__ABC50192

SEQ ID NO: 136694 - RNA, 1410 nt, Artificial Sequence; identical to SEQ ID NO: 136182
  derived and/or modified sequence opt3 from neuraminidase__InfluenzaA__ABC50203

SEQ ID NO: 136695 - RNA, 1410 nt, Artificial Sequence
  derived and/or modified sequence opt3 from neuraminidase__InfluenzaA__ABC50214
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaauugauaucaacgugaaggacuacuccaucguaagcucguaugugugcucuggucuugucggggacacgccccgcaaaaaugauuccuucucaaguagccauuguuuggacccuaacaaugaggaaggaggccacggcgugaaggggugggccuuugaugacggaaacgauguuuggaugggucgaaccauuuccgagaaacugagaucuggcuacgagaccuucaaggugaucgaaggguggagcaaaccaaaucccaagcuacagacaaacaggcaggucauuguggagcggggaaaucguucaggcuauagugguauauuuuccguagaagggaaaagcugcaucaaccgcuguuucuacguugagcucauuagaggcaggaaggaagagacugaggugugguggaccucuaauucaaucgucguguuuugcggaacaaguggcacuuaugggaccggaagcuggccugacggugcggauaucaaccugaugccaauuuga

SEQ ID NO: 136696 - RNA, 1410 nt, Artificial Sequence; identical to SEQ ID NO: 136182
  derived and/or modified sequence opt3 from neuraminidase__InfluenzaA__ABC50225

SEQ ID NO: 136697 - RNA, 1410 nt, Artificial Sequence; identical to SEQ ID NO: 136182
  derived and/or modified sequence opt3 from neuraminidase__InfluenzaA__ABC50247

SEQ ID NO: 136698 - RNA, 1410 nt, Artificial Sequence
  derived and/or modified sequence opt3 from neuraminidase__InfluenzaA__ABC50258
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaauugauaucaacgugaaggacuacuccaucguaagcucguaugugugcucuggucuugucggggacacgccccgcaaaaaugauuccuucucaaguagccauuguuuggacccuaacaaugaggaaggaggccacggcgugaaggggugggccuuugaugacggaaacgauguuuggaugggucgaaccauuuccgagaaacugagaucuggcuacgagaccuucaaggugaucgaaggguggagcaaaccaaauucaaagcuacagacaaacaggcaggucauuguggagcggggaaaucguaguggcuauuccgguauauuuagcaucgaagggaaaucuugcauuaaccgcuguuucuacguagagcucaucagaggcaggaaggaagagacugagguuugguggaccucaaauaguaucguggucuuuugcggaacaagcggcacuuaugggaccggauccuggcccgacggugcggauauuaaccugaugccuauauga

SEQ ID NO: 136699 - RNA, 1410 nt, Artificial Sequence; identical to SEQ ID NO: 136182
  derived and/or modified sequence opt3 from neuraminidase__InfluenzaA__ABC50280

SEQ ID NO: 136700 - RNA, 1410 nt, Artificial Sequence; identical to SEQ ID NO: 136182
  derived and/or modified sequence opt3 from neuraminidase__InfluenzaA__ABC50291

SEQ ID NO: 136701 - RNA, 1410 nt, Artificial Sequence
  derived and/or modified sequence opt3 from neuraminidase__InfluenzaA__ABC50302
augaaccccaaucagaagaucauuaccauaggcagcgugucccugacaaucgccacuauuugcuuccucaugcaaaucgcuauucuuaucacgaccgucacacugcacuuuaaacaguacgaguguaacucuccuccaaauaaccagguuauguugugcgaaccgacuauaaucgagagaaauauuaccgaaaucguguauuuaacaaacaccacuauugagaaggaaaucugucccaaacuggcagaguacaggaauuggucaaagccucagugcaacauaacaggguucgccccauuuaguaaagacaauagcauucggcuauccgcgggaggugauaucuggguaacccgcgagcccuaugugucuugugacccugauaagugcuaccaauucgcucucggccaggggacgacucugaacaauggacauucgaacgacaccguccacgaucgaacaccauaucguacucuucugaugaaugaauugggcgugcccuuucaucucgguaccagacagguuuguauugccuggucaagcaguuccugccacgacgggaaggcauggcugcaugugugugucacaggagaugacgagaacgccaccgcuucuuucaucuacaauggcaggcugguggauagcaucggcuccuggaguaaaaagauucuccggacgcaggaaucagagugcguauguauaaacgggacuugcacaguugugaugaccgacggaagcgcaucugguaaagccgauacuaagaucuuauuuauugaggaaggcaaaaucguccacauauccacacugucagggagcgcucaacacguggaggaaugcaguuguuauccucgcuacccaggagugagaugcgucuguagggacaacuggaagggcucuaaucggccgauuguugauaucaacgugaaggacuacuccaucguaagcucguaugugugcucuggucuugucggggacacgccccgcaaaaaugauuccuucucaaguagccauuguuuggacccuaacaaugaggaaggaggccacggcgugaaggggugggccuuugaugacggaaacgauguuuggaugggucgaaccauuuccgagaaacugagaucuggcuacgagaccuucaaggugaucgaaggguggagcaaaccaaauucaaagcuacagacaaacaggcaggucauuguggagcggggaaaucguaguggcuauuccgguauauuuagcguagaagggaaaucuugcaucaaccgcuguuucuacguugagcucauuagaggcaggaaggaagagacugaggugugguggaccucaaauaguaucgucguguuuugcggaacaagcggcacuuaugggaccggauccuggcccgacggugcggauaucaaccugaugccuauuuga

SEQ ID NO: 136702 - RNA, 1410 nt, Artificial Sequence
  derived and/or modified sequence opt3 from neuraminidase__InfluenzaA__ABC50313
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacgagaacgccaccgcuucuuucauuuauaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacauguggaggaaugcaguuguuacccucgcuauccaggagucagaugcguuuguagggacaacuggaagggcucuaaucggccgauaguggauauuaacguaaaggacuacuccaucgugagcucguacgucugcucuggucuugugggggacacccccaggaaaaaugauuccuucucaaguagccacuguuuggacccuaacaaugaggaaggaggccauggcguuaaggggugggccuuugaugacggaaacgauguguggaugggucgaacgaucuccgagaaacugagaucuggcuaugagaccuucaaggucauugaaggguggagcaaaccaaauucaaagcuacagacaaaccgccaggugaucguagagcggggaaaucguaguggcuacuccgguauuuuuagcguugaagggaaaucuugcauaaaccgcuguuucuauguggagcucaucagaggcaggaaggaagagacugaggucugguggaccucaaauaguauuguggucuuuugcggaacaagcggcacuuacgggaccggauccuggcccgacggugcggauaucaaccugaugccuaucuga

SEQ ID NO: 136703 - RNA, 1410 nt, Artificial Sequence; identical to SEQ ID NO: 136182
  derived and/or modified sequence opt3 from neuraminidase__InfluenzaA__ABC50324

SEQ ID NO: 136704 - RNA, 1410 nt, Artificial Sequence; identical to SEQ ID NO: 136170
  derived and/or modified sequence opt3 from neuraminidase__InfluenzaA__ABC50335

SEQ ID NO: 136705 - RNA, 1410 nt, Artificial Sequence
  derived and/or modified sequence opt3 from neuraminidase__InfluenzaA__ABC50346
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaauugauaucaacgugaaggacuacuccaucguaagcucguaugugugcucuggucuugucggggacacgccccgcaaaaaugauuccuucucaaguagccauuguuuggacccuaacaaugaggaaggaggccacggcgugaaggggugggccuuugaugacggaaacgauguuuggaugggucgaaccauuuccgagaaacugagaucuggcuacgagaccuucaaggugaucgaaggguggagcaaaccaaauucaaagcuacagacaaacaggcaggucauuguggagcggggaaaucguaguggcuauuccgguauauuuagcguagaagggaaaucuugcaucaaccgcuguuucuacguugagcucauuagaggcaggaaggaagagacugaggugugguggaccucaaauaguaucgucguguuuugcggaacaagcggcacuuaugggaccggauccuggcccgacggugcggauaucaaccugaugccuauuuga

SEQ ID NO: 136706 - RNA, 1410 nt, Artificial Sequence; identical to SEQ ID NO: 136182
  derived and/or modified sequence opt3 from neuraminidase__InfluenzaA__ABC50357

SEQ ID NO: 136707 - RNA, 1410 nt, Artificial Sequence; identical to SEQ ID NO: 136182
  derived and/or modified sequence opt3 from neuraminidase__InfluenzaA__ABC50368

SEQ ID NO: 136708 - RNA, 1410 nt, Artificial Sequence; identical to SEQ ID NO: 136182
  derived and/or modified sequence opt3 from neuraminidase__InfluenzaA__ABC50379

SEQ ID NO: 136709 - RNA, 1410 nt, Artificial Sequence; identical to SEQ ID NO: 136182
  derived and/or modified sequence opt3 from neuraminidase__InfluenzaA__ABC50390

SEQ ID NO: 136710 - RNA, 1410 nt, Artificial Sequence
  derived and/or modified sequence opt3 from neuraminidase__InfluenzaA__ABC50412
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuugauccuaauaacgaggaaggugggcacggaguuaaaggcugggcuuucgacgauggcaaugacguguggauggggcgcaccauuagcgagaaguugcgacugggauacgagacauuuaaagucaucgaagguuggucaaacccaaauaguaagcuacagauuaacagacaggugauaguagauaggggcaaucgguccggguauagcggaaucuucucuguugagggcaaaucauguauuaaccguugcuuuuacguggaacucauccgcgguagaaaggaggaaacugagguccuguggaccaguaauagcaucguggucuucugugggacauccggcacuuauggaaccggcucuuggcccgacggggccgauauuaaccuuaugccuauauga

SEQ ID NO: 136711 - RNA, 1410 nt, Artificial Sequence; identical to SEQ ID NO: 136710
  derived and/or modified sequence opt3 from neuraminidase__InfluenzaA__ABC50423

SEQ ID NO: 136712 - RNA, 1410 nt, Artificial Sequence; identical to SEQ ID NO: 136295
  derived and/or modified sequence opt3 from neuraminidase__InfluenzaA__ABC54671

SEQ ID NO: 136713 - RNA, 1410 nt, Artificial Sequence; identical to SEQ ID NO: 136427
  derived and/or modified sequence opt3 from neuraminidase__InfluenzaA__ABC54682

SEQ ID NO: 136714 - RNA, 1410 nt, Artificial Sequence; identical to SEQ ID NO: 136607
  derived and/or modified sequence opt3 from neuraminidase__InfluenzaA__ABC67322

SEQ ID NO: 136715 - RNA, 1410 nt, Artificial Sequence; identical to SEQ ID NO: 136182
  derived and/or modified sequence opt3 from neuraminidase__InfluenzaA__ABC67474

SEQ ID NO: 136716 - RNA, 1410 nt, Artificial Sequence; identical to SEQ ID NO: 136705
  derived and/or modified sequence opt3 from neuraminidase__InfluenzaA__ABC67546

SEQ ID NO: 136717 - RNA, 1410 nt, Artificial Sequence
  derived and/or modified sequence opt3 from neuraminidase__InfluenzaA__ABC67557
augaaccccaaucagaagaucauuaccauaggcagcgugucccugacaaucucuacuauuugcuucuuuaugcaaaucgccauucucgucacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaaugauaccguucacgaccgaacaccauaucguacucugcuuaugaacgaacugggagugcccuuucauuugggcaccaagcaggucugcaucgcuuggagcaguuccucuugucacgaugguaaagccuggcuccaugugugcguaacaggggacgauaagaaugcaaccgccagcuucauuuacaacggaagacugguugacuccaucgugucauggaguaaaaagauccugaggacgcaggagagcgaaugugucugcauuaauggcacuuguacaguggugaugaccgauggcucugcuuccgggaaagcagacacuaagauacucuuuaucgaggagggaaagauuguccacacaucaaccuuaagcgguagugcccaacacguugaagagugcucuugcuauccucgguacccaggcgugcgcuguguaugcagagauaacuggaaaggguccaacaggccgaucguggacauaaauauuaaggacuacagcaucgucucgucuuauguguguuccggacugguuggcgauacgccccggaaaaacgacucaaguagcuccucucauugccuugauccuaauaacgaagagggugggcacggagugaagggcugggcuuucgacgauggcaaugacgucuggauggggcgcaccaucagcgaaaaauugcgaucaggauacgagacauuuaaggugauugaggguuggaguaacccaaauuccaaacugcagaucaacagacagguaauuguugauaggggcaaucggagcggguauucuggaauauucucaguggaaggcaagaguuguaucaaccguugcuuuuacgucgagcuaauucgcgguagaaaggaagagacugaagugcucuggaccagcaauuccaucgucguguucugugggacaucuggcacuuauggaaccggcucguggcccgacggggccgauaucaaccugaugccuauuuga

SEQ ID NO: 136718 - RNA, 1410 nt, Artificial Sequence
  derived and/or modified sequence opt3 from neuraminidase__InfluenzaA__ABC67568
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaagcgcaucuggucgcgccgacaccaagauucucuuuaucgaggagggcaaaauagugcacauuuccccuuuaucagggagcgcucagcauguggaagagugcaguuguuauccaagauacccgggagucaggugcaucugucgggauaacuggaagggcucuaaucgccccguuguggacaucaacguaaaggacuacuccauugauagcucguaugugugcucuggucuggucggggacacuccucgaaacaaugauagauccucaaacaguuacuguaggaauccaaacaaugaaaaaggaaaccacggcgugaagggcugggccuucgacgaugggaaugacguuuggaugggacggacaaucagcgaggauucccguucugguuaugaaaccuuuaaagugauuggcggguggagcacgcccaacucaaaacuucagauaaaucgccaggucaucguggacagugauaacagauccggauacagcggcauuuucucuguagaggguaagucaugcaucaauagguguuuuuauguugaguugauccgggggcgagaacaagagacccgcgugugguggacaaguaacagcauugucguguucugcggcacuuccggaaccuacggcacagggucuuggccugacggagcgaauauaaaccugaugccaaucuga

SEQ ID NO: 136719 - RNA, 1410 nt, Artificial Sequence
  derived and/or modified sequence opt3 from neuraminidase__InfluenzaA__ABC67579
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaaccugcagaguacaggaauuggucaaagccacagugcaaaaucacaggguucgcccccuuuaguaaggacaacagcauacggcuguccgcgggaggugauauuugggugacccgcgagccuuaugucucuugugacccagauaagugcuaccaauucgcucuaggccaggggacgacucucaauaacggacauucgaaugacaccgugcacgaucgaacacccuaucguacucugcuuaugaacgaacugggcguuccuuuucauuuggguaccaaacagguguguaucgccuggucaagcaguuccugccacgacgggaaggcauggcuccaugucugugugacaggacacgaugagaaugccaccgcuucuuucauuuacgacggcagacugguagauagcaucggcuccuggaguaaaaagauccugaggacgcaggaaucagagugcguuuguauuaacgggacuugcacaguggucaugaccgacggaagcgcaucuggucgggccgauacuaaaauacucuuuaucgaggaaggcaagauugugcacaucucccaauuaucagggagcgcucagcauguggaggaaugcaguuguuauccacgcuacccgggagucagaugcguuuguagggacaauuggaagggcucuaaccggcccauaguggauauuaacguaaaagaccacuccaucgugagcucguacgucugcucuggucuggugggggacacaccucgcaagaaugauuccucaaguagcucccauugucuuaacccaaauaacgaggaaggaggccacggcguuaaagggugggccuucgacgauggaaaugacguguggaugggucgaaccaucucugagaaguugagaagcggcuaugagacguuuaaagucauugaaggguggucaaagcccaacaguaaacugcagaucaauaggcaagugauuguagaucggggaaaccguuccggcuacagcgguauauucucuguugaggggaagucaugcaucaaucgcuguuuuuauguggaacuaauuagaggcaggaagcaggagaccgaagucugguggacaaguaacagcaucguggucuucugcggaacuuccggcaccuacgggacaggaucuuggccugacggugcggauaucaaucucaugccaauuuga

SEQ ID NO: 136720 - RNA, 1410 nt, Artificial Sequence; identical to SEQ ID NO: 136343
  derived and/or modified sequence opt3 from neuraminidase__InfluenzaA__ABC67590

SEQ ID NO: 136721 - RNA, 1410 nt, Artificial Sequence; identical to SEQ ID NO: 136343
  derived and/or modified sequence opt3 from neuraminidase__InfluenzaA__ABC67601

SEQ ID NO: 136722 - RNA, 1410 nt, Artificial Sequence; identical to SEQ ID NO: 136182
  derived and/or modified sequence opt3 from neuraminidase__InfluenzaA__ABC67612

SEQ ID NO: 136723 - RNA, 1410 nt, Artificial Sequence; identical to SEQ ID NO: 136182
  derived and/or modified sequence opt3 from neuraminidase__InfluenzaA__ABC67623

SEQ ID NO: 136724 - RNA, 1410 nt, Artificial Sequence
  derived and/or modified sequence opt3 from neuraminidase__InfluenzaA__ABC67634
augaaccccaaucagaagaucauuaccauaggcagcgugucccugacaaucgccacuauuugcuuccucaugcagaucgcuauucuugucacgaccguuacacugcacuuuaaacaguacgaguguaacccuccaccgaauaaccaggugauguugugcgaacccacuaucauagagagaaauaucaccgaaauuguauauuuaacaaacaccacuaucgagaaggaaauuuguccuaaacuggcagaguacaggaauuggucuaagccacagugcaacaucacaggguucgcccccuuuucaaaagacaauaguauacggcuaagcgcgggaggugauauuugggugacccgcgagccuuaugucuccugugacccagauaagugcuaccaauucgcucucggccaggggacgacucugaacaauggacauucuaacgacaccgugcacgaucgaacacccuaucguacucuucugaugaaugaauugggcguuccuuuucaucucgguaccagacagguguguaucgccuggucgucaagcaguugccacgacgggaaggcauggcugcaugucugugugacaggagaugacgagaacgccaccgcuuccuucauuuacaauggcaggcugguagauucuaucggcagcugguccaaaaagauccuccggacgcaggaaucagagugcguuuguauuaacgggacuugcacaguggucaugaccgacggaagugcaagcgguaaagccgauacuaagauauuauuuaucgaggaaggcaaaauugugcacaucucuacacuguccgggucagcucaacacguggaggaaugcagcuguuauccacgcuacccgggagucagaugcguuuguagggacaacuggaagggcaguaaucggcccauaguggauauuaacguaaaggacuacucuaucguguccagcuaugucugcucgggucuugugggggacaccccucgcaaaaaugauucuuucuccucaagucauuguuuggacccaaacaaugaggaaggaggccacggcguuaaggggugggccuuugaugacggaaacgauguguggaugggucgaacgaucagcgagaaacugagauccggcuacgagaccuucaaggucauugaaggguggucuaaacccaauagcaagcuacagacaaacaggcaagugaucguagagcggggaaaucguucaggcuauagugguauauuuuccguugaagggaaaagcugcauuaaccgcuguuucuacguggagcucaucagaggcaggaaggaagagacugaggucugguggaccucuaauucaauuguggucuuuugcggaacaaguggcacuuaugggaccggaagcuggccugacggugcggauaucaaccugaugccaaucuga

SEQ ID NO: 136725 - RNA, 1410 nt, Artificial Sequence; identical to SEQ ID NO: 136182
  derived and/or modified sequence opt3 from neuraminidase__InfluenzaA__ABC67645

SEQ ID NO: 136726 - RNA, 1410 nt, Artificial Sequence; identical to SEQ ID NO: 136182
  derived and/or modified sequence opt3 from neuraminidase__InfluenzaA__ABC67656

SEQ ID NO: 136727 - RNA, 1410 nt, Artificial Sequence
  derived and/or modified sequence opt3 from neuraminidase__InfluenzaA__ABC67700
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauuccaacagcaagcugcagauuaauagacaggugauaguagacaggggcaaccggucuggguauucaggaaucuucaguguugagggcaaaagcuguauuaaucguugcuuuuacguggaacuaauccgcgguagaaaggaggaaacugagguccucuggaccuccaacucuaucguggucuucugugggacaucgggcacuuauggaaccggcagcuggccagauggggccgacauuaaucugaugcccauauga

SEQ ID NO: 136728 - RNA, 1410 nt, Artificial Sequence
  derived and/or modified sequence opt3 from neuraminidase__InfluenzaA__ABC67711
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagauuaauagacaggugauaguagacaggggcaaccggagcggguauucuggaaucuucucaguugagggcaaaaguuguauuaaucguugcuuuuacguggaacuaauccgcgguagaaaggaggaaacugagguccucuggaccagcaacuccaucguggucuucugugggacaucuggcacuuauggaaccggcucguggcccgauggggccgacauuaaucugaugccuauauga

SEQ ID NO: 136729 - RNA, 1410 nt, Artificial Sequence
  derived and/or modified sequence opt3 from neuraminidase__InfluenzaA__ABC67736
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcgucgcuuggagcaguuccucuugucacgacgguaaggccuggcuccaugugugcguaacaggggaugacaagaacgcaaccgccagcuucauuuacaauggaagacugguugauuccaucgugucauggaguaaagagauccugaggacgcaggaaagcgagugugucugcauuaacggcacuuguacaguggugaugaccgacggcucugcuuccgggaaggcagauacuaaaauacucuuuaucgaggaaggaaagauuguccacacaucaaccuuaagcgguagugcccaacacguugaggaaugcucuugcuauccucgguacccaggcgugcgcuguguaugcagagacaacuggaagggguccaauaggccgaucguggauauaaacauuaaagacuacagcaucgucucgucuuauguguguuccggacugguuggcgacacgccccggaagaaugauucaaguagcuccucucauugccuugacccuaacaaugaggaaggugggcacggagugaaaggcugggcuuucgaugacggcaacgaugucuggauggggcgcaccaucagcgagaaguugcgaucaggauacgagacauuuaaagugauugaagguuggaguaauccaaacuccaagcugcagaucaauagacagguaauuguugacaggggcaaccggagcggguauucuggaauauucucaguggagggcaaaaguuguaucaaucguugcuuuuacgucgaacuaauucgcgguagaaaggaggaaacugaggugcucuggaccagcaacuccaucgucguguucugugggacaucuggcacuuauggaaccggcucguggcccgauggggccgacaucaaucugaugccuauuuga

SEQ ID NO: 136730 - RNA, 1410 nt, Artificial Sequence
  derived and/or modified sequence opt3 from neuraminidase__InfluenzaA__ABC67809
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgacucaaguagcuccucucauugccuugauccuaauaacgaagagggugggcacggaguuaagggcugggcuuucgacgauggcaaugacguguggauggggcgcaccauuagcgaaaaauugcgaucaggauacgagacauuuaaggucaucgaggguuggaguaacccaaauuccaaacugcagauuaacagacaggugauaguagauaggggcaaucggagcggguauucuggaaucuucucaguugaaggcaagaguuguauuaaccguugcuuuuacguggagcuaauccgcgguagaaaggaagagacugaaguccucuggaccagcaauuccaucguggucuucugugggacaucuggcacuuauggaaccggcucguggcccgacggggccgauauuaaccugaugccuauauga

SEQ ID NO: 136731 - RNA, 1410 nt, Artificial Sequence; identical to SEQ ID NO: 136607
  derived and/or modified sequence opt3 from neuraminidase__InfluenzaA__ABC67820

SEQ ID NO: 136732 - RNA, 1410 nt, Artificial Sequence; identical to SEQ ID NO: 136586
  derived and/or modified sequence opt3 from neuraminidase__InfluenzaA__ABC67842

SEQ ID NO: 136733 - RNA, 1410 nt, Artificial Sequence; identical to SEQ ID NO: 136182
  derived and/or modified sequence opt3 from neuraminidase__InfluenzaA__ABC67853

SEQ ID NO: 136734 - RNA, 1410 nt, Artificial Sequence; identical to SEQ ID NO: 136586
  derived and/or modified sequence opt3 from neuraminidase__InfluenzaA__ABC67864

SEQ ID NO: 136735 - RNA, 1410 nt, Artificial Sequence; identical to SEQ ID NO: 136705
  derived and/or modified sequence opt3 from neuraminidase__InfluenzaA__ABC67886

SEQ ID NO: 136736 - RNA, 1410 nt, Artificial Sequence; identical to SEQ ID NO: 136182
  derived and/or modified sequence opt3 from neuraminidase__InfluenzaA__ABC67897

SEQ ID NO: 136737 - RNA, 1410 nt, Artificial Sequence; identical to SEQ ID NO: 136182
  derived and/or modified sequence opt3 from neuraminidase__InfluenzaA__ABC67970

SEQ ID NO: 136738 - RNA, 1410 nt, Artificial Sequence
  derived and/or modified sequence opt3 from neuraminidase__InfluenzaA__ABC67981
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucaguacccaggaguccgcugcguuuguagagacaacuggaagggcucuaauaggccgauaguggauauuaacguaaaggacuacuccaucgugagcucguaugucugcucuggucuugugggggacacgccccggaaaaaugauuccuucucaaguagccauuguuuggacccuaacaaugaggaaggaggccacggcguuaaggggugggccuuugaugacggaaacgauguguggaugggucgcaccaucuccgagaaacugcgaucuggcuacgagaccuucaaggucauugaaggguggagcaaaccaaauucaaagcuacagacaaacagacaggugaucguagagaggggaaaucggaguggcuauuccgguauuuuuagcguugaagggaaaucuugcauaaaccguuguuucuacguggagcucauccgcggcagaaaggaagagacugaggucugguggaccucaaauaguauuguggucuuuugcggaacaagcggcacuuaugggaccggauccuggcccgacggugcggauaucaaccugaugccuaucuga

SEQ ID NO: 136739 - RNA, 1410 nt, Artificial Sequence
  derived and/or modified sequence opt3 from neuraminidase__InfluenzaA__ABC67992
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacccccaggaaaaauaacuccuucucaaguagccauuguuuggauccuaauaacgaggaaggaggccacggcguuaaggggugggccuuugacgauggaaaugacguguggaugggucgaacgaucuccgagaaacugagaucuggcuacgagaccuucaaggucauugaaggguggagcaaaccaaacucaaagcuacagacaaaucgccaggugaucguagagcggggaaaccguaguggcuauuccgguauuuuuagcguugaagggaaaucuugcauaaaucgcuguuucuacguggagcucaucagaggcaggaaggaagagauugaggucugguggacuucaaacaguaucguggucuuuugcggaaccagcggcacauaugggacuggauccuggcccgauggugcggacaucaaucugaugccuauuuga

SEQ ID NO: 136740 - RNA, 1410 nt, Artificial Sequence; identical to SEQ ID NO: 136705
  derived and/or modified sequence opt3 from neuraminidase__InfluenzaA__ABC68003

SEQ ID NO: 136741 - RNA, 1410 nt, Artificial Sequence
  derived and/or modified sequence opt3 from neuraminidase__InfluenzaA__ABC68052
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugauagacggaagcgcaucugguaaagccgauaccaagaucuuauuuauugaggaaggcaaaaucgugcacauauccacucugucagggagcgcucaacacguggaggaaugcaguuguuauccucgcuacccaggagucagaugcguuuguagggacaacuggaagggcucuaaucggccgauuguggauaucaacguaaaggacuacuccaucgugagcucguaugucugcucuggucuugugggggacacaccccgcaaaaaugauuccuucucaaguagccauuguuuggacccuaacaaugaggaaggaggccacggcguuaaggggugggccuuugaugacggaaacgauguguggaugggucgaaccauuuccgagaaacugagaucuggcuacgagacguucaaggucaucgaaggguggagcaaaccaaauucaaagcuacagaccaacaggcaagugauuguagagcggggaaaucguaguggcuauuccgguauauuuagcguugaagggaaaucuugcaucaaccgcuguuucuacguggagcucauuagaggcaggaaggaagagacagaggucugguggacuucaaauaguaucguggucuuuugcggaaccagcggcacauaugggacuggauccuggcccgacggugcggauaucaaccugaugccuauuuga

SEQ ID NO: 136742 - RNA, 1410 nt, Artificial Sequence; identical to SEQ ID NO: 136182
  derived and/or modified sequence opt3 from neuraminidase__InfluenzaA__ABC68063

SEQ ID NO: 136743 - RNA, 1410 nt, Artificial Sequence; identical to SEQ ID NO: 136182
  derived and/or modified sequence opt3 from neuraminidase__InfluenzaA__ABC68074

SEQ ID NO: 136744 - RNA, 1410 nt, Artificial Sequence; identical to SEQ ID NO: 136728
  derived and/or modified sequence opt3 from neuraminidase__InfluenzaA__ABC68085

SEQ ID NO: 136745 - RNA, 1410 nt, Artificial Sequence
  derived and/or modified sequence opt3 from neuraminidase__InfluenzaA__ABC68096
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacccccaggaaaaaugauuccuucucaaguagccauuguuuggacccuaacaaugaggaaggaggccacggcguuaaggggugggccuuugaugacggaaacgauguguggaugggucgaacgaucuccgagaaacugagaucuggcuacgagaccuucaaggucauugaaggguggagcaaaccaaauucaaagcuacauaucaaccgccaggugauuguagagcggggaaaucguaguggcuauuccgguauauuuagcguugaagggaaaucuugcaucaaccgcuguuucuacguggagcucauuagaggcaggaaggaagagacagaggucugguggacuucaaauaguaucguggucuuuugcggaaccagcggcacauaugggacuggauccuggcccgacggugcggauaucaaccugaugccuauuuga

SEQ ID NO: 136746 - RNA, 1410 nt, Artificial Sequence
  derived and/or modified sequence opt3 from neuraminidase__InfluenzaA__ABC68225
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacguaaaagacuacagcauugugucgucuuaugucugcuccggucuugugggggacacgccccggaagaaugauucaaguagcuccucucauuguuuggacccuaacaaugaggaaggaggccacggcguuaaagggugggccuucgaugacggaaacgauguguggaugggucgcaccaucagcgagaagcugcgaucaggcuacgagaccuuuaaagucaucgaaggguggaguaagccaaauuccaaacuacagauuaacagacaggugaucguagacaggggaaaucggagcggcuauucugguauuuucucaguugagaguaagagcugcauaaaccguuguuuuuacguggaacucauccgcgggagaaagcaggagacagaaguccuguggacuuccaauucuauuguggucuucugcggcaccucgggaacauauggcacugggagcuggcccgauggagcggacaucaaccuuaugccuaucuga

SEQ ID NO: 136747 - RNA, 1410 nt, Artificial Sequence; identical to SEQ ID NO: 136535
  derived and/or modified sequence opt3 from neuraminidase__InfluenzaA__ABC68236

SEQ ID NO: 136748 - RNA, 1350 nt, Artificial Sequence
  derived and/or modified sequence opt3 from neuraminidase__InfluenzaA__ABC72646
augaaccccaauaagaaaaucauuaccauaggcagcaucugcauggugacagggauggucucccugaugcuccagauuggaaaccuuaucucuauuuggguuucacacaguauccauacugguaaucaacagaaggccgagccuauaagcaacacgaauuuccugaccgaaaaagcuguggcauccguaaaguuggccggcaacucuucguuauguccaaucaaugggugggcgguguacucaaaagacaacagcauuagaaucggaaguaagggcgaugucuuugugauuagggagccguucaucuccugcucucaccuggaaugucggacauuuuuccuaacucaggguagccuccugaaugacaagcauuccaacgggaccguuaaagaucgcucaccccaccgaacacuuaugaguugcccugugggagaggcuccaagccccuauaauucucguuuugaauccgucgccuggucagcaagcgccugucaugacggcaccaguuggcugacuauaggcauuucugggccugauuccggagcuguggcaguauugaaguacaacgguaucauuacagacaccaucaaaagcuggagaaauaacauccucaggacgcaggagucggagugcgccuguguuaauggcucuugcuucacugugaugaccgaugggccauccaacggacaggcuucacacaagauuuuuaaaauggacaagggcaaggucgugaaaaguguggaacuggaugcccccaacuaucacuacgaggaauguagcugcuauccugacgcgggugagauaacaugugucugccgggauaauuggcauggguccaaccgcccauggguuucuuucaaucaaaaccuggaguaccagaucggauauauuugcagcggcguguuuggcgacacuccgagacccaaugaugggaccggaucaugugguccuguaaguuccaacggcacauacggggugaagggauucagcuuuaaauacggcaauggugucuggaucgggaggaccaagucuacgaacucacggaguggcuucgaaaugauaugggacccaaauggauggacugagacagacagcuccuuuucugugaaacaggauauuguugcaaucaccgacuggucgggcuauagcggguccuucgugcaacaccccgaacucacuggauuagauugcauccgcccuuguuucugggucgagcugauucgagguagaccaaaggaaucaacaaucuggaccaguggcucuagcauuuccuuuugcggggugaacucagacacgguaggauggagcuggcccgauggcgccgagcuuccguucaccauagacaaauga

SEQ ID NO: 136749 - RNA, 1410 nt, Artificial Sequence; identical to SEQ ID NO: 136111
  derived and/or modified sequence opt3 from neuraminidase__InfluenzaA__ABC84392

SEQ ID NO: 136750 - RNA, 1410 nt, Artificial Sequence; identical to SEQ ID NO: 136525
  derived and/or modified sequence opt3 from neuraminidase__InfluenzaA__ABC84403

SEQ ID NO: 136751 - RNA, 1410 nt, Artificial Sequence; identical to SEQ ID NO: 136530
  derived and/or modified sequence opt3 from neuraminidase__InfluenzaA__ABC84414

SEQ ID NO: 136752 - RNA, 1410 nt, Artificial Sequence
  derived and/or modified sequence opt3 from neuraminidase__InfluenzaA__ABC84425
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuugauccuaauaacgaggaaggugggcacggaguuaaaggcugggcuuucgacgauggcaaugacguguggauggggcgcaccauuagcgagaaguugcgaucaggauacgagacauuuaaagucaucgaagguuggaguaacccaaauuccaagcugcagauuaacagacaggugauaguagauaggggcaaucggagcggguauucuggaaucuucucaguugagggcaaaaacuguauuaaucguugcuuuuacguggaacuaauccgcgguagaaaggaggaaacugagguccucuggaccaguaacagcaucguggucuucugugggacauccggcacuuauggaaccggcucuuggcccgacggggccgauauuaaucugaugccuauauga

SEQ ID NO: 136753 - RNA, 1410 nt, Artificial Sequence; identical to SEQ ID NO: 136343
  derived and/or modified sequence opt3 from neuraminidase__InfluenzaA__ABC84436

SEQ ID NO: 136754 - RNA, 1410 nt, Artificial Sequence
  derived and/or modified sequence opt3 from neuraminidase__InfluenzaA__ABC84447
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguacauuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacgagaacgccaccgcuucuuucauuuauaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacauguggaggaaugcaguuguuacccucgcuauccaggagucagaugcguuuguagggacaacuggaagggcucuaaucggccgauaguggauauuaacguaaaggacuacuccaucgugagcucguacgucugcucuggucuugugggggacacccccaggaaaaaugauuccuucucaaguagccacuguuuggacccuaacaaugaggaaggaggccauggcguuaaggggugggccuuugaugacggaaacgauguguggaugggucgaacgaucuccgagaaacugagaucuggcuaugagaccuucaaggucauugaaggguggagcaaaccaaauucaaagcuacagacaaaccgccaggugaucguagagcggggaaaucguaguggcuacuccgguauuuuuagcguugaagggaaaucuugcauaaaccgcuguuucuauguggagcucaucagaggcaggaaggaagagacugaggucugguggaccucaaauaguauuguggucuuuugcggaacaagcggcacuuacgggaccggauccuggcccgacggugcggauaucaaccugaugccuaucuga

SEQ ID NO: 136755 - RNA, 1410 nt, Artificial Sequence; identical to SEQ ID NO: 136730
  derived and/or modified sequence opt3 from neuraminidase__InfluenzaA__ABC84501

SEQ ID NO: 136756 - RNA, 1410 nt, Artificial Sequence; identical to SEQ ID NO: 136730
  derived and/or modified sequence opt3 from neuraminidase__InfluenzaA__ABC84512

SEQ ID NO: 136757 - RNA, 1410 nt, Artificial Sequence
  derived and/or modified sequence opt3 from neuraminidase__InfluenzaA__ABC84523
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacuggcugauuccaucguaucauggaguaaagagauucugaggacgcaggaaagcgaguguguuugcauaaacggcacuuguacaguggucaugaccgacggcucugcauccgggaaggccgauacuaaaauccucuuuauugaggaaggaaagaucgugcacacaucaaccuuaagcgguagugcucaacacguggaggaaugcucuugcuauccucgguacccaggcguccgcuguguuugcagagacaacuggaagggguccaauaggccgauaguggauauuaacaucaaagacuacagcaucguaucgucuuauguguguuccggacuggucggcgacacgccccggaagaaugauucaaguagcuccucucauugccuugacccuaacaaugaggaaggugggcacggagugaaaggcugggccuucgaugacggcaacgauguuuggauggggcgcaccauuagcgagaaguugcgaucaggauacgagacauuuaaagugaucgaagguuggaguaauccaaacuccaagcugcagauuaauagacaggucauaguggacaggggcaaccggagcggguauucuggaaucuucucaguagagggcaaaaguuguauuaaucguugcuuuuacguugaacuaauccgcgguagaaaggaggaaacugaggugcucuggaccagcaacuccaucgucguguucugugggacaucuggcacuuauggaaccggcucguggcccgauggggcggacauuaaucugaugccuauauga

SEQ ID NO: 136758 - RNA, 1410 nt, Artificial Sequence
  derived and/or modified sequence opt3 from neuraminidase__InfluenzaA__ABC84545
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaagcgcaucugguuccgccgacaccaagauucucuuuaucgaggagggcaaaauagugcacauuucaccuuuaagcgggagugcucagcauguggaagagugcucuuguuauccacgcuacccgggagucagaugcaucuguagggauaacuggaagggcuccaaucggcccguuguggacaucaacguaaaggaccacagcauugauucgucuuacgugugcuccggucuggucggggacacuccucgcaacaaugaucgaucaaguaacagcuauuguagaaauccaaacaaugaaaaaggaaaccauggcgugaagggcugggccuucgacgaugggaaugacguuuggaugggaaggacaaucuccgaggauucucggagcgguuacgaaaccuuuaaagugauuggcggguggucaacgcccaacaguaaacuucagauaaaucgucaggucaucguggacuccgauaaccgcagcggauauucuggcauuuucucaguagaggguaagaguugcaucaauagauguuuuuacguugaguugaucagggggcgggaacaagagacccgagugugguggacaagcaacuccauugucguguucugcggcacuucuggaaccuauggcacagggucguggccugacggagcggauauaaaucugaugccaaucuga

SEQ ID NO: 136759 - RNA, 1410 nt, Artificial Sequence; identical to SEQ ID NO: 136746
  derived and/or modified sequence opt3 from neuraminidase__InfluenzaA__ABC84574

SEQ ID NO: 136760 - RNA, 1410 nt, Artificial Sequence; identical to SEQ ID NO: 136746
  derived and/or modified sequence opt3 from neuraminidase__InfluenzaA__ABC85757

SEQ ID NO: 136761 - RNA, 1410 nt, Artificial Sequence; identical to SEQ ID NO: 136757
  derived and/or modified sequence opt3 from neuraminidase__InfluenzaA__ABC85768

SEQ ID NO: 136762 - RNA, 1410 nt, Artificial Sequence; identical to SEQ ID NO: 136746
  derived and/or modified sequence opt3 from neuraminidase__InfluenzaA__ABC85779

SEQ ID NO: 136763 - RNA, 1410 nt, Artificial Sequence; identical to SEQ ID NO: 136746
  derived and/or modified sequence opt3 from neuraminidase__InfluenzaA__ABC85790

SEQ ID NO: 136764 - RNA, 1410 nt, Artificial Sequence; identical to SEQ ID NO: 136730
  derived and/or modified sequence opt3 from neuraminidase__InfluenzaA__ABC85801

SEQ ID NO: 136765 - RNA, 1410 nt, Artificial Sequence; identical to SEQ ID NO: 136730
  derived and/or modified sequence opt3 from neuraminidase__InfluenzaA__ABC85812

SEQ ID NO: 136766 - RNA, 1410 nt, Artificial Sequence; identical to SEQ ID NO: 136757
  derived and/or modified sequence opt3 from neuraminidase__InfluenzaA__ABC85823

SEQ ID NO: 136767 - RNA, 1410 nt, Artificial Sequence; identical to SEQ ID NO: 136729
  derived and/or modified sequence opt3 from neuraminidase__InfluenzaA__ABC85834

SEQ ID NO: 136768 - RNA, 1410 nt, Artificial Sequence; identical to SEQ ID NO: 136730
  derived and/or modified sequence opt3 from neuraminidase__InfluenzaA__ABC85845

SEQ ID NO: 136769 - RNA, 1410 nt, Artificial Sequence; identical to SEQ ID NO: 136757
  derived and/or modified sequence opt3 from neuraminidase__InfluenzaA__ABC85856

SEQ ID NO: 136770 - RNA, 1410 nt, Artificial Sequence; identical to SEQ ID NO: 136729
  derived and/or modified sequence opt3 from neuraminidase__InfluenzaA__ABC85867

SEQ ID NO: 136771 - RNA, 1410 nt, Artificial Sequence; identical to SEQ ID NO: 136728
  derived and/or modified sequence opt3 from neuraminidase__InfluenzaA__ABC85900

SEQ ID NO: 136772 - RNA, 1410 nt, Artificial Sequence
  derived and/or modified sequence opt3 from neuraminidase__InfluenzaA__ABC85911
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacgccccgcaaaaaugauuccuucucaaguagccauuguuuggacccuaacaaugaggaaggaggccacggcguuaaggggugggccuuugaugacggaaacgauauguggaugggucgaaccaucuccgagaaacugagaucuggcuacgagaccuucaaggugauugaaggguggagcaaaccaaauucaaagcuacagacaaacaggcaggucaucguggagcggggaaaucguaguggcuauuccgguauuuuuagcguagaagggaaaucuugcauaaaccgcuguuucuacguugagcucaucagaggcaggaaggaagagacugaggugugguggaccucaaauaguauugucguguuuugcggaacaagcggcacuuaugggaccggauccuggcccgacggugcggauaucaaccugaugccuaucuga

SEQ ID NO: 136773 - RNA, 1410 nt, Artificial Sequence
  derived and/or modified sequence opt3 from neuraminidase__InfluenzaA__ABC85922
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaccaucgagagaaauauaacagaaaucguauauuuaaccaacacuacaauugagaaggaaaucugucccaaacuggcagaguacaggaauuggucaaagccucagugcaacauuaccggguucgccccauuuaguaaagacaauagcauccggcuauccgcgggaggugauauaugggugacgcgcgagcccuaugucucuugugacucggauaagugcuaccaauucgcucucggccaggggacuacccugaacaauggacauucaaacgacacagugcacgaucgaacuccuuaucguacccuucugaugaaugaauugggcguuccauuucaucucgguacaagacagguguguauugccuggagcaguuccucuugccacgacgggaaggcauggcugcaugucugugugaccggagaugacgagaacgccacggcuagcuucaucuacaauggcaggcugguagauuccauuggcucauggaguaaaaagauccuccggacucaggaaagcgagugcguuuguaucaacgggacaugcaccguggucaugacugacggaucugcauccgguaaagccgauacaaagauuuuauuuauagaggaaggcaaaaucgugcacauuucaacccugagcgggagugcucaacacguggaggaaugcucuuguuauccccgcuacccuggagucagaugcguuuguagggacaacuggaagggcuccaaucggccaaucguggauauaaacguaaaggacuacagcauugugucgucuuaugucugcuccggucuugugggggacacgccgcgcaaaaaugauucauucaguagcucccauuguuuggaccccaacaaugaggaaggaggccacggcguuaaggggugggccuuugaugacggaaacgauguguggaugggucgaaccaucucugagaaacugagaagcggcuacgagacauucaaggucaucgaaggguggucaaaaccuaauaguaagcuacagacuaacaggcaagugauuguagagcggggaaaucguuccggcuauagcgguaucuuuucuguugaagggaaaucaugcauuaaccgcuguuucuacguggagcucauaagaggcaggaaggaagagaccgaggucugguggacaaguaauagcaucguggucuuuugcggaacuuccggcaccuaugggacaggaucuuggccagacggugcggauauuaaccugaugcccaucuga

SEQ ID NO: 136774 - RNA, 1410 nt, Artificial Sequence; identical to SEQ ID NO: 136182
  derived and/or modified sequence opt3 from neuraminidase__InfluenzaA__ABC85933

SEQ ID NO: 136775 - RNA, 1410 nt, Artificial Sequence
  derived and/or modified sequence opt3 from neuraminidase__InfluenzaA__ABC85955
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacccccaggaaaaaugauuccuucucaaguagccauuguuuggacccuaacaaugaggaaggaggccacggcguuaaggggugggccuuugaugacggaaacgauguguggaugggucgaacgaucuccgagaaacugagaucuggcuacgagaccuucaaggucauugaaggguggagcaaaccaaauucaaagcuacagacaaaccgccaggugaucguagagcggggaaaucguaguggcuauuccgguauuuuuagcguugaagggaaaucuugcauaaaccgcuguuucuacguggagcucaucagaggcaggaaggaagagacugaggucugguggaccucaaauaguauuguggucuuuugcggaacaagcggcacuuaugggaccggauccuggcccgacggugcggauaucaaccggaugccuaucuga

SEQ ID NO: 136776 - RNA, 1410 nt, Artificial Sequence; identical to SEQ ID NO: 136182
  derived and/or modified sequence opt3 from neuraminidase__InfluenzaA__ABC85966

SEQ ID NO: 136777 - RNA, 1410 nt, Artificial Sequence; identical to SEQ ID NO: 136182
  derived and/or modified sequence opt3 from neuraminidase__InfluenzaA__ABC85977

SEQ ID NO: 136778 - RNA, 1410 nt, Artificial Sequence
  derived and/or modified sequence opt3 from neuraminidase__InfluenzaA__ABC85988
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggggauuugucccaaacuggcagaauacaggaauuggucaaagccucagugcaacaucacaggauucgccccauuuaguaaagacaauagcauacggcuauccgcggguggcgauauuugggugacccgcgagcccuaugucucuugugacccugauaagugcuaccaauucgcucucgggcagggaacgacucugaacaauggccauucgaacgacaccgugcacgaucgaacaccauaucguacucuucugaugaaugaguuggguguucccuuucaucucgggaccagacagguguguaucgccuggucaagcaguuccugccacgacggaaaggcauggcugcaugucugugugacaggcgaugacgaaaacgccaccgcuucuuucauuuacaauggcaggcugguagauagcaucggguccuggaguaaaaagauccuccggacgcaggagucagaaugcguuuguauuaacggaacuugcacaguggucaugaccgacgguagcgcaucuggcaaagccgauacuaagauauuauuuaucgaggaggggaaaauugugcacaucuccacacugucaggaagcgcucaacacguggaagagugcaguuguuauccucgcuacccaggcgucagaugcguuuguagggacaacuggaaggguucuaaucggccgauaguggauauuaacguaaaggacuacuccaucgugagcucguaugucugcucugggcuugugggagacacccccaggaaaaaugauuccuucucaaguagccauuguuuggacccuaacaaugaagagggcggccacgggguuaagggaugggccuuugaugacgguaacgauguguggaugggccgaacgaucuccgaaaaacugagaucuggguacgagaccuucaaggucauugagggauggagcaaaccaaauucaaagcuacagacaaaccgccaggugaucguagaacggggcaaucguagugguuauuccgggauuuuuagcguugagggcaaaucuugcauaaaccgcuguuucuacguggaacucaucagaggaaggaaggaggaaacugaggucugguggaccucaaauaguauuguggucuuuugcggcacaagcgggacuuauggaaccgguuccuggcccgacggcgcggauaucaaccugaugccuaucuga

SEQ ID NO: 136779 - RNA, 1410 nt, Artificial Sequence; identical to SEQ ID NO: 136343
  derived and/or modified sequence opt3 from neuraminidase__InfluenzaA__ABC85999

SEQ ID NO: 136780 - RNA, 1410 nt, Artificial Sequence; identical to SEQ ID NO: 136343
  derived and/or modified sequence opt3 from neuraminidase__InfluenzaA__ABC86010

SEQ ID NO: 136781 - RNA, 1410 nt, Artificial Sequence
  derived and/or modified sequence opt3 from neuraminidase__InfluenzaA__ABC86021
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuugauccuaauaacgaggaaggugggcacggaguuaaaggcugggcuuucgacgauggcaaugacguguggauggggcgcaccauuagcgagaaguugcgaucaggauacgagacauuuaaagucaucgaagguuggaguaacccaaauuccaagcugcagauuaacagacaggugauaguagauaggggcaaucggagcggguauucuggaaucuucucaguugagggcaaaaguuguauuaaccguugcuuuuacguggaacuaauccgcgguagaaaggaggaaacugagguccucuggaccagcaauuccaucguggucuucugugggacaucuggcacuuauggaaccggcucguggcccgacggggccaacauuaaucugaugccuauauga

SEQ ID NO: 136782 - RNA, 1410 nt, Artificial Sequence; identical to SEQ ID NO: 136607
  derived and/or modified sequence opt3 from neuraminidase__InfluenzaA__ABC86127

SEQ ID NO: 136783 - RNA, 1410 nt, Artificial Sequence; identical to SEQ ID NO: 136690
  derived and/or modified sequence opt3 from neuraminidase__InfluenzaA__ABC86140

SEQ ID NO: 136784 - RNA, 1410 nt, Artificial Sequence; identical to SEQ ID NO: 136500
  derived and/or modified sequence opt3 from neuraminidase__InfluenzaA__ABC86151

SEQ ID NO: 136785 - RNA, 1413 nt, Artificial Sequence
  derived and/or modified sequence opt3 from neuraminidase__InfluenzaA__ABC86240
augaaccccaaucagaagaucauuaccauaggcagcaucuccguggccauugggaucauuucucugauccuccaaauaggaaacaucauuucaaucugggcuagucacagcauucagacagguucccagaauuacacuggcaucugcaaccagaaaauaauuacguaugagaauagaaccugggucaaccaaacauacguuaauaucaacaauacuaacgugguagcagggaaggacaaaaccucuaugacacuugccggaaauucgucacuguguccuauuaggggcugggcgaucuauaccaaggauaacagcauccggauugguaguaaaggggacguguucgucauacgcgaaccauuuaucuccugcucucauuuggagugucgaacuuucuuuuuaacacagggagcucugcuaaaugauaagcacagcaacggcaccauuaaggaccguuccccguucagagcccucaugucaugcccccugggcgaagcaccuaguccauacaauagcagguuugagucuguggccugguccgcuucagcaugucaugaugggcuuggauggcugacgaucgguauaagcggccccgacaacggggccguugcuguguugaaauauaacggaauuaucacugaaaccaucaagaguuggaaaaagcagauucuccggacacaggagucugagugcgucugugugaauggcuccugcuucacuaucaugaccgaugguccuagcaaccgcgccgcgucguacagaauuuuuaaaauagaaaaggggaggguaacaaagucuaucgagcuggacgcaccaaauuaucacuacgaagaguguuccugcuaccccgauaccggaacgguuaugugugugugccgggacaacuggcauggcucaaaucgcccuugggucaguuucaaccaaaaucuggauuaucagauuggcuacaucugcagcgggguguuuggagacaacccacgaccgaaagauggugagggcuccuguaaucccgugacugucgacggggccgacggaguuaagggcuucucuuauagauacgguaacgggguguggaucggcaggacaaaaagcaaucggcuccguaagggauuugaaaugauuugggauccuaacggcuggaccgacacugauucagacuucaguaugaaacaggauguaguggcuaugacagacugguccggguauagcggaucuuuuguccagcacccagaguuaaccggucuggauugcaugcgccccuguuucuggguggaacuuguuagaggcuugccuagggagaauacgaccauauggacaucagggaguagcaucuccuucugcggagugaacucugaaacugccaauuggucguggccagacggcgcagagcugcccuuuaccauugauaaguga

SEQ ID NO: 136786 - RNA, 1410 nt, Artificial Sequence
  derived and/or modified sequence opt3 from neuraminidase__InfluenzaA__ABC97377
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaagcgcaucugguuccgccgacaccaagauucucuuuaucgaggagggcaaaauagugcacauuucaccuuuaagcgggagugcucagcauguggaagagugcucuuguuauccacgcuacccgggagucagaugcaucuguagggauaacuggaagggcuccaaucggcccguuguggacaucaacguaaaggacuacagcauugauucgucuuaugugugcuccggucuggucggggacacuccucgcaacaaugaucgaucaaguaacagcuacuguagaaauccaaacaaugaaaaaggaaaccacggcgugaagggcugggccuucgacgaugggaaugacguuuggaugggaaggacaaucuccgaggauucucggagcgguuaugaaaccuuuaaagugauuggcggguggucaacgcccaacaguaaacuucagauaaaucgucaggucaucguggacuccgauaaccgcagcggauacucuggcauuuucucaguagaggguaagaguugcaucaauagauguuuuuauguugaguugaucagggggcgggaacaagagacccgagugugguggacaagcaacuccauugucguguucugcggcacuucuggaaccuacggcacagggucguggccugacggagcggauauaaaucugaugccaaucuga

SEQ ID NO: 136787 - RNA, 1410 nt, Artificial Sequence; identical to SEQ ID NO: 136153
  derived and/or modified sequence opt3 from neuraminidase__InfluenzaA__ABD15452

SEQ ID NO: 136788 - RNA, 1410 nt, Artificial Sequence; identical to SEQ ID NO: 136241
  derived and/or modified sequence opt3 from neuraminidase__InfluenzaA__ABD15463

SEQ ID NO: 136789 - RNA, 1410 nt, Artificial Sequence; identical to SEQ ID NO: 136161
  derived and/or modified sequence opt3 from neuraminidase__InfluenzaA__ABD15474

SEQ ID NO: 136790 - RNA, 1410 nt, Artificial Sequence
  derived and/or modified sequence opt3 from neuraminidase__InfluenzaA__ABD15485
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacaaaaacgccaccgcuucuuucauuuauaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauugugcacaucuccacacugucagggagcgcucaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacccccaggaagaaugauuccuucucaaguagccacuguuuggacccuaacaaugaagagggaggccauggcguuaaagggugggccuuugaugacggaaacgauguguggaugggucgaacgaucuccgaaaagcugagaucuggcuaugagaccuucaaagucauugagggguggagcaagccaaauucaaaacuacagaucaaccgccaggugauuguagaacggggaaaucguaguggcuacuccgguauauuuagcguugaggggaagucuugcaucaaccgcuguuucuauguggaacucauuagaggcaggaaggaggaaacagaggucugguggacuucaaauaguaucguggucuuuugcggaaccagcggcacauacgggacuggauccuggcccgacggugcgaacaucaaucugaugccuauuuga

SEQ ID NO: 136791 - RNA, 1410 nt, Artificial Sequence; identical to SEQ ID NO: 136241
  derived and/or modified sequence opt3 from neuraminidase__InfluenzaA__ABD15496

SEQ ID NO: 136792 - RNA, 1410 nt, Artificial Sequence; identical to SEQ ID NO: 136161
  derived and/or modified sequence opt3 from neuraminidase__InfluenzaA__ABD15507

SEQ ID NO: 136793 - RNA, 1413 nt, Artificial Sequence
  derived and/or modified sequence opt3 from neuraminidase__InfluenzaA__ABD15518
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacgggggagccucauacaaaaucuucaagauugaaaagggcaaaguuacaaagaguauagagcucaaugcgccuaacuuucacuaugaagaguguagcugcuacccagacaccggcacggugaugugugucugccgggauaauuggcacggguccaaccgccccugggugucuuucaaucagaaccuggacuaccagaucggauauauuugcagcgguguguuuggcgauaauccuagaccaaaagacgggaagggaucauguaacccggucacuguugauggcgcagacggugugaaaggguucaguuacaaguauggcaauggaguauggaucggcaggacaaaauccaaccggcugcgcaagggguuugagaugaucugggaccccaauggauggaccgauacugacagcgauuucucugugaagcaagacgucguggccauuacagauuggucagguuacaguggcagcuuuguucagcauccugaacucaccggguuagacugcauacgaccauguuucuggguggagcuggucagaggacuucccagggaaaacacgaccaucuggacauccgguucuucgauuagcuucugcggcguggauuccgacacugcuaauuggucauggccugauggggccgaguugccauuuaccaucgacaaauga

SEQ ID NO: 136794 - RNA, 1410 nt, Artificial Sequence; identical to SEQ ID NO: 136343
  derived and/or modified sequence opt3 from neuraminidase__InfluenzaA__ABD15529

SEQ ID NO: 136795 - RNA, 1410 nt, Artificial Sequence; identical to SEQ ID NO: 136530
  derived and/or modified sequence opt3 from neuraminidase__InfluenzaA__ABD15551

SEQ ID NO: 136796 - RNA, 1410 nt, Artificial Sequence
  derived and/or modified sequence opt3 from neuraminidase__InfluenzaA__ABD15562
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccugauaagugcuaccaauucgcucucggccaggggacgacucugaacaaucgacauucaaacgacaccgugcacgaucguacaccauauagaacucuucugaugaaugaauugggaguucccuuucaucucggcaccaaacagguguguaucgccuggagcaguuccucuugccacgacgguaaggcauggcugcaugucugugugacagggcacgaugagaacgccaccgcuagcuucauuuacgacggaaggcugguagauuccaucggcucauggaguaaaaagauccuccggacgcaggaaagcgagugcguuuguauuaauggcacuugcacaauagugaugaccgacgggucugcauccggacgcgccgauacuaaaaucuuauuuauugaggaagguaagaucguccacauaucaccucugagcggcagugcucaacauguggaggaaugcucuuguuauccaagauacccgggggugaggugcgucugucgggacaacuggaagggauccaaucgccccauuguugauaucaacgugaaagacuacagcaucguaucgucuuaugugugcuccggccuugucggugacacaccucgaaagaacgauucaaguagcuccucucacuguuugaauccaaacaaugaggaagggggacauggcgugaaaggcugggccuucgacgaugggaacgacguuuggaugggaagaaccauuagcgagaaguuuaggucagguuacgagacguucaaagugaucgaaggcuggaguaagcccaauuccaaacugcagauuaaccggcaggucauaguggaucgugggaaucgcagcggauauucuggcaucuuuucaguagaggguaagaguugcauuaacagauguuucuacguugaacuaaucagggggcggaagcaggagaccgaagugugguggacaagcaauuccaucgucguguuuugcggcacuucuggaaccuauggcacagggucguggccugacggagcggauauuaaccucaugccaauauga

SEQ ID NO: 136797 - RNA, 1410 nt, Artificial Sequence
  derived and/or modified sequence opt3 from neuraminidase__InfluenzaA__ABD15573
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaacggacauucgaaugacaccgugcacgaucgaacaccauaucguacucuucugaugaacgaauugggcguucccuuucaucucgguaccaaacagguguguauggccuggucaagcaguuccugccacgacgggaaggcauggcugcaugucugugugacaggacacgaugagaaugccaccgcuucuuucaucuacgacggcagacugguagauagcauuggcuccuggaguaaaaagauccucaggacgcaggaaucagagugcguuuguaucaacgggacuugcacaguggucaugaccgacggaagcgcaucuggucgggccgauacuaaaauuuuauuuauagaggaaggcaagaucgugcacauuucccaacugucagggagcgcucagcauguggaggaaugcaguuguuauccucgcuacccaggagucagaugcguuuguagggacaauuggaagggcucuaaccggccgaucguggauauaaacguaaaagaccacuccauugugagcucguacgucugcucuggucuugugggggacacaccccgcaagaaugauuccucaaguagcucccauuguuugaacccuaauaacgaggaaggaggccacggcguuaaagggugggccuucgacgauggaaaugacguguggaugggucgaaccaucucugagaagcugagaagcggcuaugagacguuuaaagucaucgaaggguggucaaagccaaacaguaaacuacagauuaauaggcaagugaucguagaucggggaaaccguuccggcuacagcgguauuuucucuguugaggggaagucaugcauaaaucgcuguuuuuauguggaacucaucagaggcaggaagcaggagaccgaagucugguggacaaguaacagcauuguggucuucugcggaacuuccggcaccuacgggacaggaucuuggcccgacggugcggauaucaaucugaugccuaucuga

SEQ ID NO: 136798 - RNA, 1410 nt, Artificial Sequence
  derived and/or modified sequence opt3 from neuraminidase__InfluenzaA__ABD15584
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccugauaagugcuaccaauucgcucucggccaggggacgacucugaacaaucgacauucaaacgacaccgugcacgaucguacaccauauagaacucuucugaugaaugaauugggaguucccuuucaucucggcaccaaacagguguguaucgccuggagcaguuccucuugccacgacgguaaggcauggcugcaugucugugugacagggcacgaugagaacgccaccgcuagcuucauuuacgacggaaggcugguagauuccaucggcucauggaguaaaaagauccuccggacgcaggaaagcgagugcguuuguauuaauggcacuugcacaguggucaugaccgacgggucugcauccggacgcgccgauacuaaaauauuauuuaucgaggaagguaagauugugcacaucucaccucugagcggcagugcucaacauguggaggaaugcucuuguuauccaagauacccgggggucaggugcguuugucgggacaacuggaagggauccaaucgccccauaguggauauuaacguaaaagacuacagcaucgugucgucuuaugucugcuccggccuugugggugacacaccucgaaagaacgauucaaguagcuccucucacuguuugaauccaaacaaugaggaagggggacauggcguuaaaggcugggccuucgacgaugagaacgacguguggauggggagaaccaucagcgagaaguuuaggucaggauacgaaacguucaaagucauugaggguuggaguaagcccaauuccaaacugcagaucaaccgucaggugauuguagaucggggcaaucgcagcggguauucuggaauauuuucaguugaaggcaagaguugcaucaacagauguuucuacguggagcuaauuaggggucggaagcaggaaaccgaggucugguggacaagcaauuccaucaucguguuuugcgggacuucuggcaccuauggaacaggcucguggccugacggggcggauauuaaccucaugccaauauga

SEQ ID NO: 136799 - RNA, 1410 nt, Artificial Sequence; identical to SEQ ID NO: 136530
  derived and/or modified sequence opt3 from neuraminidase__InfluenzaA__ABD15595

SEQ ID NO: 136800 - RNA, 1410 nt, Artificial Sequence; identical to SEQ ID NO: 136530
  derived and/or modified sequence opt3 from neuraminidase__InfluenzaA__ABD15606

SEQ ID NO: 136801 - RNA, 1410 nt, Artificial Sequence; identical to SEQ ID NO: 136530
  derived and/or modified sequence opt3 from neuraminidase__InfluenzaA__ABD15617

SEQ ID NO: 136802 - RNA, 1410 nt, Artificial Sequence; identical to SEQ ID NO: 136589
  derived and/or modified sequence opt3 from neuraminidase__InfluenzaA__ABD15639

SEQ ID NO: 136803 - RNA, 1410 nt, Artificial Sequence; identical to SEQ ID NO: 136746
  derived and/or modified sequence opt3 from neuraminidase__InfluenzaA__ABD15650

SEQ ID NO: 136804 - RNA, 1410 nt, Artificial Sequence; identical to SEQ ID NO: 136269
  derived and/or modified sequence opt3 from neuraminidase__InfluenzaA__ABD15661

SEQ ID NO: 136805 - RNA, 1410 nt, Artificial Sequence; identical to SEQ ID NO: 136746
  derived and/or modified sequence opt3 from neuraminidase__InfluenzaA__ABD15683

SEQ ID NO: 136806 - RNA, 1410 nt, Artificial Sequence; identical to SEQ ID NO: 136269
  derived and/or modified sequence opt3 from neuraminidase__InfluenzaA__ABD15694

SEQ ID NO: 136807 - RNA, 1410 nt, Artificial Sequence; identical to SEQ ID NO: 136746
  derived and/or modified sequence opt3 from neuraminidase__InfluenzaA__ABD15705

SEQ ID NO: 136808 - RNA, 1410 nt, Artificial Sequence; identical to SEQ ID NO: 136746
  derived and/or modified sequence opt3 from neuraminidase__InfluenzaA__ABD15727

SEQ ID NO: 136809 - RNA, 1410 nt, Artificial Sequence
  derived and/or modified sequence opt3 from neuraminidase__InfluenzaA__ABD15749
augaaccccaaucagaagaucauuaccauaggcagcgugucccugacaaucgccacuauuugcuuccucaugcaaaucgcuguccuuguuacgaccgugacacugcacuuuaaacaguacgaguguaacucuccuccaaauaaccagguaauguugugcgaaccgacuauuaucgagagaaauauaaccgaaaucguguauuuaacaaacaccacuauugagaaggaaaucugucccaaacuggcagaguacaggaauuggucaaagccucagugcaacauuacaggguucgccccauuuaguaaagacaauagcauccggcuauccgcgggaggugauauaugggucacccgcgagcccuaugugucuugugacccugauaagugcuaccaauucgcucucggccaggggacgacucugaacaauggacauucgaacgacaccguucacgaucgaacaccauaucguacucuucugaugaaugaauugggcgugcccuuucaucucgguaccaagcaggucuguauugccuggucaagcaguuccugccacgacgggaaagcauggcugcauguguguguaacaggagaugacgagaacgccaccgcuucuuucaucuacaauggcagacugguugauagcauuggcuccuggucaaagaaaauccucaggacgcaggaaagugagugcguguguaucaacgggacuugcacagucgugaugaccgacggaagcgcaucugguaaggccgauacuaaaauuuuauuuauagaggaaggcaagaucgugcacacaucccugcuuucagggagcgcucaacacgucgaggaaugcaguuguuauccucgguacccaggaguucgcugcguguguagagacaacuggaagggcucuaauaggccgauuguagauaucaacgugaaagacuacuccauagucagcucguaugugugcucugguuugguuggggacacuccccggaagaaugauuccucaaguagcucccauugucuggacccuaacaaugaggaaggaggccacggcgugaaagggugggccuucgaugacggaaacgaugucuggaugggucgcacgauuucugagaagcuacgaagcggcuacgagaccuuuaaagugaucgaaggguggucaaagccaaauaguaaacuccagaucaacagacagguaauuguugacaggggaaaucgguccggcuauagcgguaucuucucuguggaggggaagucaugcauuaaccguuguuuuuacgucgaacugauacgcggcagaaagcaggagacagaagugcuuuggaccaguaauagcaucgucguguucugcggaaccuccggcacauaugggacuggaucuuggcccgauggugcggacauuaaccugaugccuaucuga

SEQ ID NO: 136810 - RNA, 1410 nt, Artificial Sequence; identical to SEQ ID NO: 136809
  derived and/or modified sequence opt3 from neuraminidase__InfluenzaA__ABD15760

SEQ ID NO: 136811 - RNA, 1410 nt, Artificial Sequence; identical to SEQ ID NO: 136746
  derived and/or modified sequence opt3 from neuraminidase__InfluenzaA__ABD15771

SEQ ID NO: 136812 - RNA, 1410 nt, Artificial Sequence; identical to SEQ ID NO: 136746
  derived and/or modified sequence opt3 from neuraminidase__InfluenzaA__ABD15782

SEQ ID NO: 136813 - RNA, 1410 nt, Artificial Sequence; identical to SEQ ID NO: 136746
  derived and/or modified sequence opt3 from neuraminidase__InfluenzaA__ABD15793

SEQ ID NO: 136814 - RNA, 1410 nt, Artificial Sequence; identical to SEQ ID NO: 136730
  derived and/or modified sequence opt3 from neuraminidase__InfluenzaA__ABD16306

SEQ ID NO: 136815 - RNA, 1410 nt, Artificial Sequence
  derived and/or modified sequence opt3 from neuraminidase__InfluenzaA__ABD16317
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcgugacaggggaugacaagaacgcaaccgccagcuucaucuacaauggaaggcugguagauuccaucguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagacuacagcaucgugucgucuuaugucuguuccggacuggugggcgacacgccccgcaagaaugauucaaguagcuccucucacugccuugacccuaacaaugaggaaggugggcauggaguuaaaggcugggcuuucgaugacggcaacgauguguggauggggcgaaccauuagcgagaaguugagaucaggauacgagacauuuaaagucaucgaagguuggaguaauccaaacuccaagcugcagauuaauaggcaagugauaguagaccggggcaaccguagcggguauucuggaaucuucucaguugagggcaaaaguuguauuaaucgcugcuuuuacguggaacuaaucagagguaggaaggaggaaacugagguccucuggaccagcaacuccaucguggucuucugugggacaucuggcacuuauggaaccggcucguggcccgauggggccgacauuaaucugaugccuauauga

SEQ ID NO: 136816 - RNA, 1410 nt, Artificial Sequence; identical to SEQ ID NO: 136730
  derived and/or modified sequence opt3 from neuraminidase__InfluenzaA__ABD16328

SEQ ID NO: 136817 - RNA, 1410 nt, Artificial Sequence
  derived and/or modified sequence opt3 from neuraminidase__InfluenzaA__ABD16339
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgacucaaguagcuccggucauugccuugauccuaauaacgaagaagggggacacggcguuaagggcugggcuuucgacgaugggaaugacguguggaugggacgcaccauuucugagaaauugcgaagcgguuacgagacauuuaaggucaucgagggcuggucaaacccaaauaguaaacugcagauuaacagacaggugauaguagauagggggaaucgguccggauauagcggcaucuucucuguugaagguaagucauguauuaaccguugcuuuuacguggagcuaauccgcgggagaaaggaagagacugaaguccucuggaccaguaauagcaucguggucuucuguggcacauccggaacuuauggcaccgggucuuggcccgacggagccgauauuaaccugaugccuauauga

SEQ ID NO: 136818 - RNA, 1410 nt, Artificial Sequence
  derived and/or modified sequence opt3 from neuraminidase__InfluenzaA__ABD16361
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaaaacugguagacuccaucguuucauggaguaagaaaauucugagaacgcaggagagcgaaugugugugcauaaauggcacuuguacagucgugaugaccgauggcucugcuuccgggaaggcagacacuaagauccucuuuauugaggagggaaaaaucgugcacacaucaaccuuaagcgguagugcccaacacgucgaagagugcucuugcuauccuagguacccaggcguucggugugugugccgcgauaacuggaagggguccaacagaccgauaguagacauuaauaucaaagacuacagcaucgugucgucuuaugucuguuccggacuggugggcgauacgcccaggaagaacgacucaaguagcuccucucauugccuugauccuaauaacgaagagggugggcacggaguuaaaggcugggcuuucgacgauggcaaugacguguggauggggcggaccauuagcgaaaaguugcgcucaggauacgagacauuuaaagucaucgaggguuggaguaacccaaauuccaagcugcagauuaaccgacaggugauaguagauagaggcaauaggagcggguauucuggaaucuucucaguugaaggcaagaguuguauuaaccggugcuuuuacguggagcuaauccguggucgcaaagaagagacugaaguccucuggaccagcaauuccaucguggucuucugugggacaucuggcacuuauggaaccggcucguggcccgacggggccgauauuaaccugaugccuauauga

SEQ ID NO: 136819 - RNA, 1410 nt, Artificial Sequence; identical to SEQ ID NO: 136730
  derived and/or modified sequence opt3 from neuraminidase__InfluenzaA__ABD16475

SEQ ID NO: 136820 - RNA, 1410 nt, Artificial Sequence; identical to SEQ ID NO: 136730
  derived and/or modified sequence opt3 from neuraminidase__InfluenzaA__ABD16486

SEQ ID NO: 136821 - RNA, 1410 nt, Artificial Sequence; identical to SEQ ID NO: 136757
  derived and/or modified sequence opt3 from neuraminidase__InfluenzaA__ABD16497

SEQ ID NO: 136822 - RNA, 1410 nt, Artificial Sequence; identical to SEQ ID NO: 136730
  derived and/or modified sequence opt3 from neuraminidase__InfluenzaA__ABD16508

SEQ ID NO: 136823 - RNA, 1410 nt, Artificial Sequence
  derived and/or modified sequence opt3 from neuraminidase__InfluenzaA__ABD16519
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagauauucugaggacgcaggagagcgaaugugugugcauaaauggcacuuguacagucgugaugaccgacggcucugcuuccgggaaggcagauacuaaaauccucuuuauugaggagggaaagaucgugcacacaucaaccuuaagcgguagugcccaacacgucgaagagugcucuugcuauccucgguacccaggcguucgcugugugugcagagacaacuggaagggguccaacaggccgauaguagacauuaauaucaaagauuacagcaucgugucgucuuaugucuguuccggacuggugggcgacacgccccggaagaccgauucaaguagcuccucucauugccuugacccuaacaaugaagagggugggcacggaguuaaaggcugggcuuucgaugacggcaacgauguguggauggggcgcacaauuagcgaaaaguugcgacugggauacgagacuuuuaaagucaucgaggguuggucaaauccaaacaguaagcuacagauuaauagacaggugauaguagacaggggcaaccgguccggguauagcggaaucuucucuguugaaggcaaaucauguauuaaucguugcuuuuacguggagcucauccgcgguagaaaggaagagaccgaaguccuguggacaaguaacagcaucguggucuucugugggacuuccggcaccuauggaacaggcucuuggcccgauggggccgacauuaaucuuaugccuauauga

SEQ ID NO: 136824 - RNA, 1410 nt, Artificial Sequence
  derived and/or modified sequence opt3 from neuraminidase__InfluenzaA__ABD16530
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacugguggaguauaggaauuggucaaagccucagugcaacaucacaggguucgcaccauuuaguaaagacaauagcauacggcuauccgccggaggugauauuugggucacccgcgagcccuacgugucuugugacccugauaagugcuaucaauucgcgcucggccaggggacgacucugaacaauggacacucgaacgacaccguucaugaucgaacaccauaccguacucuucugaugaaugaauugggcgugcccuuucaccucgguaccagacaggucuguaucgcuuggucaagcaguuccugccaugacgggaaggccuggcugcacguguguguaacaggagaugacaaaaacgcaaccgccucuuucauuuauaauggcaggcugguugauagcaucggcuccuggucaaagaaaauccuccggacgcaggagagugaaugcguguguauuaacgggacuugcacagucgugaugaccgacggaagcgcuucugguaaggcagauacuaaaauauuauuuaucgaggagggcaagauugugcacaucuccacacugucagggagcgcccaacaugucgaagagugcaguuguuacccucgcuauccaggaguuagaugcguguguagggacaacuggaagggcucuaaucggccgauaguagauauuaacgugaaagacuacuccaucgucagcucguacgugugcucuggucuuguuggggacacgccccgcaagaaugauuccuucucaaguagccacuguuuggacccuaacaaugaagagggaggccauggcgugaaagggugggcuuuugaugacggaaacgaugucuggaugggucgaaccaucuccgaaaagcugagaucuggcuaugagaccuucaaagugauugagggguggagcaagccaaauucaaaacuacagaucaacaggcagguaauuguugaacggggaaaucguaguggcuacuccgguauauuuagcguggaggggaagcgcugcaucaacagauguuucuaugucgaacucauuaggggccggaaggaggaaacagaggugugguggacuucuaauucaaucgucguguuuugcggaaccaguggcacauacgggacuggaagcuggcccgacggugccgauaucaaccugaugccuauuuga

SEQ ID NO: 136825 - RNA, 1410 nt, Artificial Sequence; identical to SEQ ID NO: 136607
  derived and/or modified sequence opt3 from neuraminidase__InfluenzaA__ABD16541

SEQ ID NO: 136826 - RNA, 1410 nt, Artificial Sequence; identical to SEQ ID NO: 136730
  derived and/or modified sequence opt3 from neuraminidase__InfluenzaA__ABD16552

SEQ ID NO: 136827 - RNA, 1410 nt, Artificial Sequence; identical to SEQ ID NO: 136729
  derived and/or modified sequence opt3 from neuraminidase__InfluenzaA__ABD16563

SEQ ID NO: 136828 - RNA, 1410 nt, Artificial Sequence
  derived and/or modified sequence opt3 from neuraminidase__InfluenzaA__ABD16574
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccacuaucauagagagaaacaucaccgaaauuguauauuugacaaauaccacuaucgagaaggaaauuuguccuaaauuaguggaguacaggaacuggaguaagccacagugcaaaaucacaggguucgcacccuuuagcaaggacaauuccauacggcugucugccggaggugauauuugggucacccgcgagccuuaugugucgugugacccaggcaagugcuaccaauucgcgcuagggcagggaacgacucucaacaaucgacauucaaacgauaccguucacgaccguacacccuauagaacucugcuuaugaaugaacugggcgugccuuuucauuuggguaccaaacaggucuguaucgcuuggagcaguuccucuugccacgaugggaaggccuggcuccauguguguguaacaggacacgacgagaacgcaaccgccagcuucauuuacgauggcaggcugguugacuccaucggcucauggaguaaaaauauccugcggacgcaggaaagcgagugcguguguauuaacgggacuugcacagucgugaugaccgauggaucugcuuccgagcgcgcagacacuaagauacucuuuaucgaagaggguaaaauugugcacaucucaccauuaagcggcagugcccaacaugucgaagagugcucuuguuauccgagauaccccgggguuaggugcgugugucgggauaauuggaagggauccaaccgcccuauaguagacauuaacgugaaggauuacagcaucgucucgucuuaugugugcuccggccugguuggugacacaccacgaaagaaugacagaucaaguagcuccuacuguaggaaccccaauaacgaaaaagggucucacggagugaaaggcugggcuuucgaugacggcaaugaugucuggauggggcggaccaucggagaggagcuucguagcgguuaugaaacguuuaaggugauuggcggguggucaaccccuaacaguaaauugcagaucaaucgccagguaauuguugacuccggaaacagaagcggcuacucugguauauucucaguggaggggaagaguugcaucaauagguguuuuuaugucgaacugauucggggccgcaaaaaggagacacgagugugguggacuagcaacuccaucgucguguucugcggaaccucuggcacauacgggacuggaucguggccagauggugccgacaucaaucuaaugcccauuuga

SEQ ID NO: 136829 - RNA, 1410 nt, Artificial Sequence
  derived and/or modified sequence opt3 from neuraminidase__InfluenzaA__ABD16585
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccacuaucauagagagaaacaucaccgaaauuguauauuugacaaauaccacuaucgagaaggaaauuuguccuaaauuaguggaguacaggaacuggaguaagccacagugcaaaaucacaggguucgcacccuuuagcaaggacaauuccauacggcugucugccggaggugauauuugggucacccgcgagccuuaugugucgugugacccaggcaagugcuaccaauucgcgcuagggcagggaacgacucucaacaaucgacauucaaacgauaccguucacgaccguacacccuauagaacucugcuuaugaaugaacugggcgugccuuuucauuuggguaccaaacaggucuguaucgcuuggagcaguuccucuugccacgaugggaaggccuggcuccauguguguguaacaggacacgacaaaaacgcaaccgccagcuucauuuacgauggcaggcugguugacuccaucggcucauggaguaagaauauccugcggacgcaggagagcgaaugcguguguauuaacgggacuugcacagucgugaugaccgauggaucugcuuccgagcgcgcagacacuaaaauacucuuuaucgaggaagguaagauugugcacaucucaccauuaagcggcagugcccaacaugucgaggaaugcucuuguuauccgagauaccccgggguuaggugcgugugucgggauaauuggaagggauccaaccgcccuauaguagacauuaacgugaaagauuacagcaucgucucgucuuaugugugcuccggccugguuggugacacaccacgaaagaaugacagaucaaguagcuccuacuguaggaaccccaauaacgagaaagggucucacggagugaagggcugggcuuucgaugacggcaaugaugucuggauggggcggaccaucggagaggaacuucguagcgguuaugagacguuuaaagugauuggcggguggucaaccccuaacaguaaguugcagaucaaucgccagguaauuguugacuccggaaacagaagcggcuacucugguauauucucaguggaagggaaaaguugcaucaauagguguuuuuaugucgagcugauucggggccgagaacaggagacacgcgugugguggacuagcaacuccaucgucguguucugcggaaccucuggcacauacgggacuggaucguggccagauggugccgacaucaaucuaaugcccauuuga

SEQ ID NO: 136830 - RNA, 1410 nt, Artificial Sequence
  derived and/or modified sequence opt3 from neuraminidase__InfluenzaA__ABD16721
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacuaagaucguauauuugaccaauacaaccauugaaaaagagaucuguccuaaguuaguggaauacaggaacuggaguaaaccacagugcaagauaacuggguucgcacccuuuagcaaggacaauuccauucggcugucugccggaggugauaucugggucacacgcgagccuuaugugucgugugacccaggcaaaugcuaccaauucgcgcuagggcagggaaccacgcucaacaauaagcauucaaacgauacuauucacgaccgaacccccuaucguacacugcuuaugaaugagcugggcguuccuuuucauuuggguacuaaacagguguguaucgcuuggagcaguuccucuugccacgaugggaaggccuggcuccaugucugugugaccggacacgacaaaaacgcaacagccagcuucaucuacgauggcagacugguagacuccauuggcucauggaguaagaauauacugaggacccaggaaagcgagugcguuuguaucaacgggacgugcacuguggucaugacagauggaucugcuuccgaacgggcagacaccaagauucucuuuaucgaggaggguaaaauagugcacauuucaccauuaagcggcagugcccaacauguggaagagugcucuuguuauccgcgcuaccccggggucagaugcguuuguagggauaauuggaagggauccaaccggccuaucguggacaucaacguaaaagauuacagcauugugucgucuuaugucugcuccggccuggugggugacacuccacgcaagaaugaccgaucaaguagcuccuacugucagaaccccaauaacgaaaaagggaaucacggaguuaagggcugggcuuucgaugacggcaacgauguguggauggggagaacaaucggagaggaacuuaggucugguuaugagaccuuuaaagucauuggcggguggagcacgccuaauucaaaguugcagauaaaccgucaggugaucguagacaguaagaaucgguccggauacagcggcauuuucucuguugaggguaaaucaugcaucaaccgcuguuuuuauguggaacugaucagagggagggagcaagaaacccgggucugguggacaaguaauagcauuguggucuucugcggcacuuccggaaccuacggcacagggucuuggccagauggagccgacauaaaccuaaugcccaucuga

SEQ ID NO: 136831 - RNA, 1410 nt, Artificial Sequence; identical to SEQ ID NO: 136500
  derived and/or modified sequence opt3 from neuraminidase__InfluenzaA__ABD16732

SEQ ID NO: 136832 - RNA, 1410 nt, Artificial Sequence
  derived and/or modified sequence opt3 from neuraminidase__InfluenzaA__ABD16743
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaagcgcaucuggucgcgccgacaccaagauucucuuuaucgaggagggcaaaauagugcacacuuccccuuuaucagggagcgcucagcauguggaagagugcaguuguuauccaagauacccgggagucaggugcauuugucgggauaacuggaagggcucuaaucgccccguuguggacaucaacguaaaggacuacuccaucgauagcucguaugugugcucuggucuggucggggacacaccucgaaacaaugauagauccucaaguagcuacuguaggaacccaaauaacgaaaaaggaacccacggcgugaagggcugggccuucgacgaugggaaugacguuuggaugggacggacgauuuccgaggauucucguagcgguuaugaaaccuuuaaagugaucggcggguggucaacacccaacaguaaacuucagaugaaucgccaggucauuguggacuccgauaacagaagcggauacucuggcauauucucaguagaggguaagaguugcaucaauagguguuuuuauguugaguugauucgggggcgagaacaagagacucgcgugugguggaccagcaacuccaucgucguguucugcggcacaucuggaacuuacggcaccgggucguggccugacggagcggauaucaaucugaugccaauuuga

SEQ ID NO: 136833 - RNA, 1410 nt, Artificial Sequence; identical to SEQ ID NO: 136592
  derived and/or modified sequence opt3 from neuraminidase__InfluenzaA__ABD16754

SEQ ID NO: 136834 - RNA, 1410 nt, Artificial Sequence; identical to SEQ ID NO: 136690
  derived and/or modified sequence opt3 from neuraminidase__InfluenzaA__ABD16765

SEQ ID NO: 136835 - RNA, 1410 nt, Artificial Sequence; identical to SEQ ID NO: 136134
  derived and/or modified sequence opt3 from neuraminidase__InfluenzaA__ABD17326

SEQ ID NO: 136836 - RNA, 1410 nt, Artificial Sequence
  derived and/or modified sequence opt3 from neuraminidase__InfluenzaA__ABD38137
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaauugauaucaacgugaaggacuacuccaucguaagcucguaugugugcucuggucuugucggggacacgccccgcaaaaaugauuccuucucaaguagccauuguuuggacccuaacaaugaggaaggaggccacggcgugaaggggugggccuuugaugacggaaacgauguuuggaugggucgaaccauuuccgagaaacugagaucuggcuacgagaccuucaaggugaucgaaggguggagcaaaccaaauucaaagcuacagacaaacaggcaggucauuguggagcggggaaaucguaguggcuauuccgguauauuuagcguagaagggaaaucuugcaucaaccgcuguuucuacguugagcucauuagaggcaggaaggaggaacccgaggugugguggacuucaaauaguaucgucguguuuugcggaaccccuggcacauaugggacuggaagcuggccagacggugcggauaucaaccugaugcccauuuga

SEQ ID NO: 136837 - RNA, 1413 nt, Artificial Sequence; identical to SEQ ID NO: 136402
  derived and/or modified sequence opt3 from neuraminidase__InfluenzaA__ABD60782

SEQ ID NO: 136838 - RNA, 1410 nt, Artificial Sequence
  derived and/or modified sequence opt3 from neuraminidase__InfluenzaA__ABD60793
augaaccccaaucagaagaucauuaccauaggcagcgugucccugacaaucgccacuauuugcuuccucaugcaaaucgcuauucuugucacgaccguuacacugcacuuuaaacaguacgagugugacucuccugugaacaaucagguaaugccaugcgaaccgaucauaaucgagagaaacauuacugaaaucguguauuugaccaauacaaccauugagaaggaaaucugucccaaauuagucgaguacaggaacuggucaaagccucagugcaaaauaacuggguucgcaccauuuaguaaggauaauagcauucggcuguccgccggaggugacaucugggugacacgcgagcccuauguuucuugugauccuggcaagugcuaccaauucgcgcuagggcagggaaccacgcucgacaacaaacauucgaaugauacuauucacgaccgaaccccacaucguacacugcuuaugaacgaacugggcgugcccuuucacuuggguacuagacaggucuguaucgcuuggucaagcaguuccugccaugaugggaaggccuggcuccacguguguguaaccggauaugacaaaaaugcaacagccucuuucaucuacgauggcaggcugguugacagcauuguguccuggucacagaacauacugcggacccaagagagugaaugcgucuguaucaauggcacgugcacuguggugaugacagaugggagcgcuucugagcgcgcagacaccaagauucucuuuaucgaggaaggaaaaauaguccacauuuccccuuuaucagguagcgcccagcauguugaggaaugcaguuguuauccaagauacccgggcgugaggugcaucugucgggauaacuggaaggggucuaaucgccccguaguggacaucaacgucaaggacuacuccauugauagcucguaugugugcucuggacugguuggcgacacuccucgaaacaaugauagauccucaaacaguuacuguaggaauccaaacaaugagaaagguaaccacggggugaagggaugggcuuucgacgauggcaaugaccuuuggaugggccggacaaucagcgaagauucccguucuggguaugagaccuuuaaagucauuggagguuggagcacgcccaacucaaaguugcagauaaaucgccaggugaucguagacagugauaacagauccggcuacagcgggauuuucucuguugagggaaaaucaugcaucaauagguguuuuuauguggaacugauccggggccgagagcaagaaacccgcgucugguggacaaguaacagcauuauaguguucugcgguacuuccgggaccuacggcacaggaucuuggccugacggcgccgauaucaaucuaaugccaauuuga

SEQ ID NO: 136839 - RNA, 1410 nt, Artificial Sequence; identical to SEQ ID NO: 136535
  derived and/or modified sequence opt3 from neuraminidase__InfluenzaA__ABD60804

SEQ ID NO: 136840 - RNA, 1410 nt, Artificial Sequence; identical to SEQ ID NO: 136728
  derived and/or modified sequence opt3 from neuraminidase__InfluenzaA__ABD60815

SEQ ID NO: 136841 - RNA, 1410 nt, Artificial Sequence; identical to SEQ ID NO: 136730
  derived and/or modified sequence opt3 from neuraminidase__InfluenzaA__ABD60826

SEQ ID NO: 136842 - RNA, 1410 nt, Artificial Sequence; identical to SEQ ID NO: 136809
  derived and/or modified sequence opt3 from neuraminidase__InfluenzaA__ABD60837

SEQ ID NO: 136843 - RNA, 1410 nt, Artificial Sequence
  derived and/or modified sequence opt3 from neuraminidase__InfluenzaA__ABD60848
augaaccccaaucagaagaucauuaccauaggcagcgugucccugacaaucgccacuauuugcuuccucaugcaagucgcuauccuuguuacgaccgugacacugcacuuuaaacaguacgaguguaacucuccuccaaauaaccagguaauguugugcgaaccgacuauuaucgagagaaauauaaccgaaaucguguauuuaacaaacaccacuauugagaaggaaaucugucccaaacuggcagaguacaggaauuggucaaagccucagugcaacauuacaggguucgccccauuuaguaaagacaauagcauccggcuauccgcgggaggugauauaugggucacccgcgagcccuaugugucuugugacccugauaagugcuaccaauucgcucucggccaggggacgacucugaacaauggacauucgaacgacaccguucacgaucgaacaccauaucguacucuucugaugaaugaauugggcgugcccuuucaucucgguaccaagcaggucuguauugccuggucaagcaguuccugccacgacgggaaagcauggcugcauguguguguaacaggagaugacgagaacgccaccgcuucuuucaucuacaauggcagacugguugauagcauuggcuccuggucaaagaaaauccucaggacgcaggaaagugagugcguguguaucaacgggacuugcacagucgugaugaccgacggaagcgcaucugguaaggccgauacuaaaauuuuauuuauagaggaaggcaagaucgugcacacaucccugcuuucagggagcgcucaacacgucgaggaaugcaguuguuauccucgguacccaggaguucgcugcguguguagagacaacuggaagggcucuaauaggccgauuguagauaucaacgugaaagacuacuccauagucagcucguaugugugcucugguuugguuggggacacuccccggaagaaugauuccucaaguagcucccauugucuggacccuaacaaugaggaaggaggccacggcgugaaagggugggccuucgaugacggaaacgaugucuggaugggucgcacgauuucugagaagcuacgaagcggcuacgagaccuuuaaagugaucgaaggguggucaaagccaaauaguaaacuccagaucaacagacagguaauuguugacaggggaaaucgguccggcuauagcgguaucuucucuguggaggggaagucaugcauuaaccguuguuuuuacgucgaacugauacgcggcagaaagcaggagacagaagugcuuuggaccaguaauagcaucgucguguucugcggaaccuccggcacauaugggacuggaucuuggcccgauggugcggacauuaaccugaugccuaucuga

SEQ ID NO: 136844 - RNA, 1413 nt, Artificial Sequence
  derived and/or modified sequence opt3 from neuraminidase__InfluenzaA__ABD60881
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcgaggggucauguaacccggucacuguugauggagccgacggcgugaaggguuucaguuacaaauaugggaauggcguauggaucggaaggacaaaguccaaccggcugcgcaaaggcuuugaaaugaucugggaccccaauggguggaccgauacugacagcaacuucucugugaagcaagaugucguggcuauuacagacuggucaggauacagugguagcuuuguucagcauccugagcucaccggcuuagauugcauacgaccauguuucuggguggaacuggucagagggcuucccagggagaauacgaccaucuggacauccggaucuucgauuagcuucugcggcgugaacuccgacacugccaacuggucauggccugauggugcagaauugccauuuaccaucgacaaguga

SEQ ID NO: 136845 - RNA, 1413 nt, Artificial Sequence
  derived and/or modified sequence opt3 from neuraminidase__InfluenzaA__ABD60892
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagagugauaacguacgaaaauucuaccugggucaaccacacauauguuaauauuaacaauacuaacgugguagcagggaaagacaagaccucggugacacuugccggaaauucaagccuguguaguaucuccggcugggcgauuuacaccaaagauaacucuaucaggaucgguagcaagggggacgucuucgugauucgggagccuuuuauauccugcucacauuuggagugucgcacuuucuuuuuaacacaaggagcucugcuaaaugauaaacacaguaacggcaccguuaaggaccgaagcccauaucgugcccucaugucuugcccgcugggcgaagcacccuccccuuacaauucaaaguucgagagcguggccuggagugcuucugcaugucaugaugggaugggauggcuuacgaucgguauuuccggcccagacaacggggccgucgcugugcugaaauauaacggaaucauaacugaaaccauuaagagcuggaaaaagagaaucuugaggacacaggagucggagugcguauguguuaauggcucuugcuuuacuaucaugaccgauggucccuccaacggggccgcgucauacaaaauuuucaagaucgaaaagggaaaagugacaaagaguauugagcucaaugcaccuaacuuucacuaugaagaguguagcugcuacccagacaccggcacggucaugugugugugccgggauaauuggcacggcuccaaccgccccugggugucuuucaaucagaaccuggacuaccagauaggguauaucugcagcggagucuuuggugauaauccuagaccaaaagacggcgaggggucauguaacccgguuacuguggauggagccgacggcguaaaggguuucaguuacaaauaugggaauggcguguggauuggaaggacaaaguccaaccggcugcgcaaaggcuuugaaaugaucugggaccccaauggguggaccgauacugacagcaacuucucugucaagcaagaugugguugcuaucacagacuggucaggauacagugguagcuuugugcagcauccugagcucaccggcuuagauugcauucgaccauguuucugggucgaacuggugagagggcuucccagggagaauacgaccauauggacauccggaucuucgaucagcuucugcggcguaaacuccgacacugccaacuggucauggccugauggugcagaauugccauuuaccauugacaaguga

SEQ ID NO: 136846 - RNA, 1413 nt, Artificial Sequence; identical to SEQ ID NO: 136844
  derived and/or modified sequence opt3 from neuraminidase__InfluenzaA__ABD60903

SEQ ID NO: 136847 - RNA, 1413 nt, Artificial Sequence; identical to SEQ ID NO: 136431
  derived and/or modified sequence opt3 from neuraminidase__InfluenzaA__ABD60914

SEQ ID NO: 136848 - RNA, 1410 nt, Artificial Sequence
  derived and/or modified sequence opt3 from neuraminidase__InfluenzaA__ABD60925
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacaaaaacgccaccgcuucuuucauuuauaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauugugcacaucuccacacugucagggagcgcucaacauguggaagagugcaguuguuacccucgcuauccaggagucagaugcguuuguagggacaacuggaagggcucuaaucggccgauaguggauauuaacaucaaagacuacuccaucguaagcucguacgugugcucuggucuugucggggacacgccccgcaagaaugauuccuucucaaguagccacuguuuggacccuaacaaugaagagggaggccauggcgugaaagggugggccuuugaugacggaaacgauguuuggaugggucgaaccauuuccgaaaagcugagaucuggcuaugagaccuucaaagugaucgagggguggagcaagccaaauucaaaacuacagauuaacaggcaggucauaguggaacggggaaaucguaguggcuacuccgguaucuuuagcguagaggggaagucuugcauuaaccgcuguuucuauguugaacucaucagaggcaggaaggaggaaacagaggugugguggacuucaaauaguaucgucguguuuugcggaaccagcggcacauacgggacuggauccuggcccgacggugcggauauuaaccugaugccuauauga

SEQ ID NO: 136849 - RNA, 1413 nt, Artificial Sequence
  derived and/or modified sequence opt3 from neuraminidase__InfluenzaA__ABD60947
augaaccccaaucagaagaucauuaccauaggcagcaucugcauggccauugggaucauuucccugauccuccaaauaggaaacaucauuucuaucugggugucacacaguauucagacagguagccagaaucauacuggcaucuguaaccagagaauaauuacguacgaaaauuccaccugggucaaccaaacauauguuaauaucucuaacacuaaugugguagcugggaaagacaccacaucgaugacccuugcaggaaacucaagccugugcccuauuaggggcugggccaucuacaguaaggauaauuccauccggauugguucuaaaggggacguguucgucauacgcgaaccauuuaucagcuguucccacuuggagugccgaacuuucuuuuuaacacagggagcgcugcuaaacgauaagcauucaaauggcaccauuaaagaccguaguccguauagagcucucaugagcugucccaucggcgaagccccuucuccauacaacuccagguucgagucaguggcauggagcgccagugcuugccacgaugggaugggauggcugacgauagguauuucuggccccgacgauggggcaguugccgugcuuaaguauaauggaaucaucacugaaaccauuaaguccuggcggaaacagauccugcgcacacaggagagcgagugugucugcgugaacggcucguguuuuacuauuaugaccgacgguccuucugaugggccagcuuccuacagaauauucaagaucgaaaaaggaaagauuacaaaaucaaucgaguuggacgcccccaacagucauuaugaagagugcagcuguuacccugauaccggcacgguaaugugcguuugcagggacaauuggcacggcuccaaccggccaugggugucuuuuaaucaaaaccucgauuaccagaucggguauauuuguagcggagucuucggugacaauccgcgccccaaggacggcaaggggucaugcgauccugugaacguggacggagcggauggcgucaaagguuuuaguuaccgauaugggaauggcguuuggauaggaagaacuaaguccaacagcucuaggaaaggcuucgagaugaucugggacccaaauggguggacagauaccgacucaaacuuucuggugaagcaggauguaguggcaaugacugacuggaguggauacagcgguuccuucguccagcaccccgaacugacaggccucgauuguaugcggccuugcuuuuggguggaguuaauucgugggcgcccaagagagaaaaccacgaucuggaccucuggaucgagcauuuccuucuguggcguuaauucagacacagugaacuggaguuggcccgauggugccgagcugccguucacuaucgacaaguga

SEQ ID NO: 136850 - RNA, 1410 nt, Artificial Sequence
  derived and/or modified sequence opt3 from neuraminidase__InfluenzaA__ABD61263
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacaaaaacgccaccgcuucuuucauuuauaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauugugcacaucuccacacugucagggagcgcucaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacccccaggaagaaugauuccuucucaaguagccacuguuuggacccuaacaaugaagagggaggccauggcaugaaagggugggccuuugaugacggaaacgauguuuggaugggucgaacgaucuccgaaaagcugagaucuggcuaugagaccuucaaagugauugagggguggagcaagccaaauucaaaacuacaggucaaccgccaggugaucguagaacggggaaaucguaguggcuacuccgguauuuuuagcguugaggggaagucuugcauaaaccgcuguuucuauguggaacucaucagaggcaggaaggaggaaacagaggucugguggacuucaaauaguauuguggucuuuugcggaaccagcggcacauacgggacuggauccuggcccgacggugcggauaucaaccugaugccuaucuga

SEQ ID NO: 136851 - RNA, 1410 nt, Artificial Sequence; identical to SEQ ID NO: 136161
  derived and/or modified sequence opt3 from neuraminidase__InfluenzaA__ABD61274

SEQ ID NO: 136852 - RNA, 1410 nt, Artificial Sequence
  derived and/or modified sequence opt3 from neuraminidase__InfluenzaA__ABD61285
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcaacgcuucugggaaggcagacacuaaaauccucuuuauugaggaaggaaagaucgugcacacauccaccuuaucagguagcgcccaacacgucgaggaaugcaguugcuauccucgguacccaggcguucgcugugugugcagagauaacuggaaggggucuaauaggccgauaguagacauuaacaucaaagacuacuccaucgugagcucguaugucuguucuggacuggugggcgauacgccccggaagaaugacuccucaaguagcucccauugccuugauccuaacaaugaggaaggugggcacggaguuaaaggcugggcuuucgacgauggcaacgacguguggauggggcgcaccauuucugagaaguugcgaagcggauacgagacauuuaaagucaucgaagguuggucaaauccaaacaguaagcugcagauuaauagacaggugauaguagauaggggcaaccgguccggguauagcggaaucuucucuguugagggcaaaucauguauuaaucguugcuuuuacguggaacuaauccgcgguagaaaggaggaaacugagguccucuggaccaguaacagcaucguggucuucugugggacauccggcacuuauggaaccggcucuuggcccgacggggccgauauuaaucugaugccuauauga

SEQ ID NO: 136853 - RNA, 1410 nt, Artificial Sequence; identical to SEQ ID NO: 136607
  derived and/or modified sequence opt3 from neuraminidase__InfluenzaA__ABD61296

SEQ ID NO: 136854 - RNA, 1410 nt, Artificial Sequence; identical to SEQ ID NO: 136728
  derived and/or modified sequence opt3 from neuraminidase__InfluenzaA__ABD61307

SEQ ID NO: 136855 - RNA, 1410 nt, Artificial Sequence; identical to SEQ ID NO: 136746
  derived and/or modified sequence opt3 from neuraminidase__InfluenzaA__ABD61318

SEQ ID NO: 136856 - RNA, 1410 nt, Artificial Sequence; identical to SEQ ID NO: 136077
  derived and/or modified sequence opt3 from neuraminidase__InfluenzaA__ABD61340

SEQ ID NO: 136857 - RNA, 1410 nt, Artificial Sequence; identical to SEQ ID NO: 136077
  derived and/or modified sequence opt3 from neuraminidase__InfluenzaA__ABD61351

SEQ ID NO: 136858 - RNA, 1410 nt, Artificial Sequence
  derived and/or modified sequence opt3 from neuraminidase__InfluenzaA__ABD61362
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaagugugucccaaacuggcagaguacaggaauuggucaaagccucagugcaacauuacaggguucgccccauuuaguaaagacaauagcauccggcuauccgcgggaggugauauaugggucacccgcgagcccuaugugucuugugacccugauaagugcuaccaauucgcucucggccaggggacgacucugaacaauggacauucgaacgacaccguucacgaucgaacaccauaucguacucuucugaugaaugaauugggcgugcccuuucaucucgguaccaagcaggucuguauugccuggucaagcaguuccugccacgacgggaaagcauggcugcauguguguguaacaggagaugacgagaacgccaccgcuucuuucaucuacaauggcagacugguugauagcauuggcuccuggucaaagaaaauccucaggacgcaggaaagugagugcguguguaucaacgggacuugcacagucgugaugaccgacggaagcgcaucugguaaggccgauacuaaaauuuuauuuauagaggaaggcaagaucgugcacacauccucacugagcgggagugcucaacacgucgaggaaugcucuuguuauccucgguacccaggaguucgcugcguguguagagacaacuggaagggcuccaauaggccgauuguagauaucaacgugaaagacuacagcauagucucgucuuaugugugcuccggucuuguuggggacacgccccggaagaaugauucaaguagcuccucucauuguuuggacccuaacaaugaggaaggaggccacggcgugaaagggugggccuucgaugacggaaacgaugucuggaugggucgcaccauuagcgagaagcugcgaucaggcuacgagaccuuuaaagugaucgaaggguggaguaagccaaauuccaaacuacagaucaacagacagguaauuguugacaggggaaaucggagcggcuauucugguaucuucucaguggaggggaagaguugcauuaaccguuguuuuuacgucgaacucauacgcggcagaaagcaggagacagaagugcuguggacuagcaauuccaucgucguguucugcggaaccucuggcacauaugggacuggaucguggcccgauggugcggacauugaucuuaugccuaucuga

SEQ ID NO: 136859 - RNA, 1410 nt, Artificial Sequence; identical to SEQ ID NO: 136809
  derived and/or modified sequence opt3 from neuraminidase__InfluenzaA__ABD61373

SEQ ID NO: 136860 - RNA, 1410 nt, Artificial Sequence
  derived and/or modified sequence opt3 from neuraminidase__InfluenzaA__ABD61384
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacauuaaagacuacagcaucguaucgucuuaugugugcuccggucuugucggggacacgccccggaagaaugauucaaguagcuccucucauuguuuggacccuaacaaugaggaaggaggccacggcgugaaagggugggccuucgaugacggaaacgauguuuggaugggucgcaccaucagcgagaagcugcgaucaggcuacgagaccuuuaaagugauugaaggguggaguaagccaaauuccaaacuacagaucaacagacaggucauuguggacaggggaaaucggagcggcuauucugguauauucucaguagagaguaagagcugcaucaaccguuguuuuuacguugaacucauucgcgggagaaagcaggagacagaagugcuguggacuuccaauucuaucgucguguucugcggcaccucgggaacauauggcacugggagcuggcccgauggagcggacaucaaccuuaugccuauuuga

SEQ ID NO: 136861 - RNA, 1410 nt, Artificial Sequence; identical to SEQ ID NO: 136746
  derived and/or modified sequence opt3 from neuraminidase__InfluenzaA__ABD61395

SEQ ID NO: 136862 - RNA, 1410 nt, Artificial Sequence; identical to SEQ ID NO: 136843
  derived and/or modified sequence opt3 from neuraminidase__InfluenzaA__ABD61406

SEQ ID NO: 136863 - RNA, 1413 nt, Artificial Sequence; identical to SEQ ID NO: 136844
  derived and/or modified sequence opt3 from neuraminidase__InfluenzaA__ABD61521

SEQ ID NO: 136864 - RNA, 1410 nt, Artificial Sequence
  derived and/or modified sequence opt3 from neuraminidase__InfluenzaA__ABD61532
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaugccgugcgaacccaucauaaucgagagaaacauuacugaaaucguauauuugaccaauacaaccauugagaaggaaaucuguccuaaauuaguggaguacaggaacuggaguaagccacagugcaaaauaacuggguucgcacccuuuagcaaggacaauuccauucggcugucugccggaggugauaucugggucacacgcgagccuuaugugucgugugacccaggcaagugcuaccaauucgcgcuagggcagggaaccacgcucaacaauaaacauucaaacgauacuauucacgaccgaacccccuaucguacacugcuuaugaaugaacugggcguuccuuuucauuuggguacuaaacagguguguaucgcuuggagcaguuccucuugccacgaugggaaggccuggcuccaugucugugugaccggacacgacaagaacgcaacagccagcuucaucuacgauggcagacugguagacuccauuggcucauggaguaaaaauauacugaggacccaggagagcgaaugcguuuguaucaacgggacgugcacuguggucaugacagauggaucugcuuccgagcgggcagacaccaagauucucuuuaucgaggaagguaagauagugcacauuucaccauuaagcggcagugcccaacauguggaggaaugcucuuguuauccgcgcuaccccggggucagaugcguuuguagggauaauuggaaaggauccaaccggccuaucguggacaucaacguaaaggauuacagcauugugucgucuuaugucugcuccggccuggugggugacacuccacgcaaaaaugaccgaucaaguagcuccuacuguagaaaccccaauaacgagaaggggaaucacggaguuaaaggcugggcuuucgaugacggcaacgauguguggauggggaggacaaucggagaggaacuucggucugguuaugagaccuuuaaggucauuggcggguggagcacgccuaauucaaaauugcagauaaaccgucaggugaucguagacagugaaaaucgcuccggauacagcggcauuuucucuguugaggguaagucaugcaucaacagauguuuuuauguggaacugaucagggggcgggagcaggaaacccgagucugguggacaaguaauagcauuguggucuucugcggcacuuccggaaccuacggcacagggucuuggccagauggagccgacauaucgcuaaugcccaucuga

SEQ ID NO: 136865 - RNA, 1413 nt, Artificial Sequence
  derived and/or modified sequence opt3 from neuraminidase__InfluenzaA__ABD61543
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcgaggggucauguaacccggucacuguugauggagccgacggcgugaaggguuucaguuacaaauaugggaauggcguauggaucggaaggacaaaguccaaccggcugcgcaaaggcuuugaaaugaucugggaccccaauggguggaccgauacugacagcaacuucucugugaagcaagaugucguggcuauuacagacuggucaggauacagugguaauuuuguucagcauccugagcucaccggcuuagauugcauacgaccauguuucuggguggaacuggucagagggcuucccagggagaacacgaccaucuggacaagcggauccucuauuucguucugcggcgugaacagcgacacugccaauugguccuggccugauggugcagaauugccauuuaccaucgacaaguga

SEQ ID NO: 136866 - RNA, 1413 nt, Artificial Sequence; identical to SEQ ID NO: 136844
  derived and/or modified sequence opt3 from neuraminidase__InfluenzaA__ABD63066

SEQ ID NO: 136867 - RNA, 1410 nt, Artificial Sequence; identical to SEQ ID NO: 136269
  derived and/or modified sequence opt3 from neuraminidase__InfluenzaA__ABD77601

SEQ ID NO: 136868 - RNA, 1410 nt, Artificial Sequence
  derived and/or modified sequence opt3 from neuraminidase__InfluenzaA__ABD77612
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaaugugucccaaacuggcagaguacaggaauuggcuaaagccucagugcaacauuacaggguucgccccauuuucaaaagacaauaguauccggcucagcgcgggaggugauauaugggugacccgcgagcccuaugucuccugugacccugauaagugcuaccaauucgcucugggccaggggacgacucuuaacaauggacauucuaacgacaccgugcacgaucgaacaccauaucguacucuguugaugaaugaacucggcguucccuuucaucuggguaccaaacagguguguauugccuggucgucaagcaguugccacgacgggaaggcauggcugcaugucugugugacaggagaugacgagaacgccaccgcuuccaucauuuacaauggcagacucguagauucuaucggcagcugguccaagaaaaucuuaaggacgcaggaaucagagugcguuuguauuaacgggacuugcacaguggucaugaccgacggaagugcaagcgguaaggccgauacuaaaauacuguucaucaaggagggcaagauugugcacacaucuucccuuucagggagcgcucaacacguggaagagugcaguuguuauccucgguacccaggaguccgcugcguuuguagagacaacuggaaaggcucuaauaggccgaucguggauauaaacguaaaggacuacuccauugugagcucguaugucugcucugguuuggugggggacacgccccggaaaaaugauuccucaaguagcucccauugucuggacccuaacaaugaagagggaggccacggcguuaaggggugggccuuugaugacggaaacgauguguggaugggucgcaccaucucugaaaaacuacgaagcggcuacgagaccuucaaggucaucgagggguggucaaaagcgaauaguaagcuccagauuaacagacaggugaucguagacaggggaaaucgguccggcuauagcgguauauuuucuguugaaucaaagaguugcauuaaccguuguuucuacguggagcugauccgcgggagaaaacaggaaacagagguccuuuggacuagcaauuccauuguggucuuuugcggcaccucuggaacauauggcacugggucguggccagauggagcagacaucaaccugaugcccaucuga

SEQ ID NO: 136869 - RNA, 1410 nt, Artificial Sequence
  derived and/or modified sequence opt3 from neuraminidase__InfluenzaA__ABD77634
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaaugugucccaaacuggcagaguacaggaauuggucaaagccucagugcaacauuacaggguucgccccauuuaguaaagacaauagcauccggcuauccgcgggaggugauauaugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguauugccuggucaagcaguuccugccacgacgggaaggcauggcugcaugucugugugacaggagaugacgagaacgccaccgcuucuaucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauucaucaaggagggcaagauugugcacacauccucacugagcgggagugcucaacacguggaagagugcucuuguuauccucgguacccaggaguccgcugcguuuguagagacaacuggaaaggcuccaauaggccgaucguggauauaaacguaaaggacuacagcauugugucgucuuaugucugcuccggucuugugggggacacgccccggaaaaaugauucaaguagcuccucucauuguuuggacccuaacaaugaagagggaggccacggcguuaaggggugggccuuugaugacggaaacgauguguggaugggucgcaccaucagcgaaaaacugcgaucaggcuacgagaccuucaaggucaucgagggguggaguaaagcaaauuccaagcuacagauuaacagacaggugaucguagacaggggaaaucggagcggcuauucugguauauuuucaguugaaaguaagagcugcauuaaccguuguuucuacguggagcucauccgcgggagaaaacaggaaacagagguccuguggacuuccaauucuauuguggucuuuugcggcaccucgggaacauauggcacugggagcuggccagauggagcggacaucaaccuuaugcccaucuga

SEQ ID NO: 136870 - RNA, 1410 nt, Artificial Sequence; identical to SEQ ID NO: 136869
  derived and/or modified sequence opt3 from neuraminidase__InfluenzaA__ABD77645

SEQ ID NO: 136871 - RNA, 1410 nt, Artificial Sequence; identical to SEQ ID NO: 136869
  derived and/or modified sequence opt3 from neuraminidase__InfluenzaA__ABD77656

SEQ ID NO: 136872 - RNA, 1410 nt, Artificial Sequence; identical to SEQ ID NO: 136142
  derived and/or modified sequence opt3 from neuraminidase__InfluenzaA__ABD77700

SEQ ID NO: 136873 - RNA, 1413 nt, Artificial Sequence; identical to SEQ ID NO: 136844
  derived and/or modified sequence opt3 from neuraminidase__InfluenzaA__ABD77722

SEQ ID NO: 136874 - RNA, 1413 nt, Artificial Sequence; identical to SEQ ID NO: 136844
  derived and/or modified sequence opt3 from neuraminidase__InfluenzaA__ABD77733

SEQ ID NO: 136875 - RNA, 1410 nt, Artificial Sequence
  derived and/or modified sequence opt3 from neuraminidase__InfluenzaA__ABD77744
augaaccccaaucagaagaucauuaccauaggcagcgugucccugacaaucgccacuauuugcuuccucaugcaaaucgucauucuuguuacgaccgugacacugcacuuuaaacaguacgaguguaacucuccuccaaauaaccagguaauguugugcgaaccgacuaucauagagagaaauaucaccgaaauuguguauuuaacaaacaccacuaucgagaaggaaauuugucccaaacuggcugaguacaggaauuggucaaagccucagugcaacaucacaggguucgcaccauuuaguaaagacaauagcauacggcuauccgccggaggugauauuugggucacccgcgagcccuaugugucuugugacccugauaagugcuaccaauucgcgcucggccaggggacgacucugaacaauggacauucgaacgacaccguucacgaucgaacaccauaucguacucuucugaugaaugaauugggcgugcccuuucaucucgguaccaagcaggucuguaucgcuuggucaagcaguuccugccacgacgggaaagccuggcugcauguguguguaacaggagaugacgagaacgcaaccgccucuuucauuuacaauggcagacugguugauagcaucggcuccuggucaaagaaaauccucaggacgcaggaaagugagugcguguguauuaacgggacuugcacagucgugaugaccgacggaagcgcuucugguaaggcagauacuaaaauauuauuuaucgaggaaggcaagauugugcacacaucccugcuuucagggagcgcccaacacgucgaggaaugcaguuguuauccucgguacccaggaguucgcugcguguguagagacaacuggaagggcucuaauaggccgaucguagauauaaacgugaaagacuacuccauugucagcucguaugugugcucugguuugguuggggacacuccccggaagaaugauuccucaaguagcucccauugucuggacccuaacaaugaggaaggaggccacggcgugaaagggugggcuuucgaugacggaaacgaugucuggaugggucgcacgaucucugagaagcuacgaagcggcuacgagaccuuuaaagugaucgaaggguggucaaagccaaauaguaaacuccagauuaacagacagguaaucguugacaggggaaaucgguccggcuauagcgguauuuucucuguggaggggaagucaugcauaaaccguuguuuuuacgucgaacugauccgcggcagaaagcaggagacagaagugcuuuggaccaguaauagcauugucguguucugcggaaccuccggcacauaugggacuggaucuuggcccgauggugccgacaucaaccugaugccuaucuga

SEQ ID NO: 136876 - RNA, 1410 nt, Artificial Sequence; identical to SEQ ID NO: 136869
  derived and/or modified sequence opt3 from neuraminidase__InfluenzaA__ABD77755

SEQ ID NO: 136877 - RNA, 1410 nt, Artificial Sequence; identical to SEQ ID NO: 136869
  derived and/or modified sequence opt3 from neuraminidase__InfluenzaA__ABD77766

SEQ ID NO: 136878 - RNA, 1410 nt, Artificial Sequence
  derived and/or modified sequence opt3 from neuraminidase__InfluenzaA__ABD77777
augaaccccaaucagaagaucauuaccauaggcagcgugucccugacaaucgccacuauuugcuuccucaugcaaaucgucauucuuguuacgaccgugacacugcacuuuaaacaguacgaguguaacucuccuccaaauaaccagguaaugccgugcgaacccacuaucauagagagaaauaucaccgaaauuguguauuugacaaacaccacuaucgagaaggaaauuuguccuaaauuagcugaguacaggaauuggucaaagccacagugcaacaucacaggguucgcacccuuuaguaaagacaauagcauacggcuguccgccggaggugauauuugggucacccgcgagccuuaugugucuugugacccagauaagugcuaccaauucgcgcuaggccaggggacgacucucaacaauggacauucgaacgacaccguucacgaucgaacacccuaucguacucugcuuaugaaugaacugggcgugccuuuucauuuggguaccaagcaggucuguaucgcuuggucaagcaguuccugccacgacgggaaagccuggcuccauguguguguaacaggagaugacgagaacgcaaccgccucuuucauuuacaauggcagacugguugauagcaucggcuccuggucaaagaaaauccugaggacgcaggaaagugagugcguguguauuaacgggacuugcacagucgugaugaccgacggaagcgcuucugguaaggcagauacuaaaauacucuuuaucgaggaaggcaagauugugcacacauccuuacugucagggagcgcccaacacgucgaggaaugcaguuguuauccacgguacccgggaguucgcugcguguguagagacaacuggaagggcucuaauaggcccaucguagauauaaacgugaaagacuacuccauugucagcucguaugugugcucuggucuuguuggggacaccccucggaagaaugauuccucaaguagcucccauuguuuggacccaaacaaugaggaaggaggccacggcgugaaagggugggcuuucgaugacggaaacgaugucuggaugggucgcacgaucucugagaagcugcgaagcggcuacgagaccuuuaaagugaucgaaggguggucaaagcccaauaguaaacuacagauuaacagacagguaaucguugacaggggaaaucgguccggcuauagcgguauuuucucuguggaggggaagucaugcauaaaccguuguuuuuacgucgaacucauccgcggcagaaagcaggagacagaagugcuguggaccaguaauagcauugucguguucugcggaacuuccggcacauaugggacuggaucuuggccugauggugccgacaucaaccuuaugccaaucuga

SEQ ID NO: 136879 - RNA, 1410 nt, Artificial Sequence; identical to SEQ ID NO: 136878
  derived and/or modified sequence opt3 from neuraminidase__InfluenzaA__ABD77788

SEQ ID NO: 136880 - RNA, 1362 nt, Artificial Sequence
  derived and/or modified sequence opt3 from neuraminidase__InfluenzaA__ABD77799
augaaccccaaucagaagaucauuaccauaggcagcaucugcaugguggucgggauuaucucccugauucuccaaaucggaaacauaaucucuauuuggaucucacacaguauucagacagguaaucagaaccauacuggcaucuguaaucaggggauaauuacguacaacguuguggccggacaagacagcaccuccguaauccuuacaggcaauucuucgcugugcccuauuagagguugggcuauccacucaaaagauaacgggaucaggauuggaagcaagggcgacguguucgucauacgggagccauuuaucaguuguucccauuuggaaugccgcacuuucuuuuuaacccagggcgcacugcuaaaugauaaacacucuaacgggacagugaaggaccgaagcccguaucgugcccucauguccugucccguuggagaggcgccuucaccauacaauaguagauucgaaagcguggcuuggucugccuccgcaugccaugaugguaugggcuggcugaccauugggaucucaggacccgacaacggcgccgucgcugugcuuaaauauaaugguauaauuacugagacaaucaagagcuggaggaagaaaauccugcggacccaggaaagugaguguacgugcguaaacgggucuuguuuuacuauuaugaccgauggaccuuccaauggcuuggcaagcuacaagaucuucaaaauugagaagggcaaaguuacaaagucgauagaacucaacgccccaaacucucacuaugaggaaugcuccuguuaccccgacacugggaaggugaugugcgucugccgcgauaauuggcacggaucaaacagaccuugggugaguuuugaccagaaucuggauuaucaaaucgguuacauuuguagcggcguguucggggacaacccaaggccgaaagauggaaccggcuccugcggucccgucucugcugacggggccaauggcguuaagggauuuagcuaccgguauggcaacgggguguggaucggacgcacaaaaucagacaguucccgacaugguuucgagaugaucugggauccuaauggcuggaccgagacggacagcagauuuucuguaaggcaggauguggucgcgaugacugaccggucaggguacaguggcagcuucgugcagcacccagaacugacaggacucgauuguaugcgucccugcuuuuggguugaguuaauucgcgguagaccugaagaggaaaccauauggacuuccgggucuaucauuucguucuguggcgugaacagcgacacagucgauugguccuggccagacggagcagagcugcccuucaccaucgauaaguga

SEQ ID NO: 136881 - RNA, 1410 nt, Artificial Sequence
  derived and/or modified sequence opt3 from neuraminidase__InfluenzaA__ABD77810
augaaccccaaucagaagaucauuaccauaggcagcaucugcaugguggucgggauuaucucccugauucuccaaaucggaaacauaguuucuaucuggauuucacacaguauccagacagguaaucagaaccauacuggcacguguaaucagagcauuaucaccuacaaaaacuccacaugggugaaucaaacuuauguaaacauaucuaauaccaacguggucgccgggaaggacacaaccucggugauucuugcuggaaauucaagccugugcccuaucagaggcugggcaauuuacaguaaagauaacgguguuaggaucggguccaagggagacguguucgucauccgggagccauuuauuucuuguagccacuuggaaugccgcacuuucuuuuuaacacagggcgcccugcuaaaugauaaacauuccaacggcaccgugaaggaccgaucaccguaucgugcgcucaugaguugucccguaggggaggcuccuagcccauacaauucuagauucgaauccguugccuggucagcaagcgccugccacgauggaauggguuggcugacgauaggcaucagugggcccgacgauggagcuguggcaguccuuaaguauaacggcauuaucacugagaccauaaaaucuuggaggaaggaaauucugcggacacaggaguccgagugugugugcgugaacgguagcuguuuuacuaucaugaccgacgggccuucgggaggcccagccucuuacaaaaucuucaagauugaaaaaggcaaggucacaaaguccaucgaguuggaugcucccaauucacauuaugaagagugcaguuguuacccugacaccagcaaaguuaugugcgugugccgcgauaacuggcacggguccaauagaccauggguaucuuuugaccagaaccucgauuaccaaaugggauauauuuguagcgguguguucggcgacaauccgaggcccaaggacgggaaaggaucaugcggcccugucuacguggauggugccaacgggguuaagggcuuuaguuaucgguacggaaauggcguguggauagggcgcacgaaauccaacagcucucgacagggauucgagaugaucugggacccaaaugguuggacugaaacagauucaaacuuuuucaccaagcaggacgucguggcgguaacugauuggaguggcuauagcggguccuuuguucagcaccccgagcugacaggacuggacuguaugagaccuugcuucuggguggaacucauuaggggccggccaaaagagaauaccaucuggacgucugguucgagcaucuccuucuguggggucaacucagauaccguggacuggaguuggcccgauggcgcagaauuaccguuuacaauugacaaguga

SEQ ID NO: 136882 - RNA, 1410 nt, Artificial Sequence
  derived and/or modified sequence opt3 from neuraminidase__InfluenzaA__ABD77832
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacggaggcaggcugguagacagcaucggcuccuggaguaaaaagauccuccggacgcaggaaucagagugcguuuguauuaacgggacuugcacaguggucaugaccgauggaagcgcaucuggucgcgccgacacuaaaauauuauuuaucgaggaaggcaagauugugcacaucuccccucugucagggagcgcucaacauguggaggaaugcaguuguuauccaagauacucuggagucaggugcguuugucgggauaauuggaagggcuccaaccgcccgauaguggacauuaacguaaaagauuacagcaucgugucgucuuaugucugcuccggucuugugggggacacaccccgaaagaaugacucaaguagcuccucucacuguuugaacccuaauaacgaggaaggaggccauggcguuaaagggugggccuucgaugacggaaaugauguguggauggguagaaccaucagcgagaaguuuaggucaggcuacgagacguucaaagucauugggggauggaguaagccaaacuccaaacugcagaucaaucgucaggugauuguagaccggggcaaccgcagcgguuauucugggauauuuucaguugaaggcaagaguugcaucaauagauguuucuacguggagcuaauuaggggacggaagcaggaaaccgaggucugguggacaagcaacuccaucguggucuuuugcggcacuucugggaccuauggaacagguucguggcccgauggcgcggacaucaaucucaugccuauuuga

SEQ ID NO: 136883 - RNA, 1410 nt, Artificial Sequence
  derived and/or modified sequence opt3 from neuraminidase__InfluenzaA__ABD77876
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauugugcacaucuccccucugucaggcagcgcucaacauguggaggaaugcaguuguuauccaagauacucuggggucaggugcguuugucgggacaauuggaagggauccaaccgcccgauaguggauauuaacguaaaagacuacagcaucgugucgucuuaugucugcuccggccuugugggugacacaccccgaaagaaugauucaaguagcuccucucacuguuugaacccuaauaacgaggaagggggacauggcguuaaaggcugggccuucgacgaugggaaugacguguggaugggaagaaccaucagcgagaagcugaggucagguuacgagacguuuaaagucauugaaggcuggaguaagccaaacuccaaacuacagaucaaucgucaggugauuguagaucgggggaaccgcagcggauauucuggcauauucucaguugaggguaagaguugcaucaauagauguuuuuacguggaacucauuagggggcggaagcaggagaccgaagucugguggacaagcaacuccaucguggucuucugcggcacuucuggaaccuauggcacagggucguggcccgacggagcggauaucaaucugaugccuauuuga

SEQ ID NO: 136884 - RNA, 1410 nt, Artificial Sequence; identical to SEQ ID NO: 136142
  derived and/or modified sequence opt3 from neuraminidase__InfluenzaA__ABD77887

SEQ ID NO: 136885 - RNA, 1410 nt, Artificial Sequence
  derived and/or modified sequence opt3 from neuraminidase__InfluenzaA__ABD77898
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauuauccacauauccccucugucaggcagcgcucaacauguggaggaaugcaguuguuauccaagauacccgggggugaggugcgucugucgggacaauuggaagggaucuaaccgccccauuguugauaucaacgugaaagacuacuccaucguaagcucguaugugugcucuggccuugucggugacacaccucgaaagaaugauuccucaaguagcucccacuguuugaacccaaauaacgaggaagggggacauggcgugaaaggcugggccuucgacgaugggucugacguuuggaugggaagaaccauuagcgagaagcugaggucagguuacgagacguuuaaagugaucgaaggcuggaguaagcccaauuccaaacuacagauuaaccggcaggucauaguggaucgugggaaucgcagcggauauucuggcaucuucucaguagaggguaagaguugcauuaacagauguuuuuacguugaacucaucagggggcggaagcaggagaccgaagugugguggacaagcaauuccaucgucguguucugcggcacuucuggaaccuauggcacagggucguggccugacggagcggauauuaaccugaugccaauauga

SEQ ID NO: 136886 - RNA, 1410 nt, Artificial Sequence
  derived and/or modified sequence opt3 from neuraminidase__InfluenzaA__ABD77909
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauugugcacaucuccccucugucaggcagcgcucaacauguggaggaaugcaguuguuauccaagauacccgggggucaggugcguuugucgggacaauuggaagggaucuaaccgccccauaguggauauuaacguaaaagacuacuccaucgugagcucguaugucugcucuggccuugugggugacacaccucgaaagaaugauuccucaaguagcucccacuguuugaacccaaauaacgaggaagggggacauggcguuaaaggcugggccuucgacgaugggaaugacguguggaugggaagaaccaucucugagaagcugaggagcgguuacgagacguuuaaagucauugaaggcuggucaaagcccaacaguaaacuacagaucaaucgucaggugauuguagaucgggggaacuccagcggauauucuggcauauucucaguugaggguaagaguugcaucaaucgcuguuuuuacguggaacucauuagagggaggaagcaggagaccgaagucugguggacaagcaacuccaucguggucuucugcggcacuucuggaaccuauggcacagggucguggccugacggagcggauaucaaucugaugccaauuuga

SEQ ID NO: 136887 - RNA, 1413 nt, Artificial Sequence; identical to SEQ ID NO: 136844
  derived and/or modified sequence opt3 from neuraminidase__InfluenzaA__ABD77920

SEQ ID NO: 136888 - RNA, 1413 nt, Artificial Sequence; identical to SEQ ID NO: 136844
  derived and/or modified sequence opt3 from neuraminidase__InfluenzaA__ABD77931

SEQ ID NO: 136889 - RNA, 1413 nt, Artificial Sequence; identical to SEQ ID NO: 136844
  derived and/or modified sequence opt3 from neuraminidase__InfluenzaA__ABD77942

SEQ ID NO: 136890 - RNA, 1413 nt, Artificial Sequence
  derived and/or modified sequence opt3 from neuraminidase__InfluenzaA__ABD77953
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcgaggggucauguaacccggucacuguugauggagccgacggcgugaaggguuucaguuacaaauaugggaauggcguauggaucggaaggacaaaguccaaccggcugcgcaaaggcuuugaaaugaucugggaccccaauggguggaccgauacugacagcaacuucucugugaagcaagaugucguggcuauuacagacuggucaggauacagugguagcuuuguucagcauccugagcucaccggcuuagauugcauacgaccauguuuccugguggaacuugucagaggguugcccagggagaauacgaccaucuggacauccggaucuucgauuagcuucugcggcgugaacuccgacacugccaacuggucauggccugauggugcagaacugccauuuaccaucgacaaguga

SEQ ID NO: 136891 - RNA, 1413 nt, Artificial Sequence
  derived and/or modified sequence opt3 from neuraminidase__InfluenzaA__ABD77964
augaaccccaaucagaagaucauuaccauaggcagcaucuccauugccaucgggauuaucucucugaugcuccaaauaggaaacaucauuucaaucugggcuagucacagcauucagacaagaucccagaaucauacugguaucugcaaccagaggauaauuacguacgaaaauucuaccugggugaaccacacauaugucaauaucaacaauacuaacguuguggcaggcaaagacaagaccucgguaacacuugccggaaauucaagccuguguaguauuuccggaugggcgaucuacaccaaagauaacucuauccggauuggcagcaagggugacguguucgucauacgcgagccuuuuaucuccugcucacauuuggagugucgaacuuucuuuuuaacacaaggggcucugcuaaaugauaaacacaguaacggaaccgugaaggaccguagcccauauagagcccucaugucuugcccgcugggcgaagcacccuccccuuacaauucaaaguucgagagcguugccuggagugcuucugcaugucaugauggcaugggguggcuuacgauuggaaucuccgguccagacaacggcgccguggcuguccugaaauauaacgggauaauuacugaaaccaucaagagcuggaaaaagaggaucuugcggacacaggagucggagugcguguguguaaauggaucuugcuuuacuauuaugaccgauggccccuccaacggugccgcgucauacaaaaucuucaagauugaaaaggggaaaguuacaaagaguauagagcucaaugcaccuaacuuucacuaugaagaguguagcugcuacccagacaccggaacggugaugugugucugccgcgauaauuggcacggcuccaacagacccugggugucuuucaaucagaaccuggacuaccagaucggcuauauuugcagcgggguguuuggagauaauccuaggccaaaagacggugagggcucauguaacccggucacuguugauggggccgacggagugaagggcuucaguuacaaauaugguaaugggguauggaucggccggacaaaguccaaccgccugcgaaaaggauuugaaaugaucugggaccccaauggcuggaccgauacugacagcaacuucucugugaagcaagaugucguggcuauuacagacuggucaggguacagugggagcuuuguucagcauccugagcucaccgguuuagauugcauaagaccauguuucuggguggaacuggucaggggccuuccccgggagaauacgaccaucuggacauccgggucuucgauuagcuucugcggagugaacuccgacacugccaacuggucauggccugauggcgcagaauugccauuuaccaucgacaaguga

SEQ ID NO: 136892 - RNA, 1413 nt, Artificial Sequence; identical to SEQ ID NO: 136844
  derived and/or modified sequence opt3 from neuraminidase__InfluenzaA__ABD77975

SEQ ID NO: 136893 - RNA, 1413 nt, Artificial Sequence; identical to SEQ ID NO: 136844
  derived and/or modified sequence opt3 from neuraminidase__InfluenzaA__ABD77986

SEQ ID NO: 136894 - RNA, 1413 nt, Artificial Sequence
  derived and/or modified sequence opt3 from neuraminidase__InfluenzaA__ABD77997
augaaccccaaucagaagaucauuaccauaggcagcaucuccauugccaucgggauucugucucucaugcuucaaaucggaaacauaaucucaauuugggcuagucacagcauccagacagguucccagaaucauacuggcauuugcaaccagagaaucauaacguacgagaauagcaccugggugaaccacacauaugucaauauuaacaauacuaacguuguggcagggaaagacaagaccucgguaacacuggccggaaauucaucuuuguguaguaucuccggcugggcgauuuacaccaaagauaacucuaucaggaucgguagcaagggggacguguucgucauucgggaaccuuuuauauccugcucacauuuagagugucgcacuuucuuucugacacaaggagcucuacucaaugauaaacacaguaacggcaccgugaaggaccgaagcccauaucgugcccugaugucuugcccgcuuggcgaagcacccuccccuuacaauucaaaguucgagagcguugccuggagugcuucugcaugucaugaugggaugggauggcugacgaucgguauuuccggcccagacaacggggccguggcugucuugaaauauaacggaaucauaacugaaaccauuaagagcuggaaaaagagaauccucaggacacaggagucggagugcguguguguaaauggcucuugcuuuacuaucaugaccgauggucccuccaacggggccgcgucauacaaaauuuucaagaucgaaaagggaaaaguuacaaagaguauugagcugaaugcaccuaacuuucacuaugaagaguguagcugcuacccagacaccggcacggugaugugugucugccgggauaauuggcacggcuccaaccgccccugggugucuuucaaucagaaccuggacuaccagauaggguauaucugcagcggaguguuuggugauaauccuagaccaaaagacggcgaggggucauguaacccggucacuguugauggagccgacggcgugaaggguuucaguuacaaauaugggaauggcguauggauuggaaggacaaaguccaaccggcuccgcaaaggcuuugaaaugaucugggaccccaauggguggaccgauacugacaacaauuucagcgugaagcaagaugucguggcuaucacagacuggucuggauacucagguaguuuuguucagcauccugaguuaaccggccuggauugcauucgaccauguuucuggguggaacuugucagaggguugcccagggagaacacgaccauauggacaagcggauccucuaucucguucugcggcgugaacagcgacacugccaauugguccuggccugauggugcagaacugccauuuaccauugacaaguga

SEQ ID NO: 136895 - RNA, 1413 nt, Artificial Sequence; identical to SEQ ID NO: 136844
  derived and/or modified sequence opt3 from neuraminidase__InfluenzaA__ABD78008

SEQ ID NO: 136896 - RNA, 1413 nt, Artificial Sequence; identical to SEQ ID NO: 136844
  derived and/or modified sequence opt3 from neuraminidase__InfluenzaA__ABD78019

SEQ ID NO: 136897 - RNA, 1413 nt, Artificial Sequence
  derived and/or modified sequence opt3 from neuraminidase__InfluenzaA__ABD78030
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaaccgaaccgugaaggaccguagcccauauagagcccucaugucuugcccgcugggcgaagcacccuccccuuacaauucaaaguucgagagcguugccuggagugcuucugcaugucaugauggcaugggguggcuuacgauuggaaucuccgguccagacaacggcgccguggcuguccugaaauauaacgggauaauuacugaaaccaucaagagcuggaaaaagaggaucuugcggacacaggagucggagugcguguguguaaauggaucuugcuuuacuauuaugaccgauggccccaacaauggugccgcguccuacaaaaucuucaagauugaaaaggggaaaguuacaaagucaauagagcucaacgcaccuaauuuucacuaugaagaguguaguugcuacccagacaccggaacggugaugugugucugccgcgauaacuggcacggcagcaauagacccuggguguccuucaaccagaaucuggacuaccagaucggcuauauuugcucugggguguuuggagauaacccuaggccaaaagacggugagggcagcuguaauccggucacuguugauggggccgacggagugaagggcuucucauacaaauaugguaacgggguauggaucggccggacaaagaguaaucgccugcgaaaaggauuugaaaugaucugggaccccaacggcuggaccgauacugacuccaauuucagcgugaagcaagaugucguggcuauuacagacuggucuggguacucaggaaguuuuguucagcauccugagcucaccgguuuagauugcauaagaccauguuucuggguggaacuggucaggggccuuccccgggagaacacgaccaucuggacaagcggguccucuauuucguucugcggagugaacagcgacacugccaauugguccuggccugauggcgcagaauugccauuuaccaucgacaaguga

SEQ ID NO: 136898 - RNA, 1413 nt, Artificial Sequence
  derived and/or modified sequence opt3 from neuraminidase__InfluenzaA__ABD78041
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccuccacggugaugugugucugccgggauaauuggcacggcucuaaccgccccugggugagcuucaaucagaaccuggacuaccagaucggcuauauuugcucagggguguuuggagauaauccuagaccaaaagacggugagggcaguuguaacccggucacuguugauggggccgacggagugaagggcuucuccuacaaauaugguaaugggguauggaucggcaggacaaagagcaaccggcugcgcaaaggauuugaaaugaucugggaccccaauggcuggaccgauacugacucuaacuucucagugaagcaagaugucguggcuauuacagacuggaguggguacagcggauccuuuguucagcauccugagcucaccgguuuagauugcauacgaccauguuucuggguggaacuggucagaggccuucccagggagaauacgaccaucuggacaucugggucgagcauuuccuucugcggagugaacucagacacugccaacuggaguuggccugauggcgcagaauugccauuuaccaucgacaaguga

SEQ ID NO: 136899 - RNA, 1410 nt, Artificial Sequence; identical to SEQ ID NO: 136878
  derived and/or modified sequence opt3 from neuraminidase__InfluenzaA__ABD78052

SEQ ID NO: 136900 - RNA, 1413 nt, Artificial Sequence; identical to SEQ ID NO: 136412
  derived and/or modified sequence opt3 from neuraminidase__InfluenzaA__ABD78063

SEQ ID NO: 136901 - RNA, 1413 nt, Artificial Sequence; identical to SEQ ID NO: 136412
  derived and/or modified sequence opt3 from neuraminidase__InfluenzaA__ABD78074

SEQ ID NO: 136902 - RNA, 1413 nt, Artificial Sequence; identical to SEQ ID NO: 136412
  derived and/or modified sequence opt3 from neuraminidase__InfluenzaA__ABD78085

SEQ ID NO: 136903 - RNA, 1413 nt, Artificial Sequence; identical to SEQ ID NO: 136412
  derived and/or modified sequence opt3 from neuraminidase__InfluenzaA__ABD78096

SEQ ID NO: 136904 - RNA, 1410 nt, Artificial Sequence
  derived and/or modified sequence opt3 from neuraminidase__InfluenzaA__ABD78118
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaaugugucccaaacuggcagaguacaggaauuggucaaagccucagugcaaaauuacaggguucgccccauuuaguaaggacaacagcauccggcuauccgcgggaggugauauaugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguauugccuggucaagcaguuccugccacgacgguaaggcauggcugcaugucugugugacagggcacgaugagaaugccaccgcuucuuucaucuacgacggaaggcugguagauagcauuggcuccuggaguaaaaagauccuccggacgcaggaaucagagugcguuuguaucaacggcacuugcacaguggucaugaccgacgggagcgcaucuggacgcgccgauacuaaaauuuuauuuauagaggaagguaagaucgugcacauuuccccucugucaggcagcgcucaacauguggaggaaugcaguuguuauccaagauacucuggggucaggugcguuugucgggacaauuggaagggauccaaccgcccgaucguggauauaaacguaaaagacuacagcauugugucgucuuaugucugcuccggccuugugggugacacaccccgaaagaaugauucaaguagcuccucucacuguuugaacccuaauaacgaggaagggggacauggcguuaaaggcugggccuucgacgaugggaaugacguguggaugggaagaaccaucagcgagaaguuuaggucagguuacgagacguucaaagucaucggcggguggaguaagccaaacuccaaacugcagauuaaucgucaggugaucguagaucggggaaaccgcagcggcuauucugguauauuuucaguugaagggaagaguugcauuaauagauguuucuacguggagcuaaucaggggccggaagcaggaaaccgaggucugguggacaagcaacuccauuguggucuuuugcggaacuucuggcaccuaugggacaggaucguggcccgacggugcggauaucaaucucaugccuaucuga

SEQ ID NO: 136905 - RNA, 1410 nt, Artificial Sequence; identical to SEQ ID NO: 136904
  derived and/or modified sequence opt3 from neuraminidase__InfluenzaA__ABD78129

SEQ ID NO: 136906 - RNA, 1410 nt, Artificial Sequence; identical to SEQ ID NO: 136134
  derived and/or modified sequence opt3 from neuraminidase__InfluenzaA__ABD79035

SEQ ID NO: 136907 - RNA, 1353 nt, Artificial Sequence
  derived and/or modified sequence opt3 from neuraminidase__InfluenzaA__ABD79115
augaaccccaaucagaagaucauuaccauaggcagcaucugcaugguggucgggauuaucucccugauuuuccaaaucggaaacauaguuucuaucuggauuucacacaguaucacagguacuuguaauagaagcauuuacgugaacaucuccaauacgaacguaguggccggcaaagacaccacaucugucauacucgcugggaauaguucacuuugcccuauuaggggaugggcaaucuauagcaaggauaacggcgugcggauugguaguaaaggggacguuuuugugauccgcgagccauucaucuccuguucucaucuggaaugccgaaccuuuuucuugacucagggagccuuacugaaugauaagcacagcaacggcacagucaaagaccguuccccguacagaacccuaaugucaugucccgugggcgaggcgccuaguccauauaauagcagguuugaaucuguagcuugguccgccucagcaugccaugaugggaugggauggcucacuauugguauaagcggccccgacgauggggccguugcugugcugaaguacaacggaaucauuacaggcaccaucaagaguuggcggaaagagauacuucgcacgcaggaaucugagugugucugcgugaaugguuccuguuucacuauuaugaccgacgggccuagcggaggcccagcaucguauaagaucuuuaaaaucgagaagggcaaagugacaaagucuauugaacuggaugcccccaacucccacuacgaggaaugcucauguuauccugacacuucgaaggucaugugcguuugcagagauaauuggcaugggagcaacaggccauggguguccuucgaccagaacuuggauuaccaaaugggauacaucuguucugguguauuuggcgacaauccgcggcccaaagacgggaagggaagcugcggcccuguguaugucgauggugcuaacggggugaaaggcuucucauaccgcuauggaaauggcguuuggauugggcgaaccaagaguuccagcucuagacagggauuugagaugauaugggacccaaacgguuggacagagaccgauucaaauuucuuuaugaaacaggacguggucgccgugacggauuggaguggcuacagcggguccuucguacagcaccccgaacucacuggacuggacuguaugaggccuugcuucuggguugagcugauccggggccguccaaaggaaaacacaauuuggaccucugguucgagcaucuccuuuuguggggucaauucagauacuguggacuggaguuggcccgauggcgcggagcucccguucacaaucgacaaauga

SEQ ID NO: 136908 - RNA, 1410 nt, Artificial Sequence
  derived and/or modified sequence opt3 from neuraminidase__InfluenzaA__ABD79126
augaaccccaaucagaagaucauuaccauaggcagcgugucccugacaaucacuacgauuugcuuccucaugcaaaucgccauucuugucaucaccguuacacugcacuuuaaacagugugagugcaacucuccuccaaauaaccaggugauguugugugaaccgacuauaaucgagagaaauauuaccgaaaucguauacuuaacaaacaccacuauugagaaggaaaucugccccaaacuggcugaguauaggaauuggucaaagccucaguguaaaauaacaggguucgcaccauuuaguaaggacaacagcauucggcuauccgccggaggugauaucugggugacccgcgagcccuacgucucuugcgacccuggcaaguguuaucaauucgcgcucgggcagggaacgacucugaauaaccgacauucgaaugauaccgugcacgaccguacaccauacagaacucuucugaugaacgaauugggcguucccuuucaucucgguaccaaacaggugugcauugcuuggucaagcaguuccugucacgaugggaaggccuggcugcaugucugcgugacaggacacaaugagaacgcaaccgccucuuucaucuaugacggcaggcugguagauagcaucggcuccuggaguaaaaauauucuccggacgcaggaaucagaguguguuugcauaaacgggacuugcacaguggucaugaccgacggaagcgcuucuggucgcgcagauacuaagaucuuauuuauugaggaaggcaaaaucgugcacauauccccucugucagggagcgcccaacauguggaggaauguaguugcuacccaagauauccgggagucagguguguuugccgggacaacuggaagggcucuaaucgccccauuguggauaucaacguaaaggacuacuccaucgugagcucguacgucuguucuggucuugugggggauacaccucggaaaaaugacuccucaaguagcuccuauugcuuggacccaaacaaugaggaaggaggccacggcguuaaggggugggcuuucgaugacggaaacgauguguggauggguagaaccauuucugagaaacugaggagcggcuacgagacguuuaaggucaucgggggauggucaaaacccaauaguaagcuacagauuaaccgacaggugauaguagacaaaggcaaucguuccgguuauagcgggaucuucucuguugaaggcaagucauguauuaaccgcugcuuuuacguggagcucaucagaggaaggaagcaggaaaccgaggucugguggacaaguaauagcaucguggucuucuguggcacuuccgggaccuauggaacagguucuuggccugauggcgccgacauuaaccugaugccaauauga

SEQ ID NO: 136909 - RNA, 1410 nt, Artificial Sequence; identical to SEQ ID NO: 136908
  derived and/or modified sequence opt3 from neuraminidase__InfluenzaA__ABD79137

SEQ ID NO: 136910 - RNA, 1410 nt, Artificial Sequence; identical to SEQ ID NO: 136908
  derived and/or modified sequence opt3 from neuraminidase__InfluenzaA__ABD79148

SEQ ID NO: 136911 - RNA, 1410 nt, Artificial Sequence; identical to SEQ ID NO: 136908
  derived and/or modified sequence opt3 from neuraminidase__InfluenzaA__ABD79159

SEQ ID NO: 136912 - RNA, 1410 nt, Artificial Sequence
  derived and/or modified sequence opt3 from neuraminidase__InfluenzaA__ABD79170
augaaccccaaucagaagaucauuaccauaggcagcgugucccugacaaucacuacgauuugcuuccucaugcaaaucgccauucuugucaucaccguuacacugcacuuuaaacagugugagugcaacucuccuccaaauaaccaggugauguugugugaaccgacuauaaucgagagaaauauuaccgaaaucguauacuuaacaaacaccacuauugagaaggaaaucugccccaaacuggcugaguauaggaauuggucaaagccucaguguaaaauaacaggguucgcaccauuuaguaaggacaacagcauucggcuauccgccggaggugauaucugggugacccgcgagcccuacgucucuugcgacccuggcaaguguuaucaauucgcgcucgggcagggaacgacucugaauaaccgacauucgaauaacaccgugcacgaucguacaccauacagaacucuucugaugaaugaauugggcguucccuuucaucucgguaccaaacaggugugcauugcuuggucaagcaguuccugucacgacgggaaggccuggcugcaugucugcgugacaggacacaacgagaaugcaaccgccucuuucaucuaugauggcaggcugguagacagcaucggcuccuggaguaaaaacauucuccggacgcaggaaucagaguguguuugcauaaacgggacuugcacaguggucaugaccgauggaagcgcuucuggucgcgcagacacuaagaucuuauuuauuaaagagggcaagaucgugcacguguccccucugucagggagcgcccaacaugucgaagaguguaguugcuacccaagauauccgggaguuaggugugugugccgggauaauuggaagggcucuaaccgccccauaguagacauuaaugugaaagauuacuccaucgucagcucguacguguguucuggucuuguuggggacacaccucgaaagaacgauuccucaaguagcuccuauugcuuggacccaaauaacgaagagggaggccacggcgugaaagggugggcuuucgacgauggaaaugacgucuggauggguagaaccaucucugaaaagcugaggagcggcuacgagacguuuaaagugauugggggauggucaaagcccaacaguaaacuacagaucaaucggcagguaauuguugauaagggcaaccguuccgguuauagcgggauauucucuguggagggcaagucauguaucaaucgcugcuuuuacgucgaacucauuagaggaaggaaacaggagaccgaagugugguggacaaguaacagcaucgucguguucuguggcacuuccgggaccuauggaacagguucuuggccugacggcgccgauaucaaucugaugccaauuuga

SEQ ID NO: 136913 - RNA, 1410 nt, Artificial Sequence; identical to SEQ ID NO: 136908
  derived and/or modified sequence opt3 from neuraminidase__InfluenzaA__ABD79181

SEQ ID NO: 136914 - RNA, 1410 nt, Artificial Sequence; identical to SEQ ID NO: 136908
  derived and/or modified sequence opt3 from neuraminidase__InfluenzaA__ABD79192

SEQ ID NO: 136915 - RNA, 1410 nt, Artificial Sequence
  derived and/or modified sequence opt3 from neuraminidase__InfluenzaA__ABD79203
augaaccccaaucagaagaucauuaccauaggcagcgugucccugacaaucacuacgauuugcuuccucaugcaaaucgccauucuugucaucaccguuacacugcacuuuaaacagugugagugcaacucuccuccaaauaaccaggugauguugugugaaccgacuauaaucgagagaaauauuaccgaaaucguauacuuaacaaacaccacuauugagaaggaaaaaugccccaagcuggcugaguauaggaauuggucaaaaccucaguguaagaucacaggguucgcaccauuuaguaaggacaacagcauacggcuauccgccggaggugauauuugggugacccgcgagcccuacgucucuugcgacccuggcaaauguuaucaauucgcgcucgggcagggaacgacucugaauaaccgacauucgaaugauaccgugcacgaccguacaccauacagaacucuucugaugaacgaauugggcguucccuuucaucucgguaccaaacaggugugcaucgcuuggucaagcaguuccugucacgaugggaaggccuggcugcaugucugcgugacaggacacaaugagaacgcaaccgccucuuucauuuaugacggcaggcugguagauagcaucggcuccuggucaaagaauauccuccggacgcaggaaagugaguguguuugcauuaacgggacuugcacaguggucaugaccgacggaagcgcuucuggucgcgcagauacuaaaauauuauuuaucgaggaaggcaagauugugcacaucuccccucugucagggagcgcccaacauguggaggaauguaguugcuacccaagauauccgggagucagguguguuugccgggacaacuggaagggcucuaaucgccccauaguggauauuaacaugaaagacuacuccaucguaagcucguacguguguucuggucuugucggggauacaccucgaaagaaugacuccucaaguagcuccuauugcuuggacccaaacaaugaggaaggaggccacggcgugaaagggugggcuuucgaugacggaaacgauguuuggauggguagaaccaucucugagaagcugaggagcggcuacgagacguuuaaagugauugggggauggucaaagcccaauaguaaacuacagaucaaccggcaggucauuguggacaagggcaaucguuccgguuauagcgggauauucucuguagaaggcaagucauguaucaaccgcugcuuuuacguugagcucauuagaggaaggaaacaggaaaccgaggugugguggacaaguaauagcaucgucguguucuguggcacuuccgggaccuauggaacagguucuuggccugauggcgccgacaucaaccugaugccaauuuga

SEQ ID NO: 136916 - RNA, 1410 nt, Artificial Sequence; identical to SEQ ID NO: 136908
  derived and/or modified sequence opt3 from neuraminidase__InfluenzaA__ABD79214

SEQ ID NO: 136917 - RNA, 1410 nt, Artificial Sequence
  derived and/or modified sequence opt3 from neuraminidase__InfluenzaA__ABD79236
augaaccccaaucagaagaucauuaccauaggcagcgugucccugacaaucacuacgauuugcuuccucaugcaaaucgccauucuugucaucaccguuacacugcacuuuaaacagugugagugcaacucuccuccaaauaaccaggugauguugugugaaccgacuauaaucgagagaaauauuaccgaaaucguauacuuaacaaacaccacuauugagaaggaaaucugccccaaacuggcugaguauaggaauuggucaaagccucaguguaaaauaacaggguucgcaccauuuaguaaggacaacagcauucggcuauccgccggaggugauaucugggugacccgcgagcccuacgucucuugcgacccuggcaaguguuaucaauucgcgcucgggcagggaacgacucugaauaaccgacauucgaauaacaccgcucacgaucguacaccauacagaacucuucugaugaaugaauugggcgugcccuuucaucucgguaccaaacagguuugcauugccuggucaagcaguuccugucacgacgggaaggcauggcugcaugugugcgucacaggacacaacgagaaugccaccgcuucuuucaucuaugauggcaggcugguggacagcaucggcuccuggaguaaaaacauucuccggacgcaggaaucagaguguguaugcauaaacgggacuugcacaguugugaugaccgauggaagcgcaucuggucgcgccgacacuaagaucuuauuuauuaaagagggcaagaucguccacauauccccucugucagggagcgcucaacauguggaagaguguaguugcuacccaagauauccgggagugaggugugucugccgggauaauuggaagggcucuaaccgccccauuguugacaucaaugugaaagauuacuccaucguaagcucguacguguguucuggucuugucggggacacaccucgaaagaacgauuccucaaguagcuccuauugcuuggacccaaauaacgaagagggaggccacggcgugaaagggugggccuucgacgauggaaaugacguuuggauggguagaaccauuucugaaaagcugaggagcggcuacgagacguuuaaagugaucgggggauggucaaagcccaacaguaaacuacagauuaaucggcaggucauaguggauaagggcaaccguuccgguuauagcgggaucuucucuguagagggcaagucauguauuaaucgcugcuuuuacguugaacucaucagaggaaggaaacaggagaccgaagugugguggacaaguaacagcaucgucguguucuguggcacuuccgggaccuauggaacagguucuuggccugacggcgcggauauuaaucugaugccaauauga

SEQ ID NO: 136918 - RNA, 1410 nt, Artificial Sequence
  derived and/or modified sequence opt3 from neuraminidase__InfluenzaA__ABD79247
augaaccccaaucagaagaucauuaccauaggcagcgugucccugacaaucacuacgauuugcuuccucaugcaaaucgccauucuugucaucaccguuacacugcacuuuaaacagugugagugcaacccuccaccgaauaaccaggugauguugugugaacccacuauaaucgagagaaauauuaccgaaaucguauacuuaacaaacaccacuauugagaaggaaaucugcccuaaacuggcugaguauaggaauuggucuaagccacaguguaaaauaacaggguucgcacccuuuucaaaggacaacaguauucggcuaagcgccggaggugauaucugggugacccgcgagccuuacgucuccugcgacccaggcaaguguuaucaauucgcgcucgggcagggaacgacucugaauaaccgacauucuaaugauaccgugcacgaccguacacccuacagaacucuucugaugaacgaauugggcguuccuuuucaucucgguaccaaacaggugugcauugcuuggucgucaagcaguugucacgaugggaaggccuggcugcaugucugcgugacaggacacaaugagaacgcaaccgccuccuucaucuaugacggcaggcugguagauucuaucggcagcugguccaaaaauauucuccggacgcaggaaucagaguguguuugcauaaacgggacuugcacaguggucaugaccgacggaagugcuagcggucgcgcagauacuaagaucuuauuuauugaggaaggcaaaaucgugcacauaucuccacuguccgggucagcccaacauguggaggaauguagcugcuacccgagauaucccggagucagguguguuugccgggacaacuggaagggcaguaaucgcccuauuguggauaucaacguaaaggacuacucuaucguguccagcuacgucuguucgggucuugugggggauacaccacggaaaaaugacucuuccucaaguagcuauugcuuggaccccaacaaugaggaaggaggccacggcguuaaggggugggcuuucgaugacggaaacgauguguggauggguagaaccauuuccgagaaacugaggucuggcuacgagacguuuaaggucaugggaggguggagcaaaccuaauucaaagcuacagaucaaccgacaggugauuguagaccguggcaaucgcagugguuauuccgggauauucagcguugaaggcaaaucuuguaucaacagaugcuuuuacguggagcucauuaggggacggaagcaggaaaccgaggucugguggacaucaaauaguaucguggucuucuguggcacuagcgggaccuauggaacagguuccuggccagauggcgccgacaucaaccugaugcccauuuga

SEQ ID NO: 136919 - RNA, 1410 nt, Artificial Sequence; identical to SEQ ID NO: 136343
  derived and/or modified sequence opt3 from neuraminidase__InfluenzaA__ABD94737

SEQ ID NO: 136920 - RNA, 1410 nt, Artificial Sequence; identical to SEQ ID NO: 136728
  derived and/or modified sequence opt3 from neuraminidase__InfluenzaA__ABD94748

SEQ ID NO: 136921 - RNA, 1413 nt, Artificial Sequence; identical to SEQ ID NO: 136844
  derived and/or modified sequence opt3 from neuraminidase__InfluenzaA__ABD94759

SEQ ID NO: 136922 - RNA, 1410 nt, Artificial Sequence; identical to SEQ ID NO: 136077
  derived and/or modified sequence opt3 from neuraminidase__InfluenzaA__ABD94770

SEQ ID NO: 136923 - RNA, 1413 nt, Artificial Sequence; identical to SEQ ID NO: 136412
  derived and/or modified sequence opt3 from neuraminidase__InfluenzaA__ABD94792

SEQ ID NO: 136924 - RNA, 1413 nt, Artificial Sequence; identical to SEQ ID NO: 136412
  derived and/or modified sequence opt3 from neuraminidase__InfluenzaA__ABD94803

SEQ ID NO: 136925 - RNA, 1413 nt, Artificial Sequence; identical to SEQ ID NO: 136412
  derived and/or modified sequence opt3 from neuraminidase__InfluenzaA__ABD94814

SEQ ID NO: 136926 - RNA, 1410 nt, Artificial Sequence; identical to SEQ ID NO: 136589
  derived and/or modified sequence opt3 from neuraminidase__InfluenzaA__ABD94825

SEQ ID NO: 136927 - RNA, 1410 nt, Artificial Sequence
  derived and/or modified sequence opt3 from neuraminidase__InfluenzaA__ABD94847
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgaagaucauagagagaaauaucacugaaauuguauauuuaaccaacacaaccaucgagaaagaaauuugucccaagcuggcagaguacaggaauuggucaaaaccucagugcaagaucacuggguucgccccauuuaguaaggacaacagcauacggcuauccgcgggaggugauauuugggugacacgcgagcccuaugucucuugugacccugauaaaugcuaccaauucgcucucggccaggggaccacgcugaauaaccgacauucgaaugacacugugcacgaucguaccccauauagaacacuucugaugaacgaauugggaguucccuuucaucucggcacuaaacagguguguaucgccuggucaagcaguuccugccacgacgguaaagcauggcugcaugucugugugaccgggcacgaugagaaugccacagcuucuuucauuuacgacggaaggcugguagauagcaucggcuccuggucaaagaaaauccuccggacccaggaaagugagugcguuuguauuaacggcacgugcacuguggucaugacagacgggagcgcaucuggacgcgccgugaccaagauauuauuuaucgaggaagguaagauugugcacaucuccccucugcuuggcucagcucaacaugucgaggaaugcagcuguuauccaagauacccggggguuaggugcgugugucgggauaauuggaaaggaaguaaccgccccauaguagacauuaacgugaaggauuacucuaucgucuccagcuaugugugcucgggcuugguuggugacacuccucgaaagaaugacucuuccucaaguagccacugucugaacccaaauaacgaggaagggggacauggcgugaagggcugggccuucgaugacgggaaugaugucuggaugggaagaacaaucuccgagaaacuaaggucugguuacgagaccuuuaaggugauugaaggcuggagcaaacccaacucaaagcuccagaucaaucggcagguaauuguugaccgugggaaccgcaguggauauuccggcauauucagcguggaggguaagucuugcaucaauagauguuuuuacgucgaacugauuagggggcggaaacaggagacggaagugugguggaccucaaacaguaucgucguguucugcggcacaagcggaacuuauggcaccggguccuggccugauggagcggacaucaaucuuaugccaauuuga

SEQ ID NO: 136928 - RNA, 1410 nt, Artificial Sequence; identical to SEQ ID NO: 136142
  derived and/or modified sequence opt3 from neuraminidase__InfluenzaA__ABD94858

SEQ ID NO: 136929 - RNA, 1410 nt, Artificial Sequence; identical to SEQ ID NO: 136142
  derived and/or modified sequence opt3 from neuraminidase__InfluenzaA__ABD94880

SEQ ID NO: 136930 - RNA, 1410 nt, Artificial Sequence
  derived and/or modified sequence opt3 from neuraminidase__InfluenzaA__ABD94891
augaaccccaaucagaagaucauuaccauaggcagcgugucccugacaaucacuacgauuugcuuccucaugcaaaucgccauucuugucaucaccguuacacugcacuuuaaacagugugagugcaacucuccuccaaauaaccaggugauguugugugaaccgacuauaaucgagagaaauauuaccgaaaucguauacuuaacaaacaccacuauugagaaggaaaucugccccaaacuggcugaguauaggaauuggucaaagccucaguguaaaauaacaggguucgcaccauuuaguaaggacaacagcauucggcuauccgccggaggugauaucugggugacccgcgagcccuacgucucuugcgacccuggcaaguguuaucaauucgcgcucgggcagggaacgacucugaauaaccgacauucgaaugauaccgugcacgaccguacaccauacagaacucuucugaugaacgaauugggcguucccuuucaucucgguaccaaacaggugugcauugcuuggucaagcaguuccugucacgaugggaaggccuggcugcaugucugcgugacaggacacaaugagaacgcaaccgccucuuucaucuaugacggcaggcugguagauagcaucggcuccuggaguaaaaauauucuccggacgcaggaaucagaguguguuugcauaaacgggacuugcacaguggucaugaccgacggaagcgcuucuggucgcgcagauacuaagguguuauuuaucgaggaaggcaaaauugugcacaucucccaacugucagggagcgcccagcaugucgaggaauguaguugcuacccuagauauccaggaguuaggugugugugccgggacaacuggaagggcucuaaucgcccgauaguagauauuaacgugaaggacuacuccaucgucagcucguacguguguucuggucuuguuggggauacaccccgaaagaaugacuccucaaguagcuccuauugcuuggacccuaacaaugaggaaggaggccacggcgugaaagggugggcuuucgaugacggaaacgaugucuggauggguagaaccaucucugagaaacugaggagcggcuacgagacguuuaaggugauugggggauggucaaaaccaaauaguaagcuacagaucaaccggcagguaauuguugaccguggcaaucgcuccgguuauagcgggauauucucuguggaaggcaaaucauguaucaacagaugcuuuuacgucgagcucauuaggggacggaagcaagaaaccgaggugugguggacaaguaauagcaucgucguguucuguggcacuuccgggaccuauggaacagguucuuggcccgauggcgccgacaucaaccugaugccuauuuga

SEQ ID NO: 136931 - RNA, 1410 nt, Artificial Sequence; identical to SEQ ID NO: 136908
  derived and/or modified sequence opt3 from neuraminidase__InfluenzaA__ABD94902

SEQ ID NO: 136932 - RNA, 1410 nt, Artificial Sequence
  derived and/or modified sequence opt3 from neuraminidase__InfluenzaA__ABD94924
augaaccccaaucagaagaucauuaccauaggcagcgugucccugacaaucgccacuauuugccuccuuaugcaaaucgcuauucuggucacgaccguuacauugcacuucaaacaguacgaguguaacucuccuccaaauaaccaggugauguuaugcgaaccgacuaucauagagagaaauaucaccgaaauuguauaucugacaaacaccacuaucgagaaggaaauuugucccaaacuagcagaguacaggaauuggucaaagccucagugcaaaaucacaggguuugccccauucaguaaggacaacagcauacggcucuccgcgggaggugauauuugggugacccgcgagcccuaugucucuugugacccugauaagugcuaccaauuugcucugggccaggggacgacucuuaauaaccgacauucgaaugacaccgugcacgaucguacaccauauagaacucuguugaugaacgaacucggaguucccuuccaucugggcaccaaacagguguguaucgccuggucaagcaguuccugccacgacgguaaggcauggcugcaugucugugugacagggcacgaugagaaugccaccgcuucuuuuauuuacgacggaaggcucguagauagcaucggcuccuggaguaaaaagaucuuacggacgcaggaaucagagugcguuuguauuaacggcacuugcacaguggucaugaccgacgggagcgcaucuggacgcgccgauacuaaaauacuguucaucgaggaagguaagauugugcacaucucccaacuuuugggcucagcucagcauguggaggaaugcagcuguuauccuagauacccaggggucaggugcguuugucgggacaauuggaagggaaguaaccgcccgauaguggauauuaacguaaaagacuacucuaucguguccagcuaugucugcucgggccuggugggugacacaccccgaaagaaugauucuuccucaaguagccacugucuaaacccuaauaacgaggaagggggacauggcguuaaaggcugggccuuugacgaugggaaugacguguggaugggaagaaccaucuccgagaagcucaggucugguuacgagacguucaaagucauugaaggcuggagcaagccaaacucaaaacugcagaucaaucgucaggugauuguagaucgggggaaccgcaguggauauuccggcauauuuagcguugaggguaagucuugcaucaauagauguuucuacguggaacuuauuagggggcggaagcaagagaccgaagucugguggacaucaaacaguaucguggucuuuugcggcacuagcggaaccuauggcacaggguccuggcccgacggagcggauaucaaucugaugccuauuuga

SEQ ID NO: 136933 - RNA, 1410 nt, Artificial Sequence
  derived and/or modified sequence opt3 from neuraminidase__InfluenzaA__ABD94946
augaaccccaaucagaagaucauuaccauaggcagcgugucccugacaaucgccacuauuugcuuccucacgcagaucgcuauucuugucaccacaguuacucugcacuuuaaacaguacgaguguaacucuccuccaaauaaccaggugauguugugcgaaccgaccaucauagagagaaauaucacagaaauuguauauuuaaccaacacuacaaucgagaaggaaauuugucccaaacuggcagaguacaggaauuggucaaagccucagugcaacaucaccggguucgccccauuuaguaaagacaauagcauacggcuauccgcgggaggugauauuugggugacgcgcgagcccuaugucucuugugacccugauaagugcuaccaauucgcucucggccaggggacuacccugaacaauggacauucgaacgacacagugcacgaucgaacuccauaucguacccuucugaugaaugaauugggcguucccuuucaucucgguacaaaacagguguguaucgccuggucaagcaguuccugccacgacgggaaagcauggcugcaugucugugugaccggagaugacaagaacgccacggcuucuuucauuuacaauggcagacugguagauagcaucggcuccuggucaaagaagauccucaggacucaggagagugaaugcguuuguauuaacgggacaugcaccguggucaugacugacggaagcgcaucugguaaagccgauacaaagauauuauuuaucgaggagggcaagauugugcacaccucccugcuuucagggagcgcucaacacguggaagagugcaguuguuauccucgguacccaggaguccgcugcguuuguagagacaacuggaaaggcucuaauaggccgaucguggauauaaacguaaaggacuacuccauugugagcucguaugucugcucugguuuggugggggacacgccccggaaaaaugaucgcuccucaaguagccauugucuggacccuaacaaugaagagggaggccacggcguuaaggggugggccuucgaugacggaaacgauguguggaugggucgaaccaucuccgaaaaacuaagaucuggcuacgagacauuuaaggucaucgagggguggagcaaaccaaauucaaagcuccagauuaacaggcaagugaucguagaccgggauaaucguaguggauauuccggcauuuucagcguugaagguaagucuugcauaaaccgcuguuuuuacguggagcugaucagagggaggaaucaggaaacugagguccuuuggaccucaaacaguauuguggucuucugcggcacaagcggaacuuauggcaccggguccuggcccgacggagcggauaucaaucugaugccuaucuga

SEQ ID NO: 136934 - RNA, 1410 nt, Artificial Sequence
  derived and/or modified sequence opt3 from neuraminidase__InfluenzaA__ABD94957
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgacucaaguagcuccucucauugccuugauccuaauaacgaagagggugggcacggaguuaagggcugggcuuucgacgauggcaaugacguguggauggggcgcaccauuagcgaaaaauugcgaucaggauacgagacauuuaaggucaucgaggguuggaguaacccaaauuccaaacugcagauuaacagacaggugauaguagauaggggcaaucggagcggguauucuggaaucuucucaguugaaaguaagagcuguauuaaccguugcuuuuacguggagcuaauccgcggcagaaaggaagagacugaaguccucuggaccuccaauucuaucguggucuucugugguacaucggggacuuauggcaccggaagcuggcccgacggcgccgauauuaaccugaugccuauauga

SEQ ID NO: 136935 - RNA, 1413 nt, Artificial Sequence; identical to SEQ ID NO: 136844
  derived and/or modified sequence opt3 from neuraminidase__InfluenzaA__ABD94968

SEQ ID NO: 136936 - RNA, 1413 nt, Artificial Sequence; identical to SEQ ID NO: 136844
  derived and/or modified sequence opt3 from neuraminidase__InfluenzaA__ABD94990

SEQ ID NO: 136937 - RNA, 1413 nt, Artificial Sequence
  derived and/or modified sequence opt3 from neuraminidase__InfluenzaA__ABD95001
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauauccauaacacuaauguuguggcagggaaagacaagaccucgguaacacuugccggaaacucaagccuguguaguauuuccggcugggcgaucuacaccaaagauaauucuaucaggauugguagcaagggggacguguucgucauacgggagccuuuuaucuccugcucacacuuggagugucgcacuuucuuuuuaacacaaggagcucugcuaaacgauaaacauaguaauggcaccgugaaggaccgaagcccauaucgugcccucaugucuugcccgcugggcgaagcacccuccccuuacaacucaaaguucgagagcguugccuggagugcuucugcaugucacgaugggaugggauggcuuacgauugguaucuccggcccagacaauggggccguggcuguccugaaauauaacggaauaauuacugaaaccaucaagagcuggaaaaagagaaucuugaggacacaggagucggagugcguguguguaaacggcucuugcuuuacuauuaugaccgauggucccuccaauggggccgcgucauacaaaaucuucaagauugaaaagggaaaaguuacaaagaguauagagcucaacgcaccuaauuuucacuaugaagaguguagcugcuacccagacaccggcacggugaugugugucugccgggauaacuggcauggcuccaaucgccccugggugucuuucaaccagaaucuggacuaccagaucggguauauuugcagcggaguguuuggugauaacccuagaccaaaagacggcgaggggucauguaauccggucacuguugauggagccgacggcgugaaggguuucaguuacaaauaugggaacggcguauggaucggaaggacaaaguccaaucggcugcgcaaaggcuuugaaaugaucugggaccccaacggguggaccgauacugacagcaauuucucuaugaagcaagauguggucgcuauuacagacuggucaggauacagugguagcuuugugcagcacccugagcucaccggcuuagauugcauacgaccauguuucuggguugaacuggugagagggcuucccagggagaacacgaccaucuggacauccggaucuucgauuagcuucugcggcgucaauuccgacacugccaacuggucauggccugauggugcagaauugccauuuaccaucgacaaguga

SEQ ID NO: 136938 - RNA, 1413 nt, Artificial Sequence
  derived and/or modified sequence opt3 from neuraminidase__InfluenzaA__ABD95012
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcgaggggucauguaacccggucacuguugauggagccgacggcgugaaggguuucaguuacaaauaugggaauggcguauggaucggaaggacaaaguccaaccggcugcgcaaaggcuuugaaaugaucugggaccccaauggguggaccaacacugauagcaauuucucugugaagcaagacgucguggcuauuacagauuggucaggauacagugguagcuuuguucagcauccugagcucaccggcuuagacugcauacgaccauguuucuggguggaacuggucagagggcuucccagggagaacacgaccaucuggacauccggaucuucgauuagcuucugcggcgugaacuccgauacugccaauuggucauggccugacggugcagaauugccauuuaccaucgauaaguga

SEQ ID NO: 136939 - RNA, 1413 nt, Artificial Sequence; identical to SEQ ID NO: 136844
  derived and/or modified sequence opt3 from neuraminidase__InfluenzaA__ABD95023

SEQ ID NO: 136940 - RNA, 1413 nt, Artificial Sequence
  derived and/or modified sequence opt3 from neuraminidase__InfluenzaA__ABD95034
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcgaggggucauguaacccggucacuguugauggagccgacggcgugaaggguuucaguuacaaauaugggaauggcguauggaucggaaggacaaaguccaaccggcugcgcaaaggcuuugaaaugaucugggaccccaauggguggaccgauacugacagcaacuucucugugaagcaagaugucguggcuauuacagacuggucaggauacagugguagcuuuauacagcauccugagcucaccggcuuagauugcauccgaccauguuucuggguugaacuggugagagggcuucccagggagaauacgaccauuuggacauccggaucuucgaucagcuucugcggcgucaacuccgacacugccaacuggucauggccugauggugcagaauugccauuuaccauugacaaguga

SEQ ID NO: 136941 - RNA, 1413 nt, Artificial Sequence
  derived and/or modified sequence opt3 from neuraminidase__InfluenzaA__ABD95056
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagcagaucuugagaacacaggagucggagugcguguguguaaauggcucuugcuuuacuauuaugaccgauggucccuccaacggggccgcgucauacaaaaucuucaagauugaaaagggaaaaauaacaaagaguaucgagcucaaugcaccuaacuuucacuaugaagaguguagcugcuacccagacaccggcacgguuaugugugugugcagggauaauuggcacggcuccaaccggcccugggucucuuucaaucagaaccuggacuaccaaauuggguauaucugcagcggaguguuuggugauaauccucgcccaaaagacggcgaggggucauguaacccggugacugucgauggagccaauggcguuaaggguuucaguuacaaauaugggaacggcguguggaucggaagaacaaaguccaauaggcugcggaaaggcuuugaaaugauuugggaccccaacggguggaccgacacugauagcgacuucucuguaaagcaggauguggucgcuauaacagacuggucaggauacagugguagcuuugugcagcauccugagcucaccggcuuaaauugcauccgcccauguuucuggguugaacuggugcgagggcuucccaaggagaacacgaccauuuggacauccggaucuucgaucagcuucugcggcgucaacuccgauacugccaauuggucauggccugacggugcagaauugccauuuaccauugauaaauga

SEQ ID NO: 136942 - RNA, 1413 nt, Artificial Sequence; identical to SEQ ID NO: 136412
  derived and/or modified sequence opt3 from neuraminidase__InfluenzaA__ABD95067

SEQ ID NO: 136943 - RNA, 1413 nt, Artificial Sequence; identical to SEQ ID NO: 136412
  derived and/or modified sequence opt3 from neuraminidase__InfluenzaA__ABD95078

SEQ ID NO: 136944 - RNA, 1413 nt, Artificial Sequence; identical to SEQ ID NO: 136941
  derived and/or modified sequence opt3 from neuraminidase__InfluenzaA__ABD95089

SEQ ID NO: 136945 - RNA, 1413 nt, Artificial Sequence; identical to SEQ ID NO: 136412
  derived and/or modified sequence opt3 from neuraminidase__InfluenzaA__ABD95100

SEQ ID NO: 136946 - RNA, 1413 nt, Artificial Sequence
  derived and/or modified sequence opt3 from neuraminidase__InfluenzaA__ABD95111
augaaccccaaucagaagaucauuaccauaggcagcaucuccauugccaucgggaugauuucucugaugcuccaaaucggaaacauaaucucaauuugggcuagucacagcauccagacagguucccagaaucauacuggcgugugcaaccagagaauuaucacguacgaaaauucuaccugggucaaccacacauauguuaauauaaacaauacuaacgugauugcagggaaagacaagaccucgguaacacuugccggaaauucaagccuguguaguaucuccggcugggcgauuuacaccaaagauaacucuaucaggaucgguagcaagggggacguguucgucauucgggagccuuuuauauccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgaucgguauuuccggcccagacaacggggccguggcuguccugaaauauaacggaaucauaacugaaaccauuaagagcuggaaaaagcagaucuugagaacacaggagucggagugcguguguguaaauggcucuugcuuuacuaucaugaccgauggucccuccaacggggccgcgucauacaaaauuuucaagaucgaaaagggaaaaguuacaaagaguauugagcucaaugcaccuaacuuucacuaugaagaguguagcugcuacccagacaccggcacggugaugugugucugcagggauaauuggcacggcuccaaccggcccugggugucuuucaaucagaaccuggacuaccaaauaggguauaucugcagcggaguguuuggugauaauccucgcccaaaagacggcgaggggucauguaacccggucacuguugauggagccaauggcgugaaggguuucaguuacaaauaugggaacggcguauggauuggaagaacaaaguccaauaggcugcggaaaggcuuugaaaugaucugggaccccaacggguggaccgacacugauagcgacuucucugugaagcaggaugucguggcuaucacagacuggucaggauacagugguagcuuuguucagcauccugagcucaccggcuuagauugcauucgcccauguuucuggguggaacugguccgagggcuucccaaggagaauacgaccauauggacauccggaucuucgaucagcuucugcggcgugaacuccgacacugccaacuggucauggccugauggugcagaauugccauuuaccauugacaaauga

SEQ ID NO: 136947 - RNA, 1413 nt, Artificial Sequence; identical to SEQ ID NO: 136946
  derived and/or modified sequence opt3 from neuraminidase__InfluenzaA__ABD95122

SEQ ID NO: 136948 - RNA, 1413 nt, Artificial Sequence; identical to SEQ ID NO: 136412
  derived and/or modified sequence opt3 from neuraminidase__InfluenzaA__ABD95144

SEQ ID NO: 136949 - RNA, 1413 nt, Artificial Sequence; identical to SEQ ID NO: 136412
  derived and/or modified sequence opt3 from neuraminidase__InfluenzaA__ABD95155

SEQ ID NO: 136950 - RNA, 1413 nt, Artificial Sequence
  derived and/or modified sequence opt3 from neuraminidase__InfluenzaA__ABD95166
augaaccccaaucagaagaucauuaccauaggcagcaucuccauugccaucgggaugauuucucugaugcuccaaaucggaaacauaaucucaauuugggcuagucacagcauccagacagguucccagaaucauacuggcgugugcaaccagagaauuaucacguacgaaaauucuaccugggucaaccacacauauguuaauauaaacaauacuaacgugauugcagagaaagacaagaccucgguaacacuugccggaaauucaagccuguguaguaucuccggaugggcgauuuacaccaaagauaacucuaucaggaucggcagcaagggugacguguucgucauucgggagccuuuuauauccugcucacauuuggaaugucgcacuuucuuuuuaacacaaggggcucugcuaaaugauaaacacaguaacggaaccgugaaggaccgaagcccauaucgugcccucaugucuugcccgcugggcgaggcacccuccccuuacaauucaaaguucgaaagcguugccuggagugcuucugcaugucaugauggcaugggguggcuuacgaucggaauuuccgguccagacaacggcgccguggcuguccugaaauauaacgggaucauaacugagaccauuaagagcuggaaaaagcagaucuugagaacacaggagucggaaugcguguguguaaauggaucuugcuuuacuaucaugaccgauggccccuccaacggugccgcgucauacaaaauuuucaagaucgagaaggggaaaguuacaaagaguauugaacucaaugcaccuaacuuucacuaugaggaguguagcugcuacccagacaccggaacggugaugugugucugcagggauaauuggcacggcuccaaccggcccugggugucuuucaaucagaaccuggacuaccaaauaggcuauaucugcagcgggguguuuggagauaauccucgcccaaaagacggugaaggcucauguaacccggucacuguugauggggccaauggagugaagggcuucaguuacaaauaugguaacgggguauggauuggcagaacaaaguccaauaggcugcggaaaggauuugagaugaucugggaccccaacggcuggaccgacacugauagcgacuucucugugaagcaggaugucguggcuaucacagacuggucaggguacagugggagcuuuguucagcauccugaacucaccgguuuagauugcauucgcccauguuucuggguggagcugguccgaggccuucccaaggaaaauacgaccauauggacauccgggucuucgaucagcuucugcggagugaacuccgacacugccaacuggucauggccugauggcgcagaguugccauuuaccauugacaaauga

SEQ ID NO: 136951 - RNA, 1413 nt, Artificial Sequence; identical to SEQ ID NO: 136941
  derived and/or modified sequence opt3 from neuraminidase__InfluenzaA__ABD95177

SEQ ID NO: 136952 - RNA, 1413 nt, Artificial Sequence
  derived and/or modified sequence opt3 from neuraminidase__InfluenzaA__ABD95188
augaaccccaaucagaagaucauuaccauaggcagcaucuccacaacuauugggaucauuucucugaugcuccaaaucggaaacauaaucucaauuugggccagucacagcauccagacggguucccagaaucauaccggcgugugcaaccagagaauuaucacauacgaaaauucuacuugggucaaccacaccuauguuaauauaaacaauacaaacgugauugcugggaaagacaagaccucgguaacucuugcaggaaauucaagccuguguaguaucuccggcugggccauuuacacaaaagauaacucuaucaggaucgguagcaagggggacguguucgucauucgggagccuuuuauauccugcucacauuuggagugucgcaccuucuuuuuaacgcaaggagcgcugcuaaaugauaaacacaguaacggcacugugaaggaccgaagcccauaucgugcucucaugucuugcccgcugggcgaagcccccuccccuuacaauucaaaguucgagagcguugcauggagugccucugcuugucaugaugggaugggauggcuuaccaucgguauuuccggcccagacaacggggcaguggccguccugaaauauaacggaaucauaacagaaacuauuaagagcuggaaaaagcagaucuugagaacccaggagucggagugcguguguguaaauggcucuugcuuuacaaucaugaccgauggucccuccaacggggcugccucauacaaaauuuucaagaucgaaaagggaaaaguuacgaagaguauugagcucaaugcgccuaacuuucacuaugaagaguguagcugcuacccagacacuggcacagugaugugugucugcagggauaauuggcacggcuccaaccggcccugggugucuuucaaucagaaccuggacuaccaaauaggguauaucugcagcggaguguuuggugauaauccucgcccaaaagacggcgaggggucauguaacccggucaccguugauggagcaaauggcgugaaggguuucaguuacaaauaugggaacggcguauggauuggaagaacuaaguccaauaggcugcggaaaggcuuugaaaugaucugggaccccaacggguggacagacaccgauagcgacuucucugugaagcaggaugucguggccaucacggacuggucaggauacagugguagcuuuguucagcauccugagcucaccggcuuagauugcauucgcccauguuucuggguggaacugguccgagggcuucccaaggagaauacaacuauauggaccuccggaucuucgaucagcuucugcggcgugaacuccgacacagcuaacuggucauggccugauggugccgaauugccauuuacuauugacaaauga

SEQ ID NO: 136953 - RNA, 1413 nt, Artificial Sequence; identical to SEQ ID NO: 136941
  derived and/or modified sequence opt3 from neuraminidase__InfluenzaA__ABD95199

SEQ ID NO: 136954 - RNA, 1413 nt, Artificial Sequence; identical to SEQ ID NO: 136431
  derived and/or modified sequence opt3 from neuraminidase__InfluenzaA__ABD95210

SEQ ID NO: 136955 - RNA, 1413 nt, Artificial Sequence
  derived and/or modified sequence opt3 from neuraminidase__InfluenzaA__ABD95221
augaaccccaaucagaagaucauuaccauaggcagcaucuccauugccaucgggaugauuucucugaugcuccaaaucggaaacauaaucucaauuugggcuagucacagcauccagacagguucccagaaucauacuggcgugugcaaccagagaauuaucacguacgaaaauucuaccugggucaaccacacauauguuaauauaaacaauacuaacgugauugcagggaaagacaagaccucgguaacacuugccggaaauucaagccuguguaguaucuccggcugggcgauuuacaccaaagauaacucuaucaggaucgguagcaagggggacguguucgucauucgggagccuuuuauauccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgaucgguauuuccggcccagacaacggggccguggcuguccugaaauauaacggaaucauaacugaaaccauuaagagcuggaaaaagcagaucuugagaacacaggagucggagugcguguguguaaauggcucuugcuuuacuaucaugaccgauggucccuccaacggggccgcgucauacaaaauuuucaagaucgaaaagggaaaaguuacaaagaguauugagcucaaugcaccuaacagccacuaugaagaguguuccugcuacccagacaccggcacggugaugugugucugcagggauaauuggcacggcucuaaccggcccugggugagcuuuaaucagaaccuggacuaccaaauaggguauaucugcucaggaguguucggugauaauccucgcccaaaagacggcgaggggaguuguaacccggucacuguugauggagccaauggcgugaaggguuuuuccuacaaauaugggaacggcguauggauuggaagaacaaagagcaauaggcugcggaaaggcuucgaaaugaucugggaccccaacggguggaccgacacugauucugacuuuucagugaagcaggaugucguggcuaucacagacuggaguggauacagcgguuccuucguucagcauccugagcucaccggcuuagauugcauucgcccauguuuuuggguggaacugguccgagggcuucccaaggagaauacgaccauauggacaucuggaucgagcaucuccuucugcggcgugaacucagacacugccaacuggaguuggccugauggugcagaauugccauucaccauugacaaauga

SEQ ID NO: 136956 - RNA, 1413 nt, Artificial Sequence; identical to SEQ ID NO: 136946
  derived and/or modified sequence opt3 from neuraminidase__InfluenzaA__ABD95232

SEQ ID NO: 136957 - RNA, 1413 nt, Artificial Sequence; identical to SEQ ID NO: 136412
  derived and/or modified sequence opt3 from neuraminidase__InfluenzaA__ABD95243

SEQ ID NO: 136958 - RNA, 1413 nt, Artificial Sequence; identical to SEQ ID NO: 136946
  derived and/or modified sequence opt3 from neuraminidase__InfluenzaA__ABD95254

SEQ ID NO: 136959 - RNA, 1413 nt, Artificial Sequence; identical to SEQ ID NO: 136431
  derived and/or modified sequence opt3 from neuraminidase__InfluenzaA__ABD95265

SEQ ID NO: 136960 - RNA, 1413 nt, Artificial Sequence; identical to SEQ ID NO: 136412
  derived and/or modified sequence opt3 from neuraminidase__InfluenzaA__ABD95276

SEQ ID NO: 136961 - RNA, 1413 nt, Artificial Sequence
  derived and/or modified sequence opt3 from neuraminidase__InfluenzaA__ABD95287
augaaccccaaucagaagaucauuaccauaggcagcaucuccguggccauugggaucauuucucugaugcuccaaaucggaaacauaaucucaauuugggcuagucacagcauccagacagguucccagaaucauacuggcgucugcaaccagagaauuaucacguacgaaaauucuaccuggguuaaccacacauaugugaauauaaacaauacuaacguaauugcagggaaagacaagaccucggugacacuugccggaaauucaagccuguguaguaucuccggcugggcgauuuacaccaaagauaacucuaucaggaucgguagcaagggggacgucuucgugauucgggagccuuuuauauccugcucacauuuggagugucgcacuuucuuuuuaacacaaggagcucugcuaaaugauaaacacaguaacggcaccguuaaggaccgaagcccauaucgugcccucaugucuugcccgcugggcgaagcacccuccccuuacaauucaaaguucgagagcguggccuggagugcuucugcaugucaugaugggaugggauggcuuacgaucgguauuuccggcccagacaacggggccgucgcugugcugaaauauaacggaaucauaacugaaaccauuaagagcuggaaaaagcagaucuugagaacacaggagucggagugcguauguguuaauggcucuugcuuuacuaucaugaccgauggucccuccaacggggccgcgucauacaaaauuuucaagaucgaaaagggaaaagugacaaagaguauugagcucaaugcaccuaacuuucacuaugaagaguguagcugcuacccagacaccggcacggucaugugugugugcagggauaauuggcacggcuccaaccggcccugggugucuuucaaucagaaccuggacuaccaaauaggguauaucugcagcggagucuuuggugauaauccucgcccaaaagacggcgaggggucauguaacccgguuacuguggauggagccaauggcguaaaggguuucaguuacaaauaugggaacggcguguggauuggaagaacaaaguccaauaggcugcggaaaggcuuugaaaugaucugggaccccaacggguggaccgacacugauagcgacuucucugucaagcaggaugugguugcuaucacagacuggucaggauacagugguagcuuugugcagcauccugagcucaccggcuuagauugcauucgcccauguuucugggucgaacuggugcgagggcuucccaaggagaauacgaccauauggacauccggaucuucgaucagcuucugcggcguaaacuccgacacugccaacuggucauggccugauggugcagaauugccauuuaccauugacaaauga

SEQ ID NO: 136962 - RNA, 1413 nt, Artificial Sequence; identical to SEQ ID NO: 136412
  derived and/or modified sequence opt3 from neuraminidase__InfluenzaA__ABD95298

SEQ ID NO: 136963 - RNA, 1413 nt, Artificial Sequence
  derived and/or modified sequence opt3 from neuraminidase__InfluenzaA__ABD95309
augaaccccaaucagaagaucauuaccauaggcagcaucuccauugccaucgggaugauuucucugaugcuccaaaucggaaacauaaucucaauuugggcuagucacagcauccagacagguucccagaaucauacuggcgugugcaaccagagaauuaucacguacgaaaauucuaccugggucaaccacacauauguuaauauaaacaauacuaacgugauugcagggaaagacaagaccucgguaacacuugccggaaauucaagccuguguaguaucuccggcugggcgauuuacaccaaagauaacucuaucaggaucgguagcaagggggacguguucgucauucgggagccuuuuauauccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgaucgguauuuccggcccagacaacggggccguggcuguccugaaauauaacggaaucauaacugaaaccauuaagagcuggaaaaagcagaucuugagaacacaggagucggagugcguguguguaaauggcucuugcuuuacuaucaugaccgauggucccuccaacggggccgcgucauacaaaauuuucaagaucgaaaagggaaaaguuacaaagaguauugagcucaaugcaccuaacuuucacuaugaagaguguagcugcuacccagacaccggcacggugaugugugucugcagggauaauuggcacggcuccaaccggcccugggugucuuucaaucagaaccuggacuaccaaauaggguauaucugcagcggaguguuuggugauaauccucgcccaaaagacggcgaggggucauguaacccggucacuguugauggagccaauggcgugaaggguuucaguuacaaauaugggaacggcguauggauuggaagaacaaagugcaauaggcugcggaaaggcuuugaaaugaucugggaccccaacggguggaccgacacugauuccgacuucagcgugaagcaggaugucguggcuaucacagacuggucuggauacucagguaguuuuguucagcauccugagcucaccggcuuagauuguauucgcccaugcuucuggguggaacugguccgagggcuucccaaggagaauacgaccauauggacaagcggauccucuaucucguucuguggcgugaacagcgacacugccaacugguccuggccugauggugcagaauugccauuuaccauugacaaauga

SEQ ID NO: 136964 - RNA, 1413 nt, Artificial Sequence; identical to SEQ ID NO: 136412
  derived and/or modified sequence opt3 from neuraminidase__InfluenzaA__ABD95320

SEQ ID NO: 136965 - RNA, 1413 nt, Artificial Sequence; identical to SEQ ID NO: 136941
  derived and/or modified sequence opt3 from neuraminidase__InfluenzaA__ABD95331

SEQ ID NO: 136966 - RNA, 1413 nt, Artificial Sequence
  derived and/or modified sequence opt3 from neuraminidase__InfluenzaA__ABD95342
augaaccccaaucagaagaucauuaccauaggcagcaucugcauggccauugggaucauuucccugauccuccaaauaggaaacaucauuucuaucugggugucacacaguauucagacagguagccagaaucauacuggcaucuguaaccagagaauaauuacguacgaaaauuccaccugggucaaccaaacauauguuaauaucaacaauacuaacgugguagcugggaaagacaccacaucugugacccuugcaggaaauucgucacugugcccugucaggggcugggccauuuacagcaaggauaacaguauccggaucgguuccaaaggggacguguucguuauucgcgaaccauuuauaucuuguagccacuuggagugccgaacuuucuuuuuaacacagggagcgcugcuaaaugauaagcauuccaacggcaccgugaaagaccguucaccguauagagcucucaugaguugucccaucggcgaagccccuagcccauacaauucuagguucgaguccgucgcauggucagccagcgcuugccacgaugggaugggauggcugacgauugguaucaguggccccgacgauggggcaguggccguacuuaaguauaacggaauaauuacugaaaccaucaagucuuggcggaaacgcauccugagaacacaggaguccgaguguguuugcauuaacggcagcuguuuuacuaucaugaccgacgguccuucgaaugggccagcuucuuacaggauuuucaagauagaaaaaggaaagaucacaaaauccauugaguuggaugcccccaacucacauuaugaagagugcaguuguuacccugacaccggcacggugaugugcgucugccgggauaauuggcacggcagcaaccgcccauggguguccuuuaaucagaaccucgacuaccaaaucggguauaucuguucuggaguguucggugauaauccgcgacccaaggacggcaaggggagcugcggaccugucacuguugacggcgcggauggugugaaaggguuuucauacagauauggcaacggaguauggauuggcaggacaaagaguaauuccagccggaaaggguucgagaugauaugggacccaaacggauggaccgauacugacucuaauuuucuggugaagcaggaugucguggcaaugacagacuggucagguuacaguggcagcuucguucagcaccccgaacugaccgggcucgauuguaugcguccuugcuuuuggguggaguuaauccgcggaagaccaagggagaaaacgaccauuuggacauccgguucuucgaucagcuucuguggcgucaacuccgacacugugaauuggucauggcccgauggggccgagcugccguucaccauugacaaguga

SEQ ID NO: 136967 - RNA, 1413 nt, Artificial Sequence
  derived and/or modified sequence opt3 from neuraminidase__InfluenzaA__ABD95353
augaaccccaaucagaagaucauuaccauaggcagcaucugcauggccauugggaucauuucccugauccuccaaauaggaaacaucauuucuaucugggugucacacaguauucagacagguagccagaaucauacuggcaucuguaaccagagaauaauuacguacgaaaauuccaccugggucaaccaaacauauguuaauaucucuaacacuaaugugguagcugggaaagacaccacaucgaugacccuugcaggaaacucaagccugugcccuauuaggggcugggccaucuacaguaaggauaauuccauccggauugguucuaaaggggacguguucgucauacgcgaaccauuuaucagcuguucccacuuggagugccgaacuuucuuuuuaacacagggagcgcugcuaaacgauaagcauucaaauggcaccgugaaagaccguaguccguauagagcucucaugagcugucccauuggcgaagccccuucuccauacaacuccagguucgagucaguugcauggagcgccagugcuugccacgaugggaugggauggcugacgaucgguauaucuggccccgacgauggggcaguggccguccuuaaguauaauggaauuaucacugaaaccaucaaguccuggcggaaacagauucugcgcacacaggagagcgagugugugugcguaaacggcucguguuuuacuaucaugaccgacgguccuucugaugggccagcuuccuacagaauuuucaagauagaaaaaggaaagaucacaaaaucaauugaguuggacgcccccaacagucauuaugaagagugcagcuguuacccugauaccggcacgguuaugugcgugugcagggacaauuggcacggcuccaaccggccaugggucucuuuuaaucaaaaccucgauuaccagaucggguauaucuguagcggaguguucggugacaauccgcgccccaaggacggcaaggggucaugcgauccugugaacgucgacggagcggauggcguuaaagguuuuaguuaccgauaugggaauggcguguggauuggaagaacuaaguccaacagcucuaggaaaggcuucgagaugauaugggacccaaauggguggacagauaccgacucaaacuuucugguaaagcaggauguggucgcaaugacugacuggaguggauacagcgguuccuucgugcagcaccccgaacugacaggccucgauuguaugcggccuugcuuuuggguugaguuaauccgugggcgcccaagagagaaaaccacgauuuggaccucuggaucgagcaucuccuucuguggcgucaauucagacacagugaacuggaguuggcccgauggugccgagcugccguucacuauugacaaguga

SEQ ID NO: 136968 - RNA, 1413 nt, Artificial Sequence; identical to SEQ ID NO: 136844
  derived and/or modified sequence opt3 from neuraminidase__InfluenzaA__ABE11660

SEQ ID NO: 136969 - RNA, 1413 nt, Artificial Sequence
  derived and/or modified sequence opt3 from neuraminidase__InfluenzaA__ABE11671
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugguagcagggaaagacaagaccucggugacacuugccggaaauucaagccuguguaguaucuccggcugggcgauuuacaccaaagauaacucuaucaggaucgguagcaagggggacgucuucgugauucgggagccuuuuauauccugcucacauuuggagugucgcacuuucuuuuuaacacaaggagcucugcuaaaugauaaacacaguaacggcaccguuaaggaccgaagcccauaucgugcccucaugucuugcccgcugggcgaagcacccuccccuuacaauucaaaguucgagagcguggccuggagugcuucugcaugucaugaugggaugggauggcuuacgaucgguauuuccggcccagacaacggggccgucgcugugcugaaauauaacggaaucauaacugaaaccauuaagagcuggaaaaagcagaucuugagaacacaggagucggagugcguauguguuaauggcucuugcuuuacuaucaugaccgauggucccuccaacggggccgcgucauacaaaauuuucaagaucgaaaagggaaaagugaauaagaguauugagcucaacgcaccuaauuuucacuaugaagaguguagcugcuacccagacacaggcaccgucaugugugugugcagggauaacuggcacggcuccaaucggcccugggugucuuucaaccagaaucuggacuaccaaauaggguauaucugcagcggagucuuuggugauaacccucgcccaaaagacggcgaggggucauguaauccgguuacgguggauggagccaacggcguaaaggguuucaguuacaaauaugggaauggcguguggauuggaagaacuaaguccaacaggcugcggaaaggcuuugaaaugaucugggaccccaauggguggacagacaccgauagcgacuucucugucaagcaggaugugguugcuaucacugacuggucaggauacagugguagcuuugugcagcauccugagcucacaggcuuagauugcauucgcccauguuucugggucgaacuggugcgagggcuucccagagagaacaccacgauauggaccuccggaucuucgaucagcuucugcggcguaaacuccgacacagccaauuggucauggccugauggugcagaauugccauuuacuauugacaaguga

SEQ ID NO: 136970 - RNA, 1413 nt, Artificial Sequence
  derived and/or modified sequence opt3 from neuraminidase__InfluenzaA__ABE11682
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugugaauaucaacaauacuaacguuguggcaggggaggacaaaaccucgguaacacuugccggaaauucaagccuguguaguauuuccggcugggcgaucuacaccaaggauaacucuaucaggauugguagcaaaggggacguguucgucauacgggagccuuuuaucuccugcucacauuuggaaugucgcacuuucuuuuuaacacaaggagcucugcuaaaugauaagcacaguaacggcaccgugaaagaccgaagcccauaucgugcccucaugucuugcccgcugggcgaggcacccuccccuuacaauucaaaguucgaaagcguugccuggagugcuucugcaugucaugaugggaugggauggcuuacgauugguaucuccggcccagacaacggggccguggcuguccugaaguauaacggaauaauuacugagaccaucaaaagcuggaagaaaagaaucuugaggacacaggagucggaaugcguguguguaaauggcucuugcuuuacuauuaugaccgauggucccuccaacggggccgcgucauacaagaucuucaaaauugagaagggaaagguuacaaaaaguauagaacucaaugcaccuaacuuucacuaugaggaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaggacggcgaagggucauguaacccggucacuguugauggagccgacggcgugaaagguuucaguuacaaguaugggaauggcguauggaucggaaggacaaaauccaaccggcugcgcaagggcuuugagaugaucugggaccccaauggguggaccgauacugacagcgauuucucugugaaacaagacgucguggcuauuacagauuggucaggauacagugguagcuuuguucagcauccugaacucaccggcuuagacugcauacgaccauguuucuggguggagcuggucagagggcuucccagggaaaacacgaccaucuggacauccggaucuucgauuagcuucugcggcgucaauuccgauacugccaacuggucauggccugacggugcagaguugccauuuaccaucgauaaguga

SEQ ID NO: 136971 - RNA, 1413 nt, Artificial Sequence; identical to SEQ ID NO: 136412
  derived and/or modified sequence opt3 from neuraminidase__InfluenzaA__ABE11693

SEQ ID NO: 136972 - RNA, 1413 nt, Artificial Sequence; identical to SEQ ID NO: 136412
  derived and/or modified sequence opt3 from neuraminidase__InfluenzaA__ABE11704

SEQ ID NO: 136973 - RNA, 1413 nt, Artificial Sequence; identical to SEQ ID NO: 136412
  derived and/or modified sequence opt3 from neuraminidase__InfluenzaA__ABE11715

SEQ ID NO: 136974 - RNA, 1413 nt, Artificial Sequence; identical to SEQ ID NO: 136941
  derived and/or modified sequence opt3 from neuraminidase__InfluenzaA__ABE11726

SEQ ID NO: 136975 - RNA, 1413 nt, Artificial Sequence; identical to SEQ ID NO: 136946
  derived and/or modified sequence opt3 from neuraminidase__InfluenzaA__ABE11737

SEQ ID NO: 136976 - RNA, 1413 nt, Artificial Sequence; identical to SEQ ID NO: 136412
  derived and/or modified sequence opt3 from neuraminidase__InfluenzaA__ABE11815

SEQ ID NO: 136977 - RNA, 1413 nt, Artificial Sequence; identical to SEQ ID NO: 136941
  derived and/or modified sequence opt3 from neuraminidase__InfluenzaA__ABE11826

SEQ ID NO: 136978 - RNA, 1413 nt, Artificial Sequence; identical to SEQ ID NO: 136941
  derived and/or modified sequence opt3 from neuraminidase__InfluenzaA__ABE11837

SEQ ID NO: 136979 - RNA, 1413 nt, Artificial Sequence; identical to SEQ ID NO: 136941
  derived and/or modified sequence opt3 from neuraminidase__InfluenzaA__ABE11848

SEQ ID NO: 136980 - RNA, 1413 nt, Artificial Sequence; identical to SEQ ID NO: 136946
  derived and/or modified sequence opt3 from neuraminidase__InfluenzaA__ABE11859

SEQ ID NO: 136981 - RNA, 1413 nt, Artificial Sequence
  derived and/or modified sequence opt3 from neuraminidase__InfluenzaA__ABE11903
augaaccccaaucagaagaucauuaccauaggcagcaucuccauggccauugggaucauuucucugauccuccaaauaggaaacaucauuucaaucugggcuagucacagcauucagacagguucccagaauuacacuggcaucugcaaccagagaauaauuacguaugaaaauucuaccugggugaaccaaacauacgucaauaucaacaauacuaacguuguggcagggaaagacaagaccucgaugacacuugccggaaauucaagccuguguccuauuaggggcugggcgaucuauaccaaagauaacaguauccggauugguuccaagggggacguauucgugauacgcgagccauuuaucucuugcagccauuuggagugucgaacuuucuuuuuaacacagggagcucugcuaaaugauaaacacuccaacggcaccgucaaggaccguucaccguacagagcccucaugaguugcccccugggcgaagcaccuagcccauauaauucuagguucgaguccguggccuggucagcuagcgcaugucaugaugggcuuggauggcugacgauugguaucaguggccccgacaacggggccguugcuguguugaaguacaacggaauaauuacugaaaccaucaaaucuuggaagaaacagauccuccggacacaggaguccgagugcgucugugugaauggcagcugcuuuacuauuaugaccgaugguccuucgaacggggccgcgucuuaucgcaucuucaagauugaaaaaggaagaguaacaaaguccauagagcuggacgcaccaaauuaccacuacgaagaguguucaugcuaucccgauaccggcacgguuaugugugugugcagggacaacuggcauggcaguaaucggccuugggucagcuuuaaccaaaaucuggauuaccagaucggguauauuugcuccggaguguucggugacaacccacgcccgaaggauggcgaggggucuuguaaucccgugacugucgacggagccgacggcguuaaagguuuuagcuaccgauaugggaacggcguguggaucggaagaacaaagucaaauaggcuccggaaaggcuucgaaaugaucugggauccuaacggguggaccgacacugauagugacuuuuccaugaagcaggauguaguggcuaugacagacuggagcggauacucugguucauucguccagcacccagaguuaaccggccuggauugcaugcgucccuguuuuuggguggaacuuguucgcggguugccuagagagaauacgaccauuuggacaaguggaagcuccauaucuuucugcggcgugaacucggaaacugccaauuggagcuggccagacggugcagagcugcccuucaccaucgauaaauga

SEQ ID NO: 136982 - RNA, 1413 nt, Artificial Sequence
  derived and/or modified sequence opt3 from neuraminidase__InfluenzaA__ABE11925
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaaccaaacauaugucaauauuaacaauacuaacguuguggcagggaaagacaagaccucgaugacacuugccggaaauucaagccuguguccuaucaggggcugggcgaucuacaccaaagauaacaguauucggauagguuccaagggggacguauucgugauccgcgagccauuuauuucuugcagccacuuggagugucgaacuuucuuuuuaacacagggagcucugcuaaaugauaaacauuccaacggcaccgucaaggaccguucaccguauagagcccucaugaguugcccccugggcgaagcaccuagcccauacaauucuagguucgaguccguggccuggucagcuagcgcaugucacgaugggcuuggauggcugacgaucgguauaaguggccccgacaacggggccguugcuguguugaaguauaacggaauuaucacugaaaccaucaaaucuuggaagaaacggauucuccgcacacaggaguccgagugcgucuguaugaauggcagcugcuuuacuaucaugaccgaugguccuucgaacggggccgcgucuuacagaauuuucaagauagaaaaaggaaaggugacaaaguccaucgagcuggacgcaccaaauuaucauuacgaagaguguucaugcuaccccgauaccggcacgguaauguguguuugcagggacaacuggcacggcaguaaucggccuugggugagcuuuaaccagaaucuggauuaucaaauuggguacaucugcuccggagucuucggugacaacccacgcccgaaagauggcgaggggucuuguaaucccgugacugccgacggagcugacggcgugaaggguuuuagcuaucgauacgggaacggcgucuggaucggaagaacaaaaucaaauaggcuccggaagggcuucgaaaugauuugggauccuaacggguggaccgacacugauagugacuuuuccaugaaacaggauauaguugccaugacagacuggagcggauauucugguucauucgugcagcacccagaguuaaccggccuggauugcaugcgucccuguuuuuggguagaacuugugcgcggguugccuagagagaauacgaccaucuggacaaguggaagcuccauuucuuucugcggcgucaacucggacacugcaaauuggagcuggccagauggugcugaacugcccuucaccaucgacaaguga

SEQ ID NO: 136983 - RNA, 1413 nt, Artificial Sequence
  derived and/or modified sequence opt3 from neuraminidase__InfluenzaA__ABE11952
augaaccccaaucagaagaucauuaccauaggcagcaucuccauggccauugggaucauuucucugauccuccaaauaggaaacaucauuucaaucugggcuagucacagcauucagacagguucccagaauuacacuggcaucugcaaccagagaauaauuacguaugaaaauucuaccugggugaaccaaacauacgucaauaucaacaauacuaacguuguggcagggaaagacaagaccucgaugacacuugccggaaauucaagccuguguccuauuaggggcugggcgaucuauaccaaagauaacaguauccggauugguuccaagggggacguauucgugauacgcgagccauuuaucucuugcagccauuuggagugucgaacuuucuuuuuaacacagggagcucugcuaaaugauaaacacuccaacggcaccgucaaggaccguucaccguacagagcccucaugaguugcccccugggcgaagcaccuagcccauauaauucuagguucgaguccguggccuggucagcuagcgcaugucaugaugggcuuggauggcugacgauugguaucaguggccccgacaacggggccguugcuguguugaaguacaacggaauaauuacugaaaccaucaaaucuuggaagaaacagauccuccggacacaggaguccgagugcgucugugugaauggcagcugcuuuacuauuaugaccgaugguccuucgaacggggccgcgucuuaucgcaucuucaagauugaaaaaggaagaguaacaaaguccauagagcuggacgcaccaaauuaccacuacgaagaguguucaugcuaucccgauaccggcacgguuaugugugugugcagggacaacuggcauggcaguaaucggccuugggucagcuuuaaccaaaaucuggauuaccagaucggguauauuugcuccggaguguucggugacaacccacgcccgaaggauggcgaggggucuuguaaucccgugacugucgacggagccgacggcguuaaagguuuuagcuaccgauaugggaacggcguguggaucggaagaacaaagucaaauaggcuccggaaaggcuucgaaaugaucugggauccuaacggguggaccgacacugauagugacuuuuccaugaagcaggauguaguggcuaugacagacuggagcggauacucugguucauucguccagcacccagaguuaaccggccuggauugcaugcgucccuguuuuuggguggaacuuguucgcggguugccuagagagaauacgaccauuuggacaaguggaagcuccauaucuuucugcggcgugaacucggaaacugccgacuggagcuggccagauggugcagagcugcccuucaccaucgacaaauga

SEQ ID NO: 136984 - RNA, 1413 nt, Artificial Sequence
  derived and/or modified sequence opt3 from neuraminidase__InfluenzaA__ABE12035
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaaccaaacauaugucaauauuaacaauacuaacguuguggcagggaaagacaagaccucgaugacacuugccggaaauucaagccuguguccuaucaggggcugggcgaucuacaccaaagauaacaguauucggauagguuccaagggggacguauucgugauccgcgagccauuuauuucuugcagccacuuggagugucgaacuuucuuuuuaacacagggagcucugcuaaaugauaaacauuccaacggcaccgucaaggaccguucaccguauagagcccucaugaguugcccccugggcgaagcaccuagcccauacaauucuagguucgaguccguggccuggucagcuagcgcaugucacgaugggcuuggauggcugacgaucgguauaaguggccccgacaacggggccguugcuguguugaaguauaacggaauuaucacugaaaccaucaaaucuuggaagaaacggauucuccgcacacaggaguccgagugcgucuguaugaauggcagcugcuuuacuaucaugaccgaugguccuucgaacggggccgcgucuuacagaauuuucaagauagaaaaaggaagggugacaaaguccaucgagcuggacgcaccaaauuaucauuacgaagaguguucaugcuaccccgauaccggcacgguaauguguguuugccgggacaacuggcacggcaguaaucgcccuugggugagcuuuaaccagaaucuggauuaucaaauuggguacaucugcuccggagucuucggugacaacccacgaccgaaggauggcgaggggucuuguaaucccgugacuguggacggagccgacggcgucaaagguuuuagcuauagauacgggaacggcguuuggaucggaaggacaaagucaaaucggcuccguaaaggcuucgaaaugauuugggauccuaacggguggaccgacacugauagugacuuuuccaugaagcaggauauaguggcuaugacagacuggagcggauauucugguucauucguacagcacccagaguuaaccggccuggauugcaugcgccccuguuuuuggguggaacuugucagaggguugccuagggagaauacgaccaucuggacaaguggaagcuccauuucuuucugcggcgugaacucggacacugccaauuggagcuggccagauggugcagaacugcccuucaccaucgacaaauga

SEQ ID NO: 136985 - RNA, 1410 nt, Artificial Sequence; identical to SEQ ID NO: 136746
  derived and/or modified sequence opt3 from neuraminidase__InfluenzaA__ABE12094

SEQ ID NO: 136986 - RNA, 1410 nt, Artificial Sequence; identical to SEQ ID NO: 136878
  derived and/or modified sequence opt3 from neuraminidase__InfluenzaA__ABE12126

SEQ ID NO: 136987 - RNA, 1413 nt, Artificial Sequence; identical to SEQ ID NO: 136412
  derived and/or modified sequence opt3 from neuraminidase__InfluenzaA__ABE12263

SEQ ID NO: 136988 - RNA, 1410 nt, Artificial Sequence
  derived and/or modified sequence opt3 from neuraminidase__InfluenzaA__ABE12626
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaaguggucaaaaccucagugcaagauaacuggguucgccccauuuaguaaggauaacagcauucggcuguccgcgggaggugacaucugggucacacgcgagcccuaugugucuugugauccuggcaaaugcuaccaauucgcucuagggcagggaaccacgcucgacaauaagcauucgaacgauacuauucacgaccgaaucccacaucguacccugcuuaugaaugaacugggcguucccuuucacuuggguacaagacagguguguaucgccuggucaagcaguuccugccaugaugggaaagcauggcuccacgucugugugacuggagacgauaagaacgccaccgcuucuuucauuuaugacggcaggcugguagauagcauaggcuccuggucacagaauauccugcggacacaagagagugaaugcguuuguauuaacgggaccugcacgguggucaugacugacggaagcgcaucuggucgcgccgauacaagaauccucuuuauagaggagggcaaaauugugcacaucuccccuuuaucagggagcgcucagcauguggaagagugcaguuguuacccaagguauccgggaguccggugcaucugucgcgacaauuggaagggcucuaaccgacccguuguggacauuaauguaaaggauuacuccaucgacagcucguacgugugcucuggucuggucggggauaccccuagaaacaacgacagguccucaaauaguuauugucggaacccaaauaacgaacguggaaaucacggcgugaaaggcugggccuucgaugacgggaacgauguuuggaugggacgcacuauuagcaaggacuccagaucugguuacgagacauuuaaagugauaggcggguggagcacccccaauucaaagagucagaucaacaggcaggucauuguggauuccgacaaucggagcggauauucuggcaucuucucaguagaagguaaaaguugcaucaaccgauguuuuuacguugagcuuauucgcgggagagagcaagaaacgagggugugguggaccagcaauuccauagucguguucugcggcacaucuggaacuuauggcaccgggucguggccugauggagcggacaucaacuugaugccaauuuga

SEQ ID NO: 136989 - RNA, 1410 nt, Artificial Sequence
  derived and/or modified sequence opt3 from neuraminidase__InfluenzaA__ABE12650
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucaaggaggguaagauugugcacaucuccccucugcuuggcucagcucaacauguggaagagugcagcuguuauccaagauacccgggggucaggugcguuugucgggacaauuggaaaggaaguaaccgccccauaguggauauuaacguaaaggacuacucuaucguguccagcuaugucugcucgggcuuggugggugacacaccucggaaaaaugauucuuccucaaguagccacugucugaacccaaauaacgaagaagggggacauggcguuaagggcugggccuucgacgaugggaaugacguguggaugggaagaaccaucuccgagaaacuaaggucugguuacgagacguuuaaggucauugagggcuggagcaaacccaacucaaagcuccagaucaaucgacaggugauuguagaucgugggaaccgcaguggauauuccggcauauucagcguugaagguaagucuugcaucaauagauguuuuuacguggagcugauuagggggcggaaacaggaaaccgaggucugguggacaucaaacaguaucguggucuucugcggcacuagcggaaccuauggcacaggguccuggccugacggagcggauaucaaucuuaugccaauuuga

SEQ ID NO: 136990 - RNA, 1410 nt, Artificial Sequence
  derived and/or modified sequence opt3 from neuraminidase__InfluenzaA__ABE13095
augaaccccaaucagaagaucauuaccauaggcagcgugucccugacaaucacuacgauuugcuuccucaugcaaaucgccauucuugucaucaccguuacacugcacuuuaaacagugugagugcaacucuccuccaaauaaccaggugauguugugugaaccgacuauaaucgagagaaauauuaccgaaaucguauacuuaacaaacaccacuauugagaaggaaaucugccccaaacuggcugaguauaggaauuggucaaagccucaguguaaaauaacaggguucgcaccauuuaguaaggacaacagcauucggcuauccgccggaggugauaucugggugacccgcgagcccuacgucucuugcgacccuggcaaguguuaucaauucgcgcucgggcagggaacgacucugaauaaccgacauucgaaugauaccgugcacgaccguacaccauacagaacucuucugaugaacgaauugggcguucccuuucaucucgguaccaaacaggugugcauugcuuggucaagcaguuccugucacgaugggaaggccuggcugcaugucugcgugacaggacacaaugagaacgcaaccgccucuuucaucuaugacggcaggcugguagauagcaucggcuccuggaguaaaaauauucuccggacgcaggaaucagaguguguuugcauaaacgggacuugcacaguggucaugaccgacggaagcgcuucuggucgcgcagauacuaagaucuuauuuauugaggaaggcaaaaucgugcacauauccccucugucagggagcgcccaacauguggaggaauguaguugcuacccaagauauccgggagucagguguguuugccgggacaacuggaagggcucuaaucgccccauuguggauaucaacguaaaggacuacuccaucgugagcucguacgucuguucuggucuugugggggauacaccucggaaaaaugacggauccucaaguagcuauugcuuggacccaaacaaugaggaaggcggccacgggguuaagggaugggcuuucgaugacgguaacgauguguggaugggcagaaccauuuccgagaaacugaggucuggguacgagacguuuaaggucaucggaggcuggagcaaacccaauucaaagcuacagauuaaccgacaggugauaguagacaaagguaaucguaguggguauuccggcaucuucagcguugaaggaaagucuuguauuaaccgcugcuuuuacguggagcucaucagaggcaggaagcaggaaaccgaggucugguggacaucaaauaguaucguggucuucugugggacuagcggaaccuaugguacaggcuccuggccugauggggccgacauuaaccugaugccaauauga

SEQ ID NO: 136991 - RNA, 1410 nt, Artificial Sequence; identical to SEQ ID NO: 136142
  derived and/or modified sequence opt3 from neuraminidase__InfluenzaA__ABE13332

SEQ ID NO: 136992 - RNA, 1410 nt, Artificial Sequence; identical to SEQ ID NO: 136142
  derived and/or modified sequence opt3 from neuraminidase__InfluenzaA__ABE13558

SEQ ID NO: 136993 - RNA, 1410 nt, Artificial Sequence
  derived and/or modified sequence opt3 from neuraminidase__InfluenzaA__ABE13642
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaacguacaccauauagaacucuucugaugaacgaguugggcguucccuuucaucucgguaccaaacagguguguaucgccuggucaagcaguuccugccacgacgggaaggcauggcugcaugucugugugacaggacacgaugaaaaugccaccgcuucuuucauuuacaacggcaggcugguagacagcaucggcuccuggaguaaaaauauccuccggacgcaggagucagagugcguuuguauuaacgggacuugcacaguggucaugaccgauggaagcgcaucuggucgcgccgacacuaagauauuauuuaucgaagagggcaaaauugugcacaucuccccucugucagggagcgcucaacauguggaagagugcaguuguuauccaagauacccgggagucaggugcguuugucgggauaacuggaagggcucuaaucgccccauaguggacauuaacguaaaggauuacuccaucgugagcucguaugucugcucuggucuugugggggacacaccucggaaaaaugauuccucaaguagcucccacuguuugaacccaaauaacgaagagggaggccauggcguuaaggggugggccuucgacgacggaaaugauguguggauggguagaaccaucucugagaaacugaggagcggcuacgaaacguuuaaggucauugggggauggucaaaacccaacaguaagcuacagaucaaucgacaggugauuguagaccguggcaaccgcuccgguuauagcgggauauucucuguugagggcaaaucaugcaucaauagauguuuuuacguggaacucauuaggggacggaagcaggagaccgaagucugguggacaaguaacagcaucguggucuucugcggcacuuccgggaccuauggaacagguucuuggccugauggcgcggacaucaaucugaugccaauuuga

SEQ ID NO: 136994 - RNA, 1410 nt, Artificial Sequence
  derived and/or modified sequence opt3 from neuraminidase__InfluenzaA__ABE13668
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucuggucgcgccgacacuaagauauuauuuaucgaggaaggcaaaauugugcacaucuccccucugucagggagcgcucaacauguggaggaaugcaguuguuauccaagauacccgggagucaggugcguuugucgggauaacuggaagggcucuaaccgccccauaguggacauuaauguaaaggauuacuccaucgugagcucguaugucugcucuggucuugugggggacacaccucggaaaaacgacuccucaaguagcucccacuguuugaauccaaacaaugaggaaggaggccauggcguuaaggggugggccuucgaugacggaaacgauguguggauggguagaaccaucucugagaaacugaggagcggcuacgagacguuuaaggucauugggggauggucaaaacccaauaguaagcuacagaucaaccgacaggugauuguagaccguggcaaucgcuccgguuauagcgggauauucucuguugaaggcaaaucaugcaucaacagauguuuuuacguggagcucauuaggggacggaagcaggaaaccgaggucugguggacaaguaauagcaucguggucuucugcggcacuuccgggaccuauggaacagguucuuggccugauggcgcggacaucaaccugaugccaauuuga

SEQ ID NO: 136995 - RNA, 1410 nt, Artificial Sequence
  derived and/or modified sequence opt3 from neuraminidase__InfluenzaA__ABE13836
augaaccccaaucagaagaucauuaccauaggcagcgugucccugacaaucgccacuauuugcuuccucaugcaaaucgcuauucuugucacgaccguuacacugcacuuuaaacaguacgaguguaacucuuugccuaauaaccaggugauguuaugcgaaccaacuaucauagagagaaauaucaccgaaauuguauaucugacaaacaccacuaucgagaaggaaauuuguccgaaacuagcagaguacaggaauuggucaaagccccagugcaaaaucacaggguucgccccuuuuaguaaggacaacagcauacggcucuccgcgggaggugauauuugggugacccgcgagccauaugucucuugugaccccggcaagugcuaccaauucgcucuggggcagggaacgacucuuaauaaccgacauucgaaugauaccgugcacgaccguacaccuuauagaacucuguugaugaacgaacucggcguuccauuucaucuggguaccaaacagguguguaucgccuggucaagcaguuccugccacgaugggaaggcauggcugcaugucugugugacaggacacgacgagaaugccaccgcuucuuucauuuacgauggcaggcucguagacagcaucggcuccugguccaaaaacaucuuacggacgcaggaaagugagugcguuuguauuaaugggacuugcacaguggucaugaccgauggaagcgcaucuggucgcgccgacacuaagauacuguuuaucgaggaaggcaaaauugugcacaucucaccccuuucagggagcgcucaacauguggaggaaugcaguuguuauccuagauacccaggagucaggugcguuugucgggauaacuggaagggcucuaaccgcccgauaguggacauuaauguaaaggauuacuccaucgugagcucguaugucugcucugguuuggugggggacacaccccggaaaaacgacuccucaaguagcucccacugucugaauccuaacaaugaggaaggaggccauggcguuaaggggugggccuucgaugacggaaacgauguguggauggguagaaccaucucugagaaacuaaggagcggcuacgagacguuuaaggucauugggggauggucaaaaccaaauaguaagcuccagaucaaccgacaggugauuguagaccguggcaaucgcuccgguuauagcgggauauucucuguugaaggcaaaucaugcaucaacagauguuuuuacguggagcugauuaggggacggaagcaggaaaccgaggucugguggacaaguaauagcaucguggucuucugcggcacuuccgggaccuauggaacagguucuuggcccgauggcgcggacaucaaccuuaugccuauuuga

SEQ ID NO: 136996 - RNA, 1410 nt, Artificial Sequence
  derived and/or modified sequence opt3 from neuraminidase__InfluenzaA__ABE14033
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucuggucgcgccgacacuaagauauuauuuaucgaggaaggcaaaauugugcacaucuccccucugucagggagcgcucaacauguggaggaaugcaguuguuauccaagauacccgggagucaggugcguuugucgggauaacuggaagggcucuaaccgccccauaguggacauuaauguaaaggauuacuccaucgugagcucguaugucugcucuggucuugugggggacacaccucggaaaaacgacuccucaaguagcuccuacuguuugaauccaaacaaugaggaaggaggccacggcguuaaggggugggccuucgaugacggaaacgauguguggauggguagaaccaucucugagaaacugaggagcggcuaugagacguuuaaggucauugggggauggucaaaacccaauaguaagcuacagaucaaccgacaggugauuguagaccguggcaaucgcuccgguuacagcgggauauucucuguugaaggcaaaucaugcaucaacagauguuuuuauguggagcucauuaggggacggaagcaggaaaccgaggucugguggacaaguaauagcaucguggucuucugcggcacuuccgggaccuacggaacagguucuuggccugauggcgcggacaucaaccugaugccaauuuga

SEQ ID NO: 136997 - RNA, 1410 nt, Artificial Sequence
  derived and/or modified sequence opt3 from neuraminidase__InfluenzaA__ABE14055
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucuccucauggaguaaaaacauccuccggacgcaggaaagcgagugcguuuguauuaauggcacuugcacaguggucaugaccgacgggucuuccucaggccgcgcagauacuaagauauuauuuaucgaggaaggaaaaauugugcacaucagcccucugagugguucugcccaacauguggaggaaugcuccuguuauccaagauacccgggcgucaggugcguuugucgggacaacuggaaggggagcaaccgccccauaguggauauuaauguaaaggacuacucgaucgugucuuccuaugucugcucaggacuugugggcgacacaccucggaaaaacgauaguagcuccucuagcuacuguuugaauccaaacaaugaggaaggugggcacggaguuaagggcugggcuuucgacgauggcaacgacguguggauggggagaaccaucucagagaaacugaggaguggauaugagacguuuaaggucauugguggcugguccaaacccaauagcaagcuacagaucaaccgacaggugauuguagaucgugggaaucgcucuggauacucaggcauauucaguguugaagguaaaagcugcgugaacagauguuuuuaugucgagcucaucagggggcggaagcaggaaaccgaggugugguggacauccaauucuauugucguguucugcggcacuucgggaaccuacggcacagggagcuggccugacggagccgauaucaaccugaugccaaucuga

SEQ ID NO: 136998 - RNA, 1410 nt, Artificial Sequence
  derived and/or modified sequence opt3 from neuraminidase__InfluenzaA__ABE14857
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaccacagaaaucguauauuuaaccaacacuacaauugagaaggaaaucugucccaaacuggcagaguacaggaauuggucaaagccucagugcaaaauuaccggguucgccccauuuaguaaggacaacagcauccggcuauccgcgggaggugauauaugggugacgcgcgagcccuaugucucuugugacccuggcaagugcuaccaauucgcucucgggcagggaacuacccugaauaaccgacauucgaaugauacagugcacgaccguacuccauauagaacccuucugaugaacgaauugggcguucccuuucaucucgguacaaaacagguguguauugccuggucaagcaguuccugccacgaugggaaggcauggcugcaugucugugugaccggacacgacgagaaugccacggcuucuuucaucuacgauggcaggcugguagacagcauuggcuccuggaguaaaaacauccuccggacucaggaaagugagugcguuuguaucaaugggacaugcaccguggucaugacugauggaagcgcaucuggucgcgccgacacaaagauuuuauuuauagaggaaggcaaaaucgugcacauuuccccucugucagggagcgcucaacauguggaggaaugcaguuguuauccaagauacccgggagucaggugcguuugucgggauaacuggaagggcucuaaccgccccaucguggacauaaauguaaaggauuacuccauugugagcucguaugucugcucuggucuugugggggacaccccucggaaaaacgacuccucaaguagcuccuacuguuugaauccaaacaaugaggaaggaggccacggcguuaaggggugggccuucgaugacggaaacgauguguggauggguagaacgaucucugagaaacugaggagcggcuaugagaccuuuaaggucaucgggggauggucaaaacccaauaguaagcuacagauuaaccgacaggugaucguagaccguggcaaucgcuccgguuacagcgggauuuucucuguugaaggcaaaucaugcauaaacagauguuuuuauguggagcucaucaggggacggaagcaggaaacagaggucugguggacuucaaauagcauuguggucuucugcggcaccuccgggacauacggaacugguucuuggccugauggcgcggacaucaaccugaugccaaucuga

SEQ ID NO: 136999 - RNA, 1410 nt, Artificial Sequence; identical to SEQ ID NO: 136996
  derived and/or modified sequence opt3 from neuraminidase__InfluenzaA__ABE15594

SEQ ID NO: 137000 - RNA, 1413 nt, Artificial Sequence
  derived and/or modified sequence opt3 from neuraminidase__InfluenzaA__ABE26994
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaaccaaacauaugucaauauuaacaauacuaacguuguggcagggaaagacaagaccucgaugacacuugccggaaauucaagccuguguccuaucaggggcugggcgaucuacaccaaagauaacaguauucggauagguuccaagggggacguauucgugauccgcgagccauuuauuucuugcagccacuuggagugucgaacuuucuuuuuaacacagggagcucugcuaaaugauaaacauuccaacggcaccgucaaggaccguucaccguauagagcccucaugaguugcccccugggcgaagcaccuagcccauacaauucuagguucgaguccguggccuggucagcuagcgcaugucacgaugggcuuggauggcugacgaucgguauaaguggccccgacaacggggccguugcuguguugaaguauaacggaauuaucacugaaaccaucaaaucuuggaagaaacggauucuccgcacacaggaguccgagugcgucuguaugaauggcagcugcuuuacuaucaugaccgaugguccuucgaacggggccgcgucuuacagaauuuucaagauagaaaaaggaagggugacaaaguccaucgagcuggacgcaccaaauuaucauuacgaagaguguucaugcuaccccgauaccggcacgguaauguguguuugccgggacaacuggcacaguagcaaucgcccuuggguguccuuuaaccagaaucuggauuaucaaauuggcuacaucugcucuggggucuucggagacaacccacgaccgaaggauggugagggcagcuguaaucccgugacuguggacggggccgacggagucaaaggcuuuucauauagauacgguaacgggguuuggaucggcaggacaaagaguaaucggcuccguaaaggauucgaaaugauuugggauccuaacggcuggaccgacacugauuccgacuuuagcaugaagcaggauauaguggcuaugacagacuggucuggguauucaggaaguuucguacagcacccagaguuaaccggucuggauugcaugcgccccuguuuuuggguggaacuugucagaggcuugccuagggagaauacgaccaucuggacaagcggguccucuauuucguucugcggagugaacagcgacacugccaauugguccuggccagauggcgcagaacugcccuucaccaucgacaaauga

SEQ ID NO: 137001 - RNA, 1350 nt, Artificial Sequence
  derived and/or modified sequence opt3 from neuraminidase__InfluenzaA__ABE97641
augaaccccaaucagaagaucauuaccauaggcagcaucugcauggugauugggaucauuucccugaugcuccaaaucggaaacaugauaucuaucugggucucacacaguauucagacauggaaucagcaucaggccgagagcaucuccaacacuaauccucuuacggaaaaagcuguugcaucugugacccuggccgguaacucgucauuguguccaauuagaggcugggcgguacacagcaaggacaauaguaucaggauaggguccaaaggagauguguucgucauucgggagccguuuaucucuugcagccauuuagaaugucgcacauucuuucugacucaaggcgcucuacucaacgacaagcacuccaaugguaccgugaaagaucgaucaccccaucguacacugaugaguugcccuguuggggaggccccaagccccuacaacucuagauucgaauccguggcauggucagccagcgcuugucacgacggaaccaguuggcuuacuauuggcaucucuggcccugauaauggggcagucgccgugcugaaguauaacggaaucauuacagacaccauaaaguccuggaggaauaacaucuugcggacgcaggagagcgagugcgcuuguguaaaugguucgugcuuuacuguuaugaccgauggcccaucuaacgggcaggccuccuacaaaauuuucaagauggaaaaaggaaagguggucaaaucaguggagcucgacgcgcccaacuaucacuacgaagaguguaguugcuauccugaugcaggcgagaucacaugugugugccgcgacaauuggcaugguagcaacagaccauggauauccuuuaaucagaaccuggaauaccaaauuggguauaucugcucuggagucuucggcgauaauccgaggcccaacgacggcacugggagcuguggaccuaugucaccaaauggugccuacggcguuaagggguuuaguuucaaguacggaaacggcguguggaucggucggaccaaauccacaaauagccgcucuggguuugagaugauuugggaucccaacggcuggaucggaaccgacucaaguuucagcguaaagcaggacauuguggcuauaacggauugguccggcuauucugggucguuuguccagcacccugaacugacuggacucgacugcauccgaccauguuucuggguggaguuaauuagagguaggcccaaagaaagcacaaucuggaccuccggcucaaguaucucuuucugcgggguuaauagcgauauuguguccuggucauggccggacggagccgagcugccuuuuacuauagauaaguga

SEQ ID NO: 137002 - RNA, 1350 nt, Artificial Sequence
  derived and/or modified sequence opt3 from neuraminidase__InfluenzaA__ABE97642
augaaccccaaucagaagaucauuaccauaggcagcaucugcauggugauugggauggucucccugaugcuccaaaucggaaacaugauuucuaucuggcuuucacacaguauacagacagguaaucagcaucaggccgagagcaucuccaacaauaaccuguugacugaaaaugcuguugcaucugugacguuagccggcaacucgucacuguguccuauuagagggugggcgguacacagcaaagacaauaguaucaggauuggauccaagggcgauguguucgucauccgggagccauuuauaucuugcagccaucuagaaugucgcaccuucuuucucacacaaggugcucugcuuaacgacaaacacuccaaugggacugugaaggaucgaucaccgcaucguacccugaugaguugccccguuggagaggccccuagcccauacaacucuagauucgaauccguggcauggucagccagcgcuugucacgacggcauuaguugguugacaaucggcauuucugggcccgauaauggagcagucgccgugcucaaauauaacgguaucaucaccgacacuauuaaguccuggaggaauaacauacugcggacacaggagagcgagugcgcuuguguaaacggcucgugcuuuaccguuaugacggaugggccuucuaauggacaggccuccuacaagaucuucaaaauggaaaagggcaaaguggucaagucaguggagcuggacgcgccaaacuaucacuacgaagaguguaguugcuaucccgaugccggugagauuacuugugugugccgcgacaauuggcaugggagcaacagaccuugggucuccuuuaaucagaaccucgaauaccaaaucggauauauaugcucuggcguuuucggcgauaauccaaggccgaacgacgggaccggaagcuguggucccaugucaccuaauggcgcauacggggugaaaggauuuaguuucaaguacggcaacgguguauggauugggcggacaaaguccacuaauagccgcucuggcuuugagaugaucugggauccaaacggauggaccggcacagacucaaguuucagcgugaaacaggacaucgucgcuauuaccgauugguccggguauucuggaucguuugugcagcaccccgaauuaacgggucuggacugcauccgaccuuguuucuggguugagcuuauuagaggcaggccaaaggaaagcacuauauggacauccgggucaaguaucucuuucugcggagugaauggcgauaccgucagcugguccuggcccgacggugccgaguugccguuuauuaucgauaaauga

SEQ ID NO: 137003 - RNA, 1350 nt, Artificial Sequence
  derived and/or modified sequence opt3 from neuraminidase__InfluenzaA__ABE97644
augaaccccaaucagaagaucauuaccauaggcagcaucugcauggugauugggaucgucucccugaugcuccaaauuggaaacaugaucucuauauggguuucacacaguauccagacagguaaucagcaucaggccgagagcauuuccaacacuaauccucuuacggaaaaagcuguggcaucuguaacccuggccggcaacucgucauuguguccaaucagagggugggcggugcacagcaaggacaauaacauuaggaucggaaguaaaggcgaugucuucgugauacgggagccguuuauuuccugcucucauuuagaaugucgcacauucuuucugacucaaggugcucuacucaaugacaagcacagcaacgggaccguuaaagaucgaucaccccaucguacacugauguccugcccugugggagaggccccaagucccuacaauagcagauucgaaucugucgcaugguccgccucagcuugucacgacggcaccagcuggcuuacuaucggcauuagugggccugauaacggagcaguggccguacugaaguauaaugguaucaucacagacaccauuaagucuuggaggaacaauauauugcggacgcaggaguccgagugcgcuuguguuaacggcagcugcuuuacugugaugaccgaugggccaucgaacggacaggccucuuacaaaaucuucaagauggaaaaaggcaaggucgugaaauccguggagcucgacgcgcccaauuaucacuacgaagaguguucaugcuauccugaugccggugagauuacaugugucugccgcgacaacuggcaugggaguaauagaccauggguuagcuuuaaccagaaucuggaauaccaaaucggauauauaugcuccggcguguucggcgauaacccgaggcccaaugacgggacuggaucuugugguccuaugagcccaaacggcgcauacgggguaaagggauuuucauucaaguacggcaaugguguguggauugggcggaccaaaaguacaaacucccgcagcggcuuugagaugaucugggaucccaauggauggaccggcacggacucuucauucagugucaagcaggacaucguggcucugacugauuggagcggguauuccggaucuuuuguucagcacccugaacucacagguuuagacugcauucgaccauguuucuggguggagcugaucagaggcaggcccaaagaaucgaccauuuggacuagcggguccucaauaaguuucugcggagucaacucugauacagugagcugguccuggccggacggcgccgagcuuccuuuuaccaucgauaaguga

SEQ ID NO: 137004 - RNA, 1350 nt, Artificial Sequence
  derived and/or modified sequence opt3 from neuraminidase__InfluenzaA__ABE97645
augaaccccaaucagaagaucauuaccauaggcagcaucugcauggugauugggacagucucccugaugcuccaaaucggaaacaugauuucuaucuggguuucacacaguauacagacugguaaucagcaucaggccgagccuacgagcuccaccaacccacuuacagaaaaagcuguggcaucuguaacucuggccggcaauucgucauuguguccgaucagagggugggcgauucacagcaaggacaacaguaucaggauuggauccaaaggcgauguguucgucauccgggagcccuuuauaucuugcagccauuuagaaugucgcaccuucuuucugacacaaggugcucuacucaaugacaagcacuccaacgggaccgugaaagaucgaucaccucaucguacucugaugaguugcccaguuggagaggcccccagcccuuacaauucuagauucgaauccguggcauggucagccagcgcuugucacgacggcacaaguuggcuuaccauuggcaucucugggccagauaacggagcagucgccgugcugaaguauaaugguauuaucacggacacuaucaaguccuggaggaacaauauuuugcggacccaggagagcgagugcgcuuguguaaacggcucgugcuuuacaguuaugacugaugggcccucuaauggacaggccuccuacaaaauauucaagauggaaaaaggcaagguggucaaaucaguggagcucgacgcgccuaacuaucacuacgaagaguguaguugcuauccagaugccggugagaucaccugugugugccgcgacaacuggcaugggagcaauagaccgugggucuccuuuaaccagaaucuggaauaccaaauuggauauaucugcucuggcguuuucggcgauaaccccaggccuaaugacgggacaggaagcugugguccaaugucacccaacggcgcauacggggugaagggauuugcuuucaaguacggcaaugguguauggauagggcggaccaaaaguacgaacucccgcagcggcuuugagaugauuugggauccuaauggauggacuggcccagacucuucauucagugugaagcaggacaucgucgccaucacagauuggagcggguauuccggaucuuuugugcagcaccccgaacugaccggucucgacugcauucgaccguguuucuggguugaguuaaucagaggcaggccuaaagaaucgacuauuuggacaagcggguccucaauaaguuucugcggagugaacucugauaccgucagcugguccuggcccgacggcgcagagcugccauuuacgaucgauaaguga

SEQ ID NO: 137005 - RNA, 1350 nt, Artificial Sequence
  derived and/or modified sequence opt3 from neuraminidase__InfluenzaA__ABE97646
augaaccccaaucagaagaucauuaccauaggcagcaucugcauggugauugggaucgucucccugaugcuccaaauuggaaacaugaucucuauauggguuucacacaguauccagacagagaaucagcaucaggccgaaagcauuuccaacacuaauccuccaacggagaaagcuguggcaucuguaacccuugccgguaacucgucacuguguccgaucagaggcugggcggugcacagcaaggacaauaguauuaggaucggguccaaaggagaugucuucgugauacgggaacccuuuauuucuugcagccauuuggagugucgcacauucuuuuuaacucaaggcgcucugcuaaacgacaagcacuccaaugguaccguuaaagaucgaucaccucaucguacacucaugaguugcccagugggggaagcccccagcccuuacaacucuagauucgaguccgucgcauggucagccagcgcuugucacgacggaaccaguuggcugacuaucggcauuucuggcccagauaauggggcaguggccguacuuaaguauaacggaaucaucacagacaccauuaaguccuggaggaauaacacgcugcggacucaggagagcgaaugcgcuuguguuaaugguucgugcuuuaccgugaugacagauggccccucuaacgggcaggccuccuacaaaauauucaagauggagaaaggaaaggucgugaaaucaguggaauuggacgcgccuaacuaucacuacgaggaguguaguugcuauccagaugcaggcgaaaucacuugugucugccgcgacaauuggcaugguagcaacagaccguggguuuccuuuaaucagaaccucgaguaccaaauuggguauaucugcucuggaguguucggcgauaaucccaggccuaacgacggcaccgggagcuguggaccaaugucacccaauggugccuacggcguaaagggguuuaguuucaaguacggaaacggcguguggauaggucggacaaaauccaccaauagccgcucuggguuugaaaugauuugggauccuaacggcuggacgggaacugacucaaguuucagcgucaagcaggacaucguguccaucacagauuggucuggcuauucggggagcuuuguucagcacccagagcugaccggacuggacugcauucgacccuguuucuggguggaacucaucagagguaggccgaaagaguccacuauuuggacaucaggcaguucuaucagcuucugcggggucaauuccgauaccgugucauggagcuggccugacggagcugaguuacccuuuacgauagauaaguga

SEQ ID NO: 137006 - RNA, 1350 nt, Artificial Sequence
  derived and/or modified sequence opt3 from neuraminidase__InfluenzaA__ABE97647
augaaccccaaucagaagaucauuaccauaggcagcaucugcauggugauugggaucgucucccugaugcuccaaauuggaaacaugaucucuauauggguuucacacaguauccagacagguaaucagcauagagccgagagcauuuccaacacuaauccucuuacggaaaaagcuguggcaucuguaacccuggccggcaacucgucauuguguccaaucagggggugggcggugcacagcaaggacaauaacauucggaucggaaguaaaggcgaugucuucgugauacgcgagccguuuauuuccugcucucauuuagaaugucgaacauucuuucugacucagggugcucuacucaaugacaagcacagcaacgggaccguuaaagaucguucaccccauagaacacugauguccugcccugugggagaggccccaagucccuacaauagcagguucgaaucugucgcaugguccgccucagcuugucacgacggcaccagcuggcuuacuaucggcauuagugggccugauaacggagcaguggccguacugaaguauaaugguaucaucacagacaccauuaagucuuggcggaacaauauauugcgcacgcaagaguccgagugcgcuuguguuaacggcagcugcuuuacugugaugaccgaugggccaucgaacggacaggccucuuacaaaaucuucaagauggaaaaaggcaaggucgugaaauccguggagcucgacgcgcccaauuaucacuacgaagaguguucaugcuauccugaugccggugagauuacaugugucugcagagacaacuggcaugggaguaauaggccauggguuagcuuuaaccagaaucuggaauaccagaucggauauauaugcuccggcguguucggcgauaacccgcggcccaaugacgggacuggaucuugugguccuaugagcccaaacggcgcauacgggguaaagggauuuucauucaaguacggcaaugguguguggauugggcgcaccaaaaguacaaacucccgaagcggcuuugagaugaucugggaucccaauggauggaccggcacggacucuucauucagugucaagcaagacaucguggcuauuacugauuggagcggguauuccggaucuuuuguucagcacccugaacugacaggucucgacugcaucagaccauguuucuggguggaguuaauuaggggccggcccaaagaaucgaccauauggacuagcggguccucaaucaguuucugcggagucaacucugauacagugagcugguccuggccggacggcgccgagcugccuuuuaccauugauaaguga

SEQ ID NO: 137007 - RNA, 1350 nt, Artificial Sequence
  derived and/or modified sequence opt3 from neuraminidase__InfluenzaA__ABE97649
augaaccccaaucagaagaucauuaccauaggcagcaucugcauggugauugggaucgucucccugaugcuccaaauuggaaacaugaucucuauauggguuucacacaguauccagacagguaaucagcaucaggccgagagcauuuccaacacuaauccucuuacggaaaaagcuguggcaucuguaacccuggccggcaacucgucauuguguccaaucagagggugggcggugcacagcaaggacaauaguauuaggaucggauccaaaggcgaugucuucgugauacgggagccguuuauuucuugcagccauuuagaaugucgcacauucuuucugacucaaggugcucuacucaacgacaagcacuccaaugggaccguuaaagaucgaucaccccaucguacacugaugaguugcccugugggagaggccccaagccccuacaacucuagauucgaauccgucgcauggucagccagcgcuugucacgacggcaccaguuggcuuacuaucggcauuucugggccugauaauggagcaguggccguacugaaguauaacgguaucaucacagacaccauuaaguccuggaggaauaacauauugcggacgcaggagagcgagugcgcuuguguuaauggcucgugcuuuacugugaugaccgaugggccaucuaacggacaggccuccuacaaaaucuucaagauggaaaaaggcaaggucgugaaaucaguggagcucgacgcgcccaacuaucacuacgaagaguguaguugcuauccugaugccggugagauuacaugugucugccgcgacaauuggcaugggagcaacagaccauggguuuccuuuaaucagaaccuggaauaccaaaucggauauauaugcucuggcguguucggcgauaauccgaggcccaacgacgggacuggaagcugugguccuaugucaccaaauggcgcauacgggguaaagggauuuaguuucaaguacggcaacgguguguggauugggcggaccaaauccacaaauagccgcucuggcuuugagaugaucugggaucccaacggauggaccggcacggacucaaguuucagcgucaagcaggacaucguggcuauuacugauugguccggguauucuggaucguuuguucagcacccugaacugacaggucucgacugcauccgaccauguuucuggguggaguuaauuagaggcaggcccaaagaaagcaccauauggacuuccgggucaaguaucucuuucugcggagucaauagcgauacaguguccuggucauggccggacggcgccgagcugccuuuuaccauugauaaguga

SEQ ID NO: 137008 - RNA, 1350 nt, Artificial Sequence; identical to SEQ ID NO: 137007
  derived and/or modified sequence opt3 from neuraminidase__InfluenzaA__ABE97651

SEQ ID NO: 137009 - RNA, 1350 nt, Artificial Sequence; identical to SEQ ID NO: 137007
  derived and/or modified sequence opt3 from neuraminidase__InfluenzaA__ABE97653

SEQ ID NO: 137010 - RNA, 1350 nt, Artificial Sequence; identical to SEQ ID NO: 137007
  derived and/or modified sequence opt3 from neuraminidase__InfluenzaA__ABE97654

SEQ ID NO: 137011 - RNA, 1350 nt, Artificial Sequence
  derived and/or modified sequence opt3 from neuraminidase__InfluenzaA__ABE97655
augaaccccaaucagaagaucauuaccauaggcagcaucugcauggccauugggaucgugucccugaugcuccaaauuggaaacaugaucucuauaugggucucacacaguauccagacagguaaucagcaucaggcugagagcacuuccaacacgaauccucuuaccgaaaaagcaguugccucugugacacuggcgggcaacucgucauuguguccaauuagagggugggcuauccacagcaaggacaauaguauuaggaucggauccaaaggcgauguauucgugauacgggagccguuuauuucuugcagccauuuagaaugucgcacuuucuuucugacccaaggugcccuacucaacgacaagcacuccaaugggacagucaaagaucgaucaccccaucguacccugaugaguugcccugugggagaggcaccaagccccuacaacucuagauucgaauccguugccuggucagcuagcgcaugucacgacggcacaaguuggcuuacuaucggcauuucugggccugauaauggagccguggcuguccugaaguauaacgguaucaucaccgacacgauuaaguccuggaggaauaacauauugcggacucaggagagcgagugcgccugugugaauggcucgugcuuuaccguaaugacagaugggccaucuaacggacaggcguccuacaaaaucuucaagauggaaaaaggcaagguugugaaaucagucgagcucgacgcacccaacuaucacuacgaagaguguaguugcuauccugaugccggugagauuacuugugugugccgcgacaauuggcaugggagcaacagaccauggguguccuuuaaucagaaccuggaauaccaaaucggauauauaugcucuggcgucuucggcgauaauccgaggcccaacgacgggaccggaagcugugguccuaugucaccaaauggcgcuuacgggguuaagggauuugccuucaaguacggcaacgguguguggauugggcggacaaaaaguaccaauucccgcagcggcuuugagaugaucugggaucccaacggauggacgggcccugacucuucauucaguguaaagcaggacaucguggcaauuacugauuggagcggguauuccggaucuuuuguccagcacccagaacugacaggucucgacugcauccgacccuguuucuggguggaguuaauuagaggcaggccgaaagaaucgaccauauggacuagcggguccucaaucaguuucugcggaguuaauucugauacagugagcugguccuggccugacggcgcugagcugcccuuuaccauugauaaguga

SEQ ID NO: 137012 - RNA, 1350 nt, Artificial Sequence
  derived and/or modified sequence opt3 from neuraminidase__InfluenzaA__ABE97657
augaaccccaaucagaagaucauuaccauaggcagcaucugcauggugauugggacagucucccugguucuccaaaucggaaacaugauuucuaucugggugucacacaguauacagacugguaaucagcaucaggccgagagcaucuccaacacgaauccucuuaccgaaaaagcuguagcaucugugacacuggccggcaacucgucauuguguccaauuagagggugggcgguccacagcaaggacaauaguaucaggauuggauccaaaggcgauguguucguuauccgggagccguuuauaucuugcagccauuuagaaugucgcacuuucuuucugacccaaggugcucuacucaacgacaagcacuccaaugggacagugaaagaucgaucaccccaucguacccugaugaguugcccugucggagaggccccaagccccuacaacucuagauucgaauccguggcauggucagccagcgcuugucacgacggcacuagcuggcuuacaauuggcaucucugggccugauaauggagcaguagccguucugaaguauaacgguauuaucaccgacacgaucaaguccuggagggauaauauuuugcggacucaggagagcgagugcgcuugugugaacggcucgugcuuuaccgucaugacagacgggccaucuaauggacaggccuccuacaaaauauucaagauggaaaaaggcaagguggugaaaucagucgagcucgaugcgcccaacuaucacuacgaagaguguaguugcuauccugacgcaggagagaucacuuguguuugccgcgauaacuggcaugggagcaauagaccauggguguccuuuaaccagaaucuggaauaccaaauuggauauaucugcucuggcguauucggcgacaacccgaggcccaaugaugggaccggaagcugugguccuaugucaaguaacggcgccuacggggugaagggauuuuccuucaaguacggcaauggugucuggauagggcggacaaaaagcaccaacucucgcucaggcuuugagaugauuugggacccaaauggauggacgggcacugacaguagcuucuccgugaagcaggauaucguugcuaucacagacuggucuggguauucggguagcuuugugcagcaccccgaacugaccggucucgauugcauucgaccuuguuucugggucgaguuaaucagaggcaggccaaaagaauccacuauuuggacaucagggaguucuauaaguuucugcggagugaacuccgacaccguaucauggagcuggcccgauggcgccgagcugccguuuacgaucgacaaguga

SEQ ID NO: 137013 - RNA, 1350 nt, Artificial Sequence
  derived and/or modified sequence opt3 from neuraminidase__InfluenzaA__ABE97658
augaaccccaaucagaagaucauuaccauaggcagcaucugcauggugauugggacaaucucccugaugcuccaaauuggaaacaugaucucuauaugggucucacacaguauccagacugguaaucagcaucagacggagagcauuuccaacaccaauccucuuacagaaaaagccguugcuucugugacucuggcaggcaacucgucauuguguagcaucagagggugggccguacacaguaaggacaauuccauuaggaucggaucuaaaggcgauguguucgucauacgggagccauuuauuagcugcucccauuuagaaugucgcaccuucuuucugacacaaggugcgcuacucaacgacaagcacucaaaugggaccgugaaagaucgaaguccgcaucguacucugaugagcugccccguuggagaggcuccuucuccauacaacuccagauucgaaucaguggccuggagcgcaagugccugucacgacggcacaucuuggcuuaccaucggcauuuccgggcccgauaauggagcugucgcagugcugaaguauaacgguaucaucacggacacuauuaagagcuggagggauaauauauugcggacccaggagucggagugcgccuguguaaacggcucuugcuuuacaguuaugacugacgggccuuccaauggacaggcuucauacaaaaucuucaagauggaaaaaggcaagguggucaaaaguguggagcucgaugccccaaacuaucacuacgaagaguguagcugcuaucccgacgcgggugagauuaccugugugugccgcgauaacuggcauggguccaauagaccuugggucucuuuuaaccagaaucuggaauaccaaaucggauauauaugcagcggcguuuucggcgacaacccaaggccgaaugaugggacaggaucauguggucccaugaguuccaacggcgcacacggggugaagggauuuagcuucaaguacggcaaugguguauggauugggcggaccaaaucuacgaacucacgcaguggcuuugagaugaucugggacccuaauggauggacuggcacagacagcuccuucucugugaagcaggauaucgucgccauuaccgacuggucgggguacagcggauccuuugugcagcauccagaacugacuggucucgauugcauccgacccuguuucuggguugaguuaauuagaggcaggccuaaagaaucaacaauauggaccagugggucuagcaucuccuucugcggagugaacucagacacggucagcuggucuuggccagauggcgcugagcugcccuuuaccauugacaaguga

SEQ ID NO: 137014 - RNA, 1350 nt, Artificial Sequence
  derived and/or modified sequence opt3 from neuraminidase__InfluenzaA__ABE97659
augaaccccaaucagaagaucauuaccauaggcagcaucugcauggugauugggaucgucucccugaugcuccaaauuggaaacaugaucucuauauggguuucacacaguauccagacagguaaucagcaucaggccgagagcauuuccaacacuaauccucuuacggaaaaagcuguggcaucuguaacccuggccggcaacucgucauuguguccaaucagagggugggcggugcacagcaaggacaauaguauuaggaucggauccaaaggcgaugucuucgugauacgggagccguuuauuucuugcagccauuuagaaugucgcacauucuuucugacucaaggugcucuacucaacgacaagcacuccaaugagaccguuaaagaucgaucaccccaucguacacugaugaguugcccugugggggaagccccaagccccuacaacucuagauucgaguccgucgcauggucagccagcgcuugucacgacggaaccaguuggcuuacuaucggcauuucuggcccugauaauggggcaguggccguacugaaguauaacggaaucaucacagacaccauuaaguccuggagggauaauauauugcggacgcaggagagcgaaugcgcuuguguuaacgguucgugcuuuacugugaugaccgacggcccaucuaaugggcaggccuccuacaaaaucuucaagauggagaaaggaaaggucgugaaaucaguggaacucgaugcgcccaacuaucacuacgaggaguguaguugcuauccugacgcaggcgaaauuacaugugucugccgcgauaacuggcaugguagcaauagaccauggguuuccuuuaaccagaaucuggaguaccaaaucggguauauaugcucuggaguguucggcgacaacccgaggcccaaugauggcacugggagcuguggaccuaugucaaguaacggugccuacggcguaaagggguuuuccuucaaguacggaaauggcguguggauuggucggaccaaaagcacaaacucucgcucaggguuugaaaugaucugggacccaaauggcuggaccggaacggacaguagcuucuccgucaagcaggauaucguggcuauuacugacuggucuggcuauucggggagcuuuguucagcaccccgagcugacaggacucgauugcauccgaccuuguuucuggguggaauuaauuagagguaggccaaaagaguccaccauauggacuucaggcaguucuaucagcuucugcggggucaacuccgacacagugucauggagcuggcccgauggagccgagcugccguuuaccauugacaaguga

SEQ ID NO: 137015 - RNA, 1350 nt, Artificial Sequence
  derived and/or modified sequence opt3 from neuraminidase__InfluenzaA__ABE97660
augaaccccaaucagaagaucauuaccauaggcagcaucugcauggugauugggacaaucucccugaugcuccaaauuggaaacaugaucucuauaugggucucacacaguauccagacugguaaucagcaucaggccgagagcauuuccaacacgaauccucuuaccgaaaaagcuguugcaucugugacacuggccggcaacucgucauuguguccaaucagagggugggcgguacacagcaaggacaauaguauuaggaucggauccaaaggcgauguguucgucauacgggagccguuuauuucuugcagccauuuagaaugucgcacuuucuuucugacccaaggugcucuacucaacgacaagcacuccaaugggacagugaaagaucgaucaccccaucguacccugaugaguugcccuguuggagaggccccaagccccuacaacucuagauucgaauccguggcauggucagccagcgcuugucacgacggcacuagcuggcuuacaaucggcauuucugggccugauaauggagcagucgccgugcugaaguauaacgguaucaucaccgacacgauuaaguccuggagggauaauauauugcggacucaggagagcgagugcgcuuguguaaacggcucgugcuuuaccguuaugacagacgggccaucuaauggacaggccuccuacaaaaucuucaagauggaaaaaggcaagguggucaaaucaguggagcucgaugcgcccaacuaucacuacgaagaguguaguugcuauccugacgccggugagauuacuugugugugccgcgauaacuggcaugggagcaauagaccaugggucuccuuuaaccagaaucuggaauaccaaaucggauauauaugcucuggcguuuucggcgacaacccgaggcccaaugaugggaccggaagcugugguccuaugucaaguaacggcgcacacggggugaagggauuuuccuucaaguacggcaaugguguauggauugggcggacaaaaagcaccaacucucgcucaggcuuugagaugaucugggacccaaauggauggacgggcacugacaguagcuucuccgugaagcaggauaucgucgcuauuacagacuggucuggguacucgggaaguuuugugcagcaucccgaacugaccggucucgauugcauccgaccuuguuucuggguugaguuaauuagaggcaggccaaaagaauccacuauauggacaucagggaguucuaucagcuucugcggagugaacuccgacaccgucucauggagcuggcccgauggcgccgagcugccguuuacgauugacaaguga

SEQ ID NO: 137016 - RNA, 1350 nt, Artificial Sequence
  derived and/or modified sequence opt3 from neuraminidase__InfluenzaA__ABE97661
augaaccccaaucagaagaucauuaccauaggcagcaucugcauggugauugggacaaucucccugaugcuccaaauuggaaacaugaucucuauaugggucucacacaguauccagacugguaaucagcaucagacggagagcauuuccaacaccaauccucuuacagaaaaagccguugcuucugugacucuggcaggcaacucgucauuguguccaaucagagggugggccguacacagcaaggacaauaguauuaggaucggauccaaaggcgauguguucgucauacgggagccguuuauuucuugcagccauuuagaaugucgcaccuucuuucugacacaaggugcgcuacucaacgacaagcacuccaaugggaccgugaaagaucgaucaccccaucguacucugaugaguugcccuguuggagaggcuccaagccccuacaacucuagauucgaauccguggccuggucagcaagcgccugucacgacggcacaaguuggcuuaccaucggcauuucugggccugauaauggagcugucgcagugcugaaguauaacgguaucaucacggacacuauuaaguccuggagggauaauauauugcggacccaggagagcgagugcgccuguguaaacggcucgugcuuuacaguuaugacugacgggccaucuaauggacaggcuuccuacaaaaucuucaagauggaaaaaggcaagguggucaaaucaguggagcucgaugcccccaacuaucacuacgaagaguguaguugcuauccugacgcgggugagauuaccugugugugccgcgauaacuggcaugggagcaauagaccaugggucuccuuuaaccagaaucuggaauaccaaaucggauauauaugcucuggcguuuucggcgacaacccgaggcccaaugaugggacaggaagcugugguccuaugucaaguaacggcgcacacggggugaagggauuuuccuucaaguacggcaaugguguauggauugggcggaccaaaagcacgaacucucgcucaggcuuugagaugaucugggacccaaauggauggacuggcacagacaguagcuucuccgugaagcaggauaucgucgccaccacugacuggucuggguacucggguagcuuugugcagcaucccgaacugacaggacucgauugcauucgaccuuguuucuggguugaguuaaucagaggcaggccaaaagaauccaccguguggacgucagggaguucuauuagcuucugcggagucaacuccgacaccgugucauggagcuggcccgauggcgcugagcugccguuuacaauagacaaguga

SEQ ID NO: 137017 - RNA, 1350 nt, Artificial Sequence
  derived and/or modified sequence opt3 from neuraminidase__InfluenzaA__ABE97662
augaaccccaaucagaagaucauuaccauaggcagcaucugcauggugauugggaucgucucccugaugcuccaaauuggaaacaugaucucuauauggguuucacacaguauccagacagguaaucagcaucaggccgagagcauuuccaacacuaauccucuuacggaaaaagcuguggcaucuguaacccuggccggcaacucgucauuguguccaaucagagggugggcggugcacagcaaggacaauaguauuaggaucggauccaaaggcgaugucuucgugauacgggagccguuuauuucuugcagccauuuagaaugucgcacauucuuucugacucaaggugcucuacucaacgacaagcacuccaaugggaccguuaaagaucgaucaccccaucguacacugaugaguugcccugugggagaggccccaagccccuacaacucuagauucgaauccgucgcauggucagccagcgcuugucacgacggcaccaguuggcuuacuaucggcauuucugggccugauaauggagcaguggccguacugaaguauaacgguaucaucacagacaccauuaaguccuggaggaauaacauauugcggacgcaggagagcgagugcgcuuguguuaauggcucgugcuuuacugugaugaccgaugggccaucuaacggacaggccuccuacaaaaucuucaagaugcgcaaaggcaaggucgugaaaucaguggaacucgacgcgcccaacuaucacuacgaggaauguaguugcuauccugaugccggugagauuacaugugucugcagagacaauuggcaugggagcaacaggccauggguuuccuuuaaucagaaccuggaguaccaaaucggauauauaugcucuggcguguucggcgauaauccgcggcccaacgacgggacuggaagcugugguccuaugucaccaaauggcgcauacgggguaaagggauuuaguuucaaguacggcaacgguguguggauugggcgcaccaaauccacaaauagccgaucuggcuuugaaaugaucugggaucccaacggauggaccggcacggacucaaguuucagcgucaagcaggacaucguggcuauuacugauugguccggguauucuggaucguuuguucagcacccugagcugacaggucucgacugcaucagaccauguuucuggguggaauuaauuaggggccggcccaaagagagcaccauauggacuuccgggucaaguaucucuuucugcggagucaauagcgauacaguguccuggucauggccggacggcgccgaacugccuuuuaccauugauaaguga

SEQ ID NO: 137018 - RNA, 1350 nt, Artificial Sequence
  derived and/or modified sequence opt3 from neuraminidase__InfluenzaA__ABE97663
augaaccccaaucagaagaucauuaccauaggcagcaucugcauggugacagggauugucucccugaugcuccaaaucggaaacaugauuucuaucuggguuucacacaguauacauacugguaaucagcaccaggccgagccuaucagcaacacgaauuuccuuaccgaaaaagcuguggcauccguaaagcuggccggcaacucuucguuguguccaauuaaugggugggcgguguacucaaaagacaacagcaucagaauuggaaguaagggcgaugucuuugugaucagggagccguucauauccugcucucauuuagaaugucggacauuuuuccugacucagggugcucuacucaaugacaaacacagcaacgggaccguuaaggaucgcucaccccaucgaacacugauguccugcccugugggagaggccccaagucccuauaauagccguuuugaaucugucgcaugguccgccucagcuugucacgacggcaccagcuggcuuacuauuggcaucagugggccugauaacggagcaguggccguacugaaguacaaugguauuaucacagacaccaucaaaucuuggagaaacaauauuuugaggacgcaagaguccgagugcgcuuguguuaacggcagcugcuucacugugaugaccgaugggccaucgaacggacaggccucucacaagauauuuaaaauggaaaagggcaaagucgugaaguccguggagcucgacgcgcccaauuaucauuacgaagaguguucaugcuauccugaugccggugagaucacaugugucugccgggacaacuggcacgggaguaaucgcccauggguuagcuucaaccagaaucuggaauaccagauuggauauaucugcuccggcguguuuggcgauaacccgagacccaaugacgggacuggaucuugugguccuguaagcucaaacggcgcauacggggugaagggauucaguuuuagguacggcaauggugucuggauagggcggaccaaauccacaaacagccgcucuggcuucgagaugauuugggauccaaauggauggaccgaaacggacucaaguuuuagcgugaagcaagacaucguugcuaucacugauugguccggcuauucugggucguucgugcagcaucccgagcugacaggacucgacugcauucgaccuuguuucugggucgaauuaaucagagguaggccaaaagagagcaccauuuggacuuccggcucaaguauaucuuuuugcggggugaacagcgauacaguaggaugguccuggcccgacggcgccgagcugccguucaccaucgauaaguga

SEQ ID NO: 137019 - RNA, 1350 nt, Artificial Sequence
  derived and/or modified sequence opt3 from neuraminidase__InfluenzaA__ABE97665
augaaccccaaucagaagaucauuaccauaggcagcaucugcauggugacagggauugucucccugaugcuccaaguuggaaacaugaucucuauuugggugucacacaguauccauacugguaaucagcaccaggccgagccuauaagcaacacgaauuuccuuaccgaaaaagcuguagcauccgugaagcuggccggcaacucuucguuguguccaaucaaugggugggcggucuacucaaaagacaacagcauuagaaucggaaguaagggcgauguguuuguuauuagggagccguucaucuccugcucucauuuagaaugucggacauuuuuccugacucacggugcucuacucaaugacaaacauagcaacgggaccgugaaggaucgcucaccccaccgaacacugauguccugcccugucggagaggccccaagucccuauaauagccguuuugaaucuguggcaugguccgccucagcuugucacgacggcaccagcuggcuuacuauaggcauuagugggccugauaacggagcaguagccguucugaaguacaaugguaucauuacagacaccaucaaaucuuggagaaacaauaucuugaggacgcaggaguccgagugcgcuugugugaacggcagcugcuucacugucaugaccgaugggccaucgaacggacaagccucucauaagauuuuuaaaauggaaaagggcaaaguggugaaguccgucgagcucgacgcgcccaauuaucacuacgaagaguguucaugcuauccugaugccggugagauaacauguguuugccgggacaacuggcaugggaguaaucgcccaugggugagcuucaaccagaaucuggaauaccagaucggauauauuugcuccggcguauuuggcgauaacccgagacccaaugacgggacuggaucuugugguccugugagcucaaacggcgcauacggggucaagggauucaguuuuaaauacggcaaugguguguggaucgggaggaccaaguccacaaacagccggucuggcuucgagaugauaugggauccaaauggauggaccgaaacggacucaaguuuuagcguuaaacaggacauuguggcuaucacugauugguccggcuauucugggucguucguccaacaccccgagcugacaggacucgacugcauccgcccuuguuucuggguggaauuaauucgagguagaccaaaggagagcaccaucuggacuuccggcucaaguauuucuuuuugcgggguaaacagcgauacaguuggaugguccuggcccgacggcgccgagcugccguucaccauagauaaauga

SEQ ID NO: 137020 - RNA, 1350 nt, Artificial Sequence
  derived and/or modified sequence opt3 from neuraminidase__InfluenzaA__ABE97666
augaaccccaaucagaagaucauuaccauaggcagcaucugcauggugacagggauugucucccugaugcuccaaaucggaaacaugauuucuaucuggguuucacacaguauacauacugguaaucagcaccagagcgagccuaucuccaacacgaauuuccuuaccgaaaaagccguggcuucuguaaagcuggcaggcaacucgccauuguguccgauuaaugggugggccguguacucaaaagacaacagcaucagaauuggaaguaagggcgaugucuuugugaucagggagcccuucauauccugcucucauuuagaaugucggacauuuuuccugacucagggugcgcuacucaaugacaaacacagcaacgggaccguuaaggaucgcuccccucaucgaacacugaugucaugcccagugggagaggcucccaguccuuauaauagccguuuugaaucugucgccugguccgcaucagccugucacgacggcaccagcuggcuuacuauuggcaucagugggccagauaacggagcuguggcaguacugaaguacaaugguauuaucacagacaccaucaaaucuuggagaaacaauauuuugaggacgcaagaguccgagugcgccuguguuaacggcagcugcuucacugugaugaccgaugggcccucgaacggacaggcuucucacaagauauuuaaaauggaaaagggcaaagucgugaaguccguggagcucgacgccccuaauuaucauuacgaagaguguucaugcuauccagaugcgggugagaucacaugugucugccgggacaacuggcacgggaguaaucgcccguggguuagcuucaaccagaaucuggaauaccagauuggauauaucugcuccggcguguuuggcgauucucccagaccuaacgacgggacuggaagcugugguccaguaucaaguaauggcgcauacggggugaagggauucuccuuuaaauacggcaacggugucuggauagggaggaccaagagcacaaauucucggucaggcuucgagaugauuugggaucccaacggauggaccgaaacggacaguagcuuuuccgugaaacaagacaucguugccaucacugauuggucuggcuauucggggagcuucgugcagcauccugagcugacaggacucgacugcauucgcccauguuucugggucgaauuaauccgagguagacccaaggaguccaccauuuggacuucaggcaguucuauauccuuuugcggggugaauagcgauacaguaggauggucauggccggacggcgcugagcugccuuucaccaucgauaaauga

SEQ ID NO: 137021 - RNA, 1350 nt, Artificial Sequence
  derived and/or modified sequence opt3 from neuraminidase__InfluenzaA__ABE97667
augaaccccaaucagaagaucauuaccauaggcagcaucugcauggugacagggauugucucccugaugcuccaaaucggaaacaugauuucuaucugggguucacacaguauacauacuggcaaucagcaccagagcgagccuaucuccaacacgaauuuccuuaccgaaaaagccguugcuucugugaagcuggcagggaacucgucauuguguccaauuaauggaugggccguauacagcaaagacaacaguaucagaauuggcuccaagggugauguguuugucaucagggagccguucauaucuugcagccauuuagaaugucggacauuuuuccugacucagggggcgcuacucaaugacaaacacuccaacggaaccgugaaggaucgcucaccccaucgaacacugaugaguugcccuguuggcgaggcuccaagccccuauaauucucguuuugaauccguggccuggucagcaagcgccugucacgacggcaccaguuggcuuacuauugggaucucuggaccugauaacggugcugucgcagugguaaaguacaauggcauuaucacagacaccaucaaauccuggagaaacaauauucugaggacgcaagagagcgagugcgccuguguuaacgggucgugcuucacugugaugaccgauggaccaucuaacggccaggcuucccacaagauauuuaaaauggaaaaggguaaagucgugaagucaguggaguuggacgcccccaauuaucauuacgaagaguguaguugcuauccugaugcggggaagaucacaugugucugccgggacaacuggcacggaagcaaucgcccauggguuuccuucaaccagaaucucgaguaccagauuggcuauaucugcucuggcguguuuggggauaacccgagacccaaugacggaacugguagcuguggcccuguaucaaguaacggggcauacggagugaaaggcuucuccuuuaaguacgguaauggggucuggauaggcaggaccaaaagcacaaacucucggucaggauucgaaaugauuugggauccaaauggcuggaccgagacggacaguagcuuuuccgugaagcaagacaucguugccaucacugauuggucuggguauucggguagcuucgugcagcaucccgaacugacaggacuggacugcauucgcccuuguuucugggucgagcucauccgaggcagaccaaaagaauccaccauuuggacuucagggaguucuaucagcuuuugcggagugaacuccgauauaguaggcuggucauggcccgacggugcugaguuaccguucacaauugauaaguga

SEQ ID NO: 137022 - RNA, 1350 nt, Artificial Sequence
  derived and/or modified sequence opt3 from neuraminidase__InfluenzaA__ABE97669
augaaccccaaucagaagaucauuaccauaggcagcaucugcauggugacagggauugucucccugaugcuccaaaucggaaacaugauuucuaucuggguuucacacaguauacauacugguaaucagcaccagagcgagccuaucuccaacacgaauuuccuuaccgaaaaagccguggcuucuguaaagcuggcaggcaacucgucauuguguccaauuaaugggugggccguguacagcaaagacaacaguaucagaauuggauccaagggcgaugucuuugugaucagggagccguucauaucuugcagccauuuagaaugucggacauuuuuccugacucagggugcgcuacucaaugacaaacacuccaacgggaccguuaaggaucgcucaccccaucgaacacugaugaguugcccugugggagaggcuccaagccccuauaauucucguuuugaauccgucgccuggucagcaagcgccugucacgacggcaccaguuggcuuacuauuggcaucucugggccugauaacggagcuguggcaguaguuaaguacaaugguauuaucacagacaccaucaaauccuggagaaacaauauucugaggacgcaagagagcgagugcgccugugugaacggcucgugcuucacugucaugaccgaugggccaucuaacggacaggcuucccacaagauauuuaaaauggaaaagggcaaaguggugaagucagucgaguuggacgcccccaauuaucauuacgaagaguguaguugcuauccugaugcgggugagaucacauguguuugccgggacaacuggcacgggagcaaucgcccauggguguccuucaaccagaaucucgaauaccagauuggauauaucugcucuggcguauuuggcgauaacccgagacccaaugacgggacuggaagcugugguccugugucaaguaacggcgcauacggggucaagggauucuccuuuaaauacggcaaugguguguggauagggaggaccaagagcacaaacucucggucaggcuucgagaugauuugggauccaaauggauggaccgaaacggacaguagcuuuuccguuaaacaagacaucguggccaucacugauuggucuggcuauucggggagcuucguccagcaucccgagcugacaggacuggacugcauucgcccuuguuucuggguggaacucauccgagguagaccaaaggaguccaccauuuggacuucaggcaguucuaucagcuuuugcgggguaaacuccgauacaguuggauggucauggcccgacggcgcugaguuaccguucaccauagauaaauga

SEQ ID NO: 137023 - RNA, 1350 nt, Artificial Sequence
  derived and/or modified sequence opt3 from neuraminidase__InfluenzaA__ABE97670
augaaccccaaucagaagaucauuaccauaggcagcaucugcauggugacagggauugucucccugaugcuccaaaucggaaacaugauuucuaucuggguuucacacaguauacauacugguaaucagcaccagagcgagccuaucuccaacacgaauuuccuuaccgaaaaagccguggcuucuguaaagcuggcaggcaacucgucauuguguccaauuaaugggugggccguguacagcaaagacaacaguaucagaauuggauccaagggcgaugucuuugugaucagggagccguucauaucuugcagccauuuagaaugucggacauuuuuccugacucagggugcgcuacucaaugacaaacacuccaacgggaccguuaaggaucgcucaccccaucgaacacugaugaguugcccugugggagaggcuccaagccccuauaauucucguuuugaauccgucgccuggucagcaagcgccugucacgacggcaccaguuggcuuacuauuggcaucucugggccugauaacggagcuguggcaguaguuaaguacaaugguauuaucacagacaccaucaaauccuggagaaacaauauucugaggacgcaagagagcgagugcgccugugugaacggcucgugcuucacugucaugaccgaugggccaucuaacggacaggcuucccacaagauauuuaaaauggaaaagggcaaaguggugaagucagucgaguuggacacacccaauuaucauuacgaagaguguaguugcuauccugaugccggugagaucacuuguguuugccgggacaacuggcacgggagcaaucgcccauggguguccuucaaccagaaucucgaauaccagauuggauauaucugcucuggcguauuuggcgauaacccgagacccaaugacgggaccggaagcugugguccugugucaaguaacggcgcguacggggucaagggauucuccuuuaaauacggcaaugguguguggauagggaggacaaagagcaccaacucucggucaggcuucgagaugauuugggauccaaauggauggacggaaacugacaguagcuuuuccguuaaacaagacaucguggcaaucacagauuggucuggcuauucggggagcuucguccagcaucccgagcugaccggacuggacugcauucgcccuuguuucuggguggaacucauccgagguagaccaaaggaguccacuauuuggacaucaggcaguucuaucagcuuuugcgggguaaacuccgauaccguuggauggucauggcccgacggcgccgaguuaccguucacgauagauaaauga

SEQ ID NO: 137024 - RNA, 1350 nt, Artificial Sequence
  derived and/or modified sequence opt3 from neuraminidase__InfluenzaA__ABE97671
augaaccccaaucagaagaucauuaccauaggcagcaucugcauggugacagggauugucucccugaugcuccaaaucggaaacaugauuucuaucuggguuucacacaguauacauacugguaaucagcaccaggccgagccuaucagcaacacgaauuuccuuaccgaaaaagcuguggcauccguaaagcuggccggcaacucuucguuguguccaauuaaugggugggcgguguacucaaaagacaacagcaucagaauuggaaguaagggcgaugucuuugugaucagggagccguucauauccugcucucauuuagaaugucggacauuuuuccugacucagggugcucuacucaaugacaaacacagcaacgggaccguuaaggaucgcucaccccaucgaacacugauguccugcccugugggagaggccccaagucccuauaauagccguuuugaaucugucgcaugguccgccucagcuugucacgacggcaccagcuggcuuacuauuggcaucagugggccugauaacggagcaguggccguacugaaguacaaugguauuaucacagacaccaucaaaucuuggagaaacaauauuuugaggacgcaagaguccgagugcgcuuguguuaacggcagcugcuucacugugaugaccgaugggccaucgaacggacaggccucucacaagauauuuaaaauggaaaagggcaaagucgugaaguccguggagcucgacgcgcccaauuaucauuacgaagaguguucaugcuauccugaugccggugagaucacaugugucugccgggacaacuggcacgggaguaaucgcccauggguuagcuucaaccagaaucuggaauaccagauuggauauaucugcuccggcguguuuggcgauaacccgagacccaaugacgggacuggaucuugugguccuguaagcucaaacggcgcauacggggugaagggauucaguuuuaaauacggcaauggugucuggauagggaggaccaaguccacaaacagccggucuggcuucgagaugauuugggauccaaauggauggaccgaaacggacucaaguuuuagcgugaaacaagacaucguugcuaucacugauugguccggcuauucugggucguucgugcagcaucccgagcugacaggacucgacugcauucgcccuuguuucugggucgaauuaauccgagguagaccaaaggagagcaccauuuggacuuccggcucaaguauaucuuuuugcggggugaacagcgauacaguaggaugguccuggcccgacggcgccgagcugccguucaccaucgauaaauga

SEQ ID NO: 137025 - RNA, 1350 nt, Artificial Sequence
  derived and/or modified sequence opt3 from neuraminidase__InfluenzaA__ABE97672
augaaccccaaucagaagaucauuaccauaggcagcaucugcauggugacagggauugucucccugaugcuccaaaucggaaacaugauuucuaucuggguuucacacaguauacauacugguaaucagcaccaggccgagccuaucagcaacacgaauuuccuuaccgaaaaagcucuggcauccgugaaguuggccggcaacucuucguuauguccaauuaaugggugggcgguauacucaaaagacaacagcaucagaauuggaaguaagggcgauguguuugucaucagggagccguucauauccugcucucaucuggaaugucggacauuuuuccuaacucagggugcucuccugaaugacaaacacagcaacgggaccgugaaggaucgcucaccccaucgaacacuuauguccugcccuguuggagaggccccaagucccuauaauagccguuuugaaucuguggcaugguccgccucagcuugucacgacggcaccagcuggcugacuauuggcaucagugggccugauaacggagcagucgccguguugaaguacaaugguauuaucacagacaccaucaaaucuuggagaaacaauauucucaggacgcaagaguccgagugcgcuuguguaaacggcagcugcuucacuguuaugaccgaugggccaucgaacggacaggccucucacaagauauuuaaaauggaaaagggcaaaguggucaaguccguggagcuggacgcgcccaauuaucauuacgaagaguguucaugcuauccugaugccggugagaucacaugugugugccgggacaacuggcacgggaguaaucgcccaugggucagcuucaaccagaaucuggaauaccagauuggauauaucugcuccggcguuuuuggcgauaacccgagacccaaugacgggacuggaucuugugguccugugagcucaaacggcgcauacgggguaaagggauucaguuuuaaauacggcaaugguguguggauagggaggaccaaguccacaaacagccggucuggcuucgagaugauuugggauccaaauggauggaccgaaacggacucaaguuuuagcgucaaacaagacaucguggcuaucacugauugguccggcuauucugggucguucguucagcaucccgagcucacaggauuagacugcauucgcccuuguuucuggguggaacugauccgagguagaccaaaggagagcaccauuuggacuuccggcucaaguauaucuuuuugcggggucaacagcgauacagugggaugguccuggcccgacggcgccgagcuuccguucaccaucgauaaauga

SEQ ID NO: 137026 - RNA, 1350 nt, Artificial Sequence
  derived and/or modified sequence opt3 from neuraminidase__InfluenzaA__ABE97675
augaaccccaaucagaagaucauuaccauaggcagcaucugcauggugacagggauugucucccugaugcuccaaguuggaaacaugaucucuauuugggugucacacaguauccauacugguaaucagcaccaggccgagccuauaagcaacacgaauuuccuuaucgaaaaagcuguagcauccgugaagcuggccggcaacucuucguuguguccaauuaaugggugggcggucuacucaaaagacaacagcaucagaauuggaaguaagggcgauguguuuguuaucagggagccguucauauccugcucucauuuagaaugucggaccuuuuuccugacacagggugcucuacucaaugacaaacacagcaacgggacugugaaggaucgcucaccccaucgaacccugauguccugcccugucggagaggccccaagucccuauaauagccguuuugaaucuguggcaugguccgccucagcuugucacgacggcacaagcuggcuuaccauuggcaucagugggccugauaacggagcaguagccguucugaaguacaaugguauuaucacugacacaaucaaaucuuggagaaacaauauuuugaggacccaagaguccgagugcgcuugugugaacggcagcugcuucacggucaugacugaugggccaucgaacggacaggccucucacaagauauuuaaaaucgaaaagggcaaaguggugaaguccgucgagcucgacgcgcccaauuaucauuacgaagaguguucaugcuauccugaugccggugagauuaccuguguuugccgggacaacuggcacgggaguaaucgcccaugggugagcuucaaccagaaucuggaauaccagaucggauauauaugcuccggcguauuuggcgauaacccgagacccaaugacgggacaggaucuugugguccugugagcucaaacggcgcauacggggucaagggauucaguuuuaaauacggcaaugguguguggauugggaggacuaaguccaccaacagccggucuggcuucgagaugaucugggauccaaauggauggucagaaacagacaguagcuuuuccguuaaacaagacaucguggcuauuaccgauuggucuggcuauucggggagcuucguccagcaucccgagcugacgggacucgacugcauccgcccuuguuucuggguggaauuaauucgagguagaccaaaggaguccacuauauggacaucaggcaguucuaucagcuuuugcgggguaaacuccgauaccguuggauggucauggcccgacggcgccgagcugccguucacuauugauaaauga

SEQ ID NO: 137027 - RNA, 1350 nt, Artificial Sequence
  derived and/or modified sequence opt3 from neuraminidase__InfluenzaA__ABE97676
augaaccccaaucagaagaucauuaccauaggcagcaucugcauggugacagggauugucucccugaugcuccaaaucggaaacaugauuucuaucuggguuucacacaguauacauacugguaaucagcaccaggccgagccuaucagcaacacgaauuuccuuaccgaaaaagcuguggcauccguaaagcuggccggcaacucuucguuguguccaauuaaugggugggcgguguacucaaaagacaacagcaucagaauuggaaguaagggcgaugucuuugugaucagggagccguucauauccugcucucauuuagaaugucggacauuuuuccugacucagggugcucuacucaaugacaaacacagcaacgggaccguuaaggaucgcucaccccaucgaacacugauguccugcccugugggagaggccccaagucccuauaauagccguuuugaaucugucgcaugguccgccucagcuugucacgacggcaccagcuggcuuacuauuggcaucagugggccugauaacggagcaguggccguacugaaguacaaugguauuaucacagacaccaucaaaucuuggagaaacaauauuuugaggacgcaagaguccgagugcgcuuguguuaacggcagcugcuucacugugaugaccgaugggccaucgaacggacaggccucucacaagauauuuaaaauggaaaagggcaaagucgugaaguccguggagcucgacgcgcccaauuaucauuacgaagaguguucaugcuauccugaugccggugagaucacaugugucugccgggacaacuggcacgggaguaaucgcccauggguuagcuucaaccagaaucuggaauaccagauuggauauaucugcuccggcguguuuggcgauaacccgagacccaaugacgggacuggaucuugugguccuguaagcucaaacggcgcauacggggugaagggauucaguuuuaaauacggcaauggugucuggauagggaggaccaaguccacaaacagccggucuggcuucgagaugauuugggauccaaauggauggaccgaaacggacucaaguuuuagcgugaaacaagacaucguugcuaucaacgauugguccggcuauucugggucguucgugcagcaucccgagcugacuggacucgacugcauucgcccuuguuucugggucgaauuaauccgagguagaccaaaggagagcacaauuuggaccuccggcucaaguauaucuuuuugcggggugaauagcgauacuguaggaugguccuggcccgacggcgccgagcugccguucacaaucgauaaauga

SEQ ID NO: 137028 - RNA, 1350 nt, Artificial Sequence
  derived and/or modified sequence opt3 from neuraminidase__InfluenzaA__ABE97677
augaaccccaaucagaagaucauuaccauaggcagcaucugcauggugacagggauugucucccugaugcuccaaaucggaaacauuaucucuauauggguuagacacucaauccauacugguaaucagcaccagagugagccuauuagcaacacgaauuuccuuaccgaaaaagccguggcuuccguaaagcuggcaggcaacucuucguuguguccaaucaaugggugggccguguacucaaaagacaacagcauuaggaucggaaguaagggcgaugucuuugugauacgggagccguucauuuccugcucucauuuagaaugucgcacauuuuuccugacucagggugcgcuacucaaugacaaacacagcaacgggaccguuaaggaucgaucaccccaucguacacugauguccugcccugugggagaggcuccaagucccuauaauagcagauuugaaucugucgccugguccgcaucagccugucacgacggcaccagcuggcuuacuaucggcauuagugggccugauaacggagcuguggcaguaguuaaguacaaugguaucaucacagacaccauuaaaucuuggaggaacaauauacugcggacgcaagaguccgagugcgccugugugaacggcagcugcuucacugucaugaccgaugggccaucgaacggacaggcuucucacaagaucuuuaaaauggaaaagggcaaaguggugaaguccgucgaguuggacgcccccaauuaucauuacgaagaguguucaugcuauccugaugcgggugagauuacauguguuugccgcgacaacuggcacgggaguaauagaccaugggugagcuucaaccagaaucucgaauaccagaucggauauauaugcuccggcguauuuggcgauaacccgaggcccaaugacgggacuggaucuugugguccugugagcucaaacggcgcauacggggucaagggauucaguuuuaaauacggcaaugguguguggauugggcggaccaaguccacaaacagccgcucuggcuucgagaugaucugggauccaaauggauggaccgaaacggacucaaguuuuagcguuaaacaagacaucguggccauuacugauugguccggcuauucugggucguucguccagcaucccgagcugacaggacuggacugcauccgaccuuguuucuggguggaacucauuagagguaggccaaaggagagcaccauauggacuuccggcucaaguaucucuuuuugcgggguaaacagcgauacaguuggaugguccuggcccgacggcgcugaguuaccguucaccauugauaaauga

SEQ ID NO: 137029 - RNA, 1350 nt, Artificial Sequence
  derived and/or modified sequence opt3 from neuraminidase__InfluenzaA__ABE97679
augaaccccaaucagaagaucauuaccauaggcagcaucugcauggugacagggauugucucccugaugcuccaaaucggaaacaugauuucuaucuggguuagacacucaauacauacugguaaucagcaccagagugagccuaucagcaacacgaauuuccuuaccgaaaaagccguggcuuccguaaagcuggcaggcaacucuucguuguguccaauuaaugggugggccguguacucaaaagacaacagcaucaggauuggaaguaagggcgaugucuuugugauccgggagccguucauauccugcucucauuuagaaugucgcacauuuuuccugacucagggugcgcuacucaaugacaaacacagcaacgggaccguuaaggaucgaucaccccaucguacacugauguccugcccugugggagaggcuccaagucccuauaauagcagauuugaaucugucgccugguccgcaucagccugucacgacggcaccagcuggcuuacuauuggcaucagugggccugauaacggagcuguggcaguaguuaaguacaaugguauuaucacagacaccaucaaaucuuggaggaacaauauucugcggacgcaagaguccgagugcgccugugugaacggcagcugcuucacugucaugaccgaugggccaucgaacggacaggcuucucacaagauauuuaaaauggaaaagggcaaaguggugaaguccgucgaguuggacgcccccaauuaucauuacgaagaguguucaugcuauccugaugcgggugagaucacauguguuugccgcgacaacuggcacgggaguaauagaccaugggugagcuucaaccagaaucucgaauaccagauuggauauaucugcuccggcguauuuggcgauaacccgaggcccaaugacgggacuggaucuugugguccugugagcucaaacggcgcauacggggucaagggauucaguuuuaaauacggcaaugguguguggauagggcggaccaaguccacaaacagccgcucuggcuucgagaugauuugggauccaaauggauggaccgaaacggacucaaguuuuagcguuaaacaagacaucguggccaucacugauugguccggcuauucugggucguucguccagcaucccgagcugacaggacuggacugcauucgaccuuguuucuggguggaacucaucagagguaggccaaaggagagcaccauuuggacuuccggcucaaguauaucuuuuugcgggguaaacagcgauacaguuggaugguccuggcccgacggcgcugaguuaccguucaccaucgauaaauga

SEQ ID NO: 137030 - RNA, 1350 nt, Artificial Sequence; identical to SEQ ID NO: 137022
  derived and/or modified sequence opt3 from neuraminidase__InfluenzaA__ABE97680

SEQ ID NO: 137031 - RNA, 1350 nt, Artificial Sequence; identical to SEQ ID NO: 137022
  derived and/or modified sequence opt3 from neuraminidase__InfluenzaA__ABE97681

SEQ ID NO: 137032 - RNA, 1350 nt, Artificial Sequence; identical to SEQ ID NO: 137022
  derived and/or modified sequence opt3 from neuraminidase__InfluenzaA__ABE97682

SEQ ID NO: 137033 - RNA, 1350 nt, Artificial Sequence
  derived and/or modified sequence opt3 from neuraminidase__InfluenzaA__ABE97684
augaaccccaaucagaagaucauuaccauaggcagcaucugcauggugacagggauugucucccugaugcuccaaaucggaaacaugauuucuaucuggguuucacacaguauacauacugguaaucagcaccaggccgagccuaucagcaacacgaauuuccuuaccgaaaaagcuguggcauccguaaagcuggccggcaacucuucguuguguccaauuaaugggugggcgguguacucaaaagacaacagcaucagaauuggaaguaagggcgaugucuuugugaucagggagccguucauauccugcucucauuuagaaugucggacauuuuuccugacucagggugcucuacucaaugacaaacacagcaacgggaccguuaaggaucgcucaccccaucgaacacugauguccugcccugugggagaggccccaagucccuauaauagccguuuugaaucugucgcaugguccgccucagcuugucacgacggcaccagcuggcuuacuauuggcaucagugggccugauaacggagcaguggccguacugaaguacaaugguauuaucacagacaccaucaaaucuuggagaaacaauauuuugaggacgcaagaguccgagugcgcuuguguuaacggcagcugcuucacugugaugaccgaugggccaucgaacggacaggccucucacaagauauuuaaaauggaaaagggcaaagucgugaaguccguggagcucgacgcgcccaauuaucauuacgaagaguguucaugcuauccugaugccggugagaucacaugugucugccgggacaacuggcacgggaguaaucgcccauggguuagcuucaaccagaaucuggaauaccagauuggauauaucugcuccggcguguuuggcgauaacccgagacccaaugacgggacuggaucuugugguccuguaagcucaaacggcgcauacggggugaagggauucaguuuuaaauacggcaauggugucuggauagggaggaccaaguccacaaacagccggucuggcuucgagaugauuugggauccaaauggauggaccgaaacggacucaaguuuuagcgugaaacaagacaucguugcuaucacugauugguccggcuauucugggucguucgugcagcaucccgagcugacaggacucgacugcauucgcccuuguuucugggucgaauuaauccgagguagaccaaaggagagcaccauuuggacuuccggcucaaguauaucuuuuugcggggugaacagcggaacaguaggcugguccuggcccgauggugccgagcugccguucaccaucgacaaauga

SEQ ID NO: 137034 - RNA, 1350 nt, Artificial Sequence
  derived and/or modified sequence opt3 from neuraminidase__InfluenzaA__ABE97685
augaaccccaaucagaagaucauuaccauaggcagcaucugcauggugacagggauugucucccugaugcuccaaaucggaaacaugauuucuaucuggguuucacacaguauacauacugguaaucagcaccaggccgagccuaucagcaacacgaauuuccuuaccgaaaaagcuguggcauccguaaagcuggccggcaacucuucguuguguccaauuaaugggugggcgguguacucaaaagacaacagcaucagaauuggaaguaagggcgaugucuuugugaucagggagccguucauauccugcucucauuuagaaugucggacauuuuuccugacucagggugcucuacucaaugacaaacacagcaacgggaccguuaaggaucgcucaccccaucgaacacugauguccugcccugugggagaggccccaagucccuauaauagccguuuugaaucugucgcaugguccgccucagcuugucacgacggcaccagcuggcuuacuauuggcaucagugggccugauaacggagcaguggccguacugaaguacaaugguauuaucacagacaccaucaaaucuuggagaaacaauauuuugaggacgcaagaguccgagugcgcuuguguuaacggcagcugcuucacugugaugaccgaugggccaucgaacggacaggccucucacaagauauuuaaaauggaaaagggcaaagucgugaaguccguggagcucgacgcgcccaauuaucauuacgaagaguguucaugcuauccugaugccggugagaucacaugugucugccgggacaacuggcacgggaguaaucgcccauggguuagcuucaaccagaaucuggaauaccagauuggauauaucugcuccggcguguuuggcgauaacccgagacccaaugacgggacuggaucuugugguccuguaagcucaaacggcgcauacggggugaagggauucaguuuuaaauacggcaauggugucuggauagggaggaccaaguccacaaacagccggucuggcuucgagaugauuugggauccaaauggauggaccgaaacggacucaaguuuuagcgugaaacaagacaucguugcuaucacugauugguccggcuauucugggucguucgugcagcaucccgagcugacaggacucgacugcauucgcccuuguuucugggucgaauuaauccgagguagaccaaaggagagcaccauuuggacuuccggcucaaguauaucuuuuugcggggugaacagcgauacaggaggcugguccuggcccgacggugccgagcugccguucaccaucgauaaauga

SEQ ID NO: 137035 - RNA, 1350 nt, Artificial Sequence; identical to SEQ ID NO: 137024
  derived and/or modified sequence opt3 from neuraminidase__InfluenzaA__ABE97686

SEQ ID NO: 137036 - RNA, 1350 nt, Artificial Sequence
  derived and/or modified sequence opt3 from neuraminidase__InfluenzaA__ABE97687
augaaccccaaucagaagaucauuaccauaggcagcaucugcauggugacagggauugucucccugaugcuccaaguuggaaacaugaucucuauuugggugucacacaguauccauacugguaaucagcaccaggccgagccuauaagcaacacgaauuuccuuaccgaaaaagcuguagcauccgugaagcuggccggcaacucuucguuguguccaaucaaugggugggcggucuacucaaaagacaacagcauuagaaucggaaguaagggcgauguguuuguuauuagggagccguucaucuccugcucucauuuagaaugucggacauuuuuccugacucagggugcucuacucaaugacaaacacagcaacgggaccgugaaggaucgcucaccccaucgaacacugauguccugcccugucggagaggccccaagucccuauaauagccguuuugaaucuguggcaugguccgccucagcuugucacgacggcaccagcuggcuuacuauaggcauuagugggccugauaacggagcaguagccguucugaaguacaaugguaucauuacagacaccaucaaaucuuggagaaacaauaucuugaggacgcaagaguccgagugcgcuugugugaacggcagcugcuucacugucaugaccgaugggccaucgaacggacaggccucucacaagauuuuuaaaauggaaaagggcaaaguggugaaguccgucgagcucgacgcgcccaauuaucauuacgaagaguguucaugcuauccugaugccggugagauaacauguguuugccgggacaacuggcacgggaguaaucgcccaugggugagcuucaaccagaaucuggaauaccagaucggauauauuugcuccggcguauuuggcgauaacccgagacccaaugacgggacuggaucuugugguccugugagcucaaacggcgcauacggggucaagggauucaguuuuaaauacggcaaugguguguggaucgggaggaccaaguccacaaacagccggucuggcuucgagaugauaugggauccaaauggauggaccgaaacggacucaaguuuuagcguuaaacaagacauuguggcuaucacugauugguccggcuauucugggucguucguccagcaucccgagcugacaggacucgacugcauccgcccuuguuucuggguggaauuaauucgagguagaccaaaggagagcaccaucuggacuuccggcucaaguauuucuuuuugcgggguaaacagcgauacaguuggaugguccuggcccgacggcgccgagcugccguucaccauagauaaauga

SEQ ID NO: 137037 - RNA, 1350 nt, Artificial Sequence
  derived and/or modified sequence opt3 from neuraminidase__InfluenzaA__ABE97688
augaaccccaaucagaagaucauuaccauaggcagcaucugcauggugacagggauugucucccugaugcuccaaguuggaaacaugaucucuauuugggugucacacaguauccauacugguaaucagcaccaggccgagccuauaagcaacacgaauuuccuuaccgaaaaagcuguagcauccgugaagcuggccggcaacucuucguuguguccaaucaaugggugggcggucuacucaaaagacaacagcauuagaaucggaaguaagggcgauguguuuguuauuagggagccguucaucuccugcucucauuuagaaugucggacauuuuuccugacucagggugcucuacucaaugacaaacacagcaacgggaccgugaaggaucgcucaccccaucgaacacugauguccugcccugucggagaggccccaagucccuauaauagccguuuugaaucuguggcaugguccgccucagcuugucacgacggcaccagcuggcuuacuauaggcauuagugggccugauaacggagcaguagccguucugaaguacaaugguaucauuacagacaccaucaaaucuuggagaaacaauaucuugaggacgcaagaguccgagugcgcuugugugaacggcagcugcuucacugucaugaccgaugggccaucgaacggacaggccucucacaagauuuuuaaaauggaaaagggcaaagugauaaaguccguggagcucgacgcgcccaauuaucauuacgaagaguguucaugcuauccugaugccggugagaucacaugugucugccgggacaacuggcacgggaguaaucgcccauggguuagcuucaaccagaaucuggaauaccagauuggauauaucugcuccggcguguuuggcgauaacccgagacccaaugacgggacuggaucuugugguccuguaagcucaaacggcgcauacggggugaagggauucaguuuuaaauacggcaauggugucuggguggggaggaccaaguccacaaacagccggucuggcuucgagaugauaugggauccaaauggauggaccgaaacggacucaaguuuuagcguuaaacaagacauuguggcuaucacugauugguccggcuauucugggucguucguccagcaucccgagcugacaggacucgacugcauccgcccuuguuucuggguggaauuaauucgagguagaccaaaggagagcaccaucuggacuuccggcucaaguauuucuuuuugcgggguaaacagcgauacaguuggaugguccuggcccgacggcgccgagcugccguucauaaucgauaaauga

SEQ ID NO: 137038 - RNA, 1350 nt, Artificial Sequence
  derived and/or modified sequence opt3 from neuraminidase__InfluenzaA__ABE97690
augaaccccaaucagaagaucauuaccauaggcagcaucugcauggugacagggauugucucccugaugcuccaaguuggaaacaugaucucuauuugggugucacacaguauccauacugguaaucagcaccaggccgagccuauaagcaacacgaauuuccuuaccgaaaaagcuguagcauccgugaagcuggccggcaacucuucguuguguccaaucaaugggugggcggucuacucaaaagacaacagcauuagaaucggaaguaagggcgauguguuuguuauuagggagccguucaucuccugcucucauuuagaaugucggacauuuuuccugacucagggugcucuacucaaugacaaacacagcaacgggaccgugaaggaucgcucaccccaucgaucccugaugaguugcccugucggagaggccccaagccccuauaauucucguuuugaauccguggcauggucagccagcgcuugucacgacggcacaaguuggcuuaccauaggcauuucugggccugauaacggagcaguagccguucugaaguacaaugguaucauuacugacacaaucaaauccuggagaaacaauaucuugaggacccaagagagcgagugcgcuugugugaacggcucgugcuucacggucaugacugaugggccaucuaacggacaggccucccacaagauuuuuaaaaugaagaaaggcaagguggugaagucagucgaacucgacgcgcccaauuaucauuacgaggaauguaguugcuauccugaugccggugagauaaccuguguuugccgggacaacuggcacgggagcaaucgcccauggguguccuucaaccagaaucuggaguaccagaucggauauauuugcucuggcguauuuggcgauaacccgagacccaaugacgggacaggaagcugugguccugugucaaguaacggcgcauacggggucaaaggauucuccuuuaaguacggcaaugguguguggaucgggaggacuaaaagcaccaacucucggucaggcuucgaaaugauaugggauccaaauggauggacagagaccgacaguagcuuuuccguuaagcaagacauuguggcuaucacggauuggucuggcuauucggggagcuucguccagcaucccgaacugacuggacucgacugcauccgcccuuguuucuggguggaguuaauucgagguagaccaaaagaauccacaaucuggaccucaggcaguucuauuagcuuuugcgggguaaacuccgauacuguuggauggucauggcccgacggcgccgagcugccguucacaauagauaaguga

SEQ ID NO: 137039 - RNA, 1350 nt, Artificial Sequence
  derived and/or modified sequence opt3 from neuraminidase__InfluenzaA__ABE97691
augaaccccaaucagaagaucauuaccauaggcagcaucugcauggugacagggauugucucccugaugcuccaaguuggaaacaugaucucuauuugggugucacacaguauccauacugguaaucagcaccaggccgagccuauaagcaacacgaauuuccuuaccgaaaaagcuguagcauccgugaagcuggccggcaacucuucguuguguccaaucaaugggugggcggucuacucaaaagacaacagcauuagaaucggaaguaagggcgauguguuuguuaaaagggagccgugcauuuccuguucucauuuaaagugccggacauucuuucugacucagggugcucuacucaaugacaagcacagcaacgggaccgugaaagaucgcucaccccaucgaacacugauguccuguccugucggagaagccccaagucccuauaauagccguuucgagucuguggcaugguccgccucagcuugccacgacggcaccagcuggcuuacuaucggcauaagugggccugauaacggagcaguagccguucugaaguacaaugguauuaucacagacaccauuaaaucuuggagaaacaauaucuugaggacgcaagaauccgagugugcuugcgugaacggcagcuguuuuacugucaugaccgaugggccaucgaacggacaggccucucacaagaucuucaaaauggagaagggcaagguggugaaauccgucgaacucgacgcgcccaauuaucauuacgaggaaugcucauguuauccugaugccggugagauuacaugcguuugccgggacaacuggcacgggaguaaucgcccaugggugagcuuuaaccagaaucuggaguaccagauaggauauaucuguuccggcguauucggcgauaacccgagacccaaugacgggacuggaucuugcgguccugugagcucaaacggcgcauacggggucaagggauuuaguuucaaauacggcaaugguguguggauugggaggaccaaguccacaaacagccggucuggcuuugaaaugaucugggauccaaauggauggaccgagacggacucaaguuucagcguuaaacaagacauaguggcuauuacugauugguccggcuauucugggucguuuguccagcaucccgaacugacaggacucgacuguauccgcccuugcuucuggguggaguuaauccgagguagaccaaaggaaagcaccauuuggacuuccggcucaaguaucucuuucugugggguaaacagcgauacaguuggaugguccuggcccgacggcgccgagcugccguuuaccauugauaaauga

SEQ ID NO: 137040 - RNA, 1350 nt, Artificial Sequence
  derived and/or modified sequence opt3 from neuraminidase__InfluenzaA__ABE97694
augaaccccaaucagaagaucaugaccauuggcagcauaugcauggugacagggaucgucucccugaugcuccaaguuggaaacaugauuucuaucugggugucacacaguauucauacugguaaucagcaccaggccgagccuaucagcaacacgaauuuccuuaccgaaaaagcuguagacuccgugaagcuggcaggcaacucuucguuguguccaauaaaugggugggccgucuacucaaaagauaacagcaucagaauuggaaguaagggcgacguguuuguuaucagggagccguccgugucuugcagccauuuagaaugucggacauucuuucugacucagggugcgcuacucaaugauaaacacuccaacgggaccgucaaggaccgcucaccccaucgaacacugaugaguugcccugugggagaggcuccaagccccuauaauucucguuucgaauccguagccuggucagcaagcgccugucacgauggcaccaguuggcuuacuauuggcaucucugggccugacaacggagcuguugcagugcugaaguacaaugguauaauuacagauaccaucaaauccuggagaaacaauauuuugaggacgcaagagagcgagugcgccugugucaacggcucgugcuuuacugugaugaccgacgggccaucuaacggacaggcuucccacaagaucuucaaaauggaaaagggcaaaguggucaagucaguugagcucgaugcccccaauuaucauuacgaagaguguaguugcuauccugacgcgggugagaucacaugugugugccgggauaacuggcacgggagcaaucgcccauggguauccuuuaaccagaaucuggaauaccagauuggauauauaugcucuggcguguucggcgacaacccgagacccaaugaugggacuggaagcugugguccugucucaaguaacggcgcauacggggugaagggauuuuccuucaaauacggcaaugguguuuggaucgggaggaccaagagcacaaacucucggucaggcuuugagaugauuugggacccaaauggauggaccgaaacggacaguagcuucuccgugaaacaagaugucguggccaucacugacuggucuggcuauucggggagcuuuguacagcaucccgagcugacaggacucgauugcauacgcccuuguuucuggguugaauuaauucgagguagaccaaaggaguccaccaucuggacuucaggcaguucuaucagcuucugcggggugaacuccgacacagucggauggucauggcccgauggcgcugagcugccguuuaccauugacaaauga

SEQ ID NO: 137041 - RNA, 1350 nt, Artificial Sequence
  derived and/or modified sequence opt3 from neuraminidase__InfluenzaA__ABE97696
augaaccccaaucagaagaucauuaccauaggcagcaucugcauggugacagggauugucucccugaugcuccaaguuggaaacaugaucucuauuugggugucacacaguauccauacugguaaucagcaccaggccgagccuauaagcaacacgaauuuccuuaccgaaaaagcuguagcauccgugaagcuggccggcaacucuucguuguguccaaucaaugggugggcggucuacucaaaagacaacagcauuagaaucggaaguaagggcgauguguuuguuauuagggagccguucaucuccugcucucauuuagaaugucggacauuuuuccugacucagggugcucuacucaaugacaaacacagcaacggguccgugaaggaucgcucaccccaucgaacccugaugaguugcagcgucggagaggccccuucuccauauaauucccguuuugaaucaguggcauggagcgccagugcuugucacgacggcacaucuuggcuuaccauaggcauuuccgggcccgauaacggagcaguagccguucugaaguacaaugguaucauuacugacacaaucaaaagcuggagaaacaauaucuugaggacccaagagucggagugcgcuugugugaacggcucuugcuucacggucaugacugaugggccuuccaacggacaggccucacacaagauuuuuaaaauggaaaagggcaaaguggugaagagugucgagcucgacgcgccaaauuaucauuacgaagaguguagcugcuaucccgaugccggugagauaaccuguguuugccgggacaacuggcacggguccaaucgcccuugggugucuuucaaccagaaucuggaauaccagaucggauauauuugcagcggcguauuuggcgauaacccaagaccgaaugacgggacaggaucauguggucccgugaguuccaacggcgcauacggggucaagggauucagcuuuaaauacggcaaugguguguggaucgggaggacuaagucuaccaacucacggaguggcuucgagaugauaugggauccuaauggauggacagaaaccgacagcuccuuuucuguuaaacaagacauuguggcuaucacggauuggucgggcuauagcggguccuucguccagcauccagagcugacuggacucgacugcauccgccccuguuucuggguggaauuaauucgagguagaccuaaggagucaacaaucuggaccaguggcucuagcauuuccuuuugcgggguaaacucagauacuguuggauggagcuggccagacggcgccgagcugcccuucacaauagauaaauga

SEQ ID NO: 137042 - RNA, 1350 nt, Artificial Sequence
  derived and/or modified sequence opt3 from neuraminidase__InfluenzaA__ABE97697
augaaccccaaucagaagaucauuaccauaggcagcaucugcauggugacagggauugucucccugaugcuccaaguuggaaacaugaucucuauuugggugucacacaguauccauacugguaaucagcaccaggccgagccuauaagcaacacgaauuuccuuaacgaaaaagcuguagcauccgugaagcuggccggcaauucuucguuguguccaaucaacgggugggcggucuacucaaaagacaauagcauuagaaucggaaguaagggcgauguguuuguuauuagggagccguucaucuccugcucucauuuagaaugucggaccuuuuuccugacacagggugcucuacucaacgacaaacacagcaaugggacugugaaggaucgcucaccccaucgaacccugauguccugcccugucggagaggccccaagucccuauaacagccguuuugaaucuguggcaugguccgccucagcuugucacgacggcacaagcuggcuuaccauaggcauuagugggccugauaauggagcaguagccguucugaaguacaacgguaucauuacugacacaaucaaaucuuggagaaauaacaucuugaggacccaagaguccgagugcgcuugugugaacggcagcugcuucacggucaugacugaugggccaucgaauggacaggccucucacaagauuuuuaaaauggaaaagggcaaaguggugaaguccgucgagcucgacgcgcccaacuaucauuacgaagaguguucaugcuauccugaugccggugagauaaccuguguuugccgggacaauuggcacgggaguaaccgcccaugggugagcuucaaucagaaccuggaauaccagaucggauauauuugcuccggcguauuuggcgauaauccgagacccaacgacgagacagggucuuguggaccugugagcucaaauggugcauacggcgucaagggguucaguuuuaaauacggaaacggcguguggaucgguaggacuaaguccaccaauagccggucuggguucgaaaugauaugggauccaaacggcuggacagagaccgacucaaguuuuagcguuaaacaagacauuguggcuaucacggauugguccggauauucuggcucguucguccagcaucccgaacugacugggcucgacugcauccgcccuuguuucuggguggaguuaauucgaggaagaccaaaggagagcacaaucuggaccuccgguucaaguauuucuuuuugcggcguaaauagcgauacuguugggugguccuggcccgacggagccgaacugccguucacaauagauaaauga

SEQ ID NO: 137043 - RNA, 1350 nt, Artificial Sequence
  derived and/or modified sequence opt3 from neuraminidase__InfluenzaA__ABE97702
augaaccccaaucagaagaucauuaccauaggcagcaucugcauggugacagggauugucucccugaugcuccaaguuggaaacaugaucucuauuugggugucacacaguauccauacugguaaucagcaccaggccgagccuauaagcaacacgaauuuccuuaccgaaaaagcuguagcauccgugaagcuggccggcaacucuucguuguguccaaucaaugggugggcggucuacucaaaagacaacagcauuagaaucggaaguaagggcgauguguuuguuauuagggagccguucaucuccugcucucauuuagaaugucggacauuuuuccugacucagggugcucuacucaaugacaaacacagcaacgggaccgugaaggaucgcucaccccaucgaacacugauguccugcccugucggagaggccccaagucccuauaauagccguuuugaaucuguggcaugguccgccucagcuugucacgacggcaccagcuggcuuacuauaggcauuagugggccugauaacggagcaguagccguucugaaguacaaugguaucauuacagacaccaucaaaucuuggagaaacaauaucuugaggacgcaagaguccgagugcgcuugugugaacggcagcugcuucacugucaugaccgaugggccaucgaacggacaggccucucacaagauuuuuaaaauggaaaagggcaaaguggugaaguccgucgagcucgacgcgcccuauuaccauuaugaagaguguucaugcuacccugaugccggugagauaacauguguuugccgggacaauuggcacgggaguaaccgcccaugggugagcuucaaucagaaccuggaauaucagaucggauacauuugcuccggcguauuuggcgauaauccgagacccaacgacgggacuggaucuugugguccugugagcucaaauggcgcauacggggucaagggauucaguuuuaaauauggcaacgguguguggaucgggaggaccaaguccacaaauagccggucuggcuucgagaugauaugggauccaaacggauggaccgaaacggacucaaguuuuagcguuaaacaagacauuguguccaucacugauuggucuggcuacucggggagcuucguccagcaucccgagcugacaggacucgacugcauccgcccuuguuucuggguggaauuaauucgagguagaccaaaggaguccaccaucuggacuucaggcaguucuauuagcuuuugcgggguaaauuccgauacaguuggauggucauggcccgacggcgcugagcugccguucaccacggauaaauga

SEQ ID NO: 137044 - RNA, 1350 nt, Artificial Sequence; identical to SEQ ID NO: 137036
  derived and/or modified sequence opt3 from neuraminidase__InfluenzaA__ABE97703

SEQ ID NO: 137045 - RNA, 1350 nt, Artificial Sequence; identical to SEQ ID NO: 137036
  derived and/or modified sequence opt3 from neuraminidase__InfluenzaA__ABE97705

SEQ ID NO: 137046 - RNA, 1350 nt, Artificial Sequence
  derived and/or modified sequence opt3 from neuraminidase__InfluenzaA__ABE97706
augaaccccaaucagaagaucauuaccauaggcagcaucugcauggugacagggauugucucccugaugcuccaaguuggaaacaugaucucucuuugggugucacacaguauucauacugguaaucagcaccaggccgagccuaucagcaacacgaauuuccugaccgaaagagcuguagcauccgugaaauuggccggcaacucuucguuauguccaauaaaugggugggcggucuacucaaaggacaacagcaucaggauuggaaguaaaggcgauguguuuguuauccgggagccguucauuuccugcucucaucuggaaugucgcacauuuuuccuaacucagggugcucuccugaaugacaagcacagcaacgggaccgugaaagaucgaucaccccaucguacacuuauguccugcccugucggagaggccccaagucccuauaauagcagauuugaaucuguggcaugguccgccucagcuugucacgacggcaccagcuggcugacuaucggcauaagugggccugauaacggagcaguagccguuuugaaguacaaugguauuaucacagacaccauuaagucuuggaggaacaauauccuccggacgcaagaguccgagugcgcuugugugaacggcagcugcuucacugucaugaccgaugggccaucgaacggacaggccucucacaaaaucuuuaagauggaaaaaggcaagguggugaaauccgucgagcuggacgcgcccaauuaucauuacgaagaguguucaugcuauccugaugccggugagauuacauguguuugccgcgacaacuggcacgggaguaauagaccaugggugagcuucaaccagaaucuggaauaccagauaggauauaucugcuccggcguauuuggcgauaacccgaggcccaaugacgggacuggaucuugugguccugugagcucaaacggcgcauacggggucaagggauucaguuuuaaguacggcaaugguguguggauugggcggaccaaauccacaagcucucgcucaggcuucgagaugaucugggauccaaacggauggaccgaaacggacaguagcuuuuccguuaagcaagacauaguggcuauuacugauuggucuggcuauucggggagcuucguccagcaucccgagcucacaggauuagacugcauccgaccuuguuucuggguggaacugaucagagguaggccaaaagaguccaccauuugggccucaggcaguucuaucagcuuuugcgggguaaauuccgauacuguuggauggucauggcccgacggcgcagagcuuccguucacaauugauaaguga

SEQ ID NO: 137047 - RNA, 1350 nt, Artificial Sequence
  derived and/or modified sequence opt3 from neuraminidase__InfluenzaA__ABE97707
augaaccccaaucagaagaucauuaccauaggcagcaucugcauggugacagggauugucucccugaugcuccaaguuggaaacaugaucucuauuugggugucacacaguauccauacugguaaucagcaccaggccgagccuauaagcaacacgaauuuccuuaccgaaaaagcuguagcauccgugaagcuggccggcaacucuucguuguguccaaucaaagggugggcggucuacucaaaggacaauagcauuagaaucggaaguaaaggcgauguguuuguuauuagggagccguucaucuccugcucucauuuagaaugucggacauuuuuccugacucagggugcucuacucaacgacaagcacagcaaugggaccgugaaggaucgcucaccccaucgaacacugauguccugcccugucggagaggccccaagucccuauaacagccguuuugaaucuguggcaugguccgccucagcuugucacgacggcaccagcuggcuuacuauaggcauuagugggccugauaauggagcaguagccguucugaaauacaacgguaucauuacagacaccaucaagucuuggagaaauaacaucuugaggacgcaagaguccgagugcgcuugugugaauggcagcugcuucacugucaugaccgaugggccaucgaacggacaggccucucacaaaauuuuuaagauggaaaaaggcaagguggugaaguccgucgagcucgacgcgcccaacuaucauuacgaagaguguucaugcuauccugaugccggugagauaacauguguuugccgggacaauuggcacgggaguaaccgcccaugggugagcuucaaucagaaccuggaauaccagaucggauauauuugcuccggcguauuuggcgauaauccgagacccaacgacgggacuggaucuugugguccugugagcucaaauggcgcauacggggucaaaggauucaguuuuaaguacggcaacgguguguggaucgggaggaccaaauccacaaauagccggucuggcuucgagaugauaugggauccaaacggauggaccgaaacggacucaaguuuuagcguuaagcaagacauuguggcuaucacugauugguccggcuauucugggucguucguccagcaucccgagcugacaggacucgacugcauccgcccuuguuucuggguggaauuaauucgagguagaccaaaagagagcaccaucuggacuuccggcucaaguauuucuuuuugcgggguaaauagcgauacaguuggaugguccuggcccgacggcgccgagcugccguucaccauagauaaguga

SEQ ID NO: 137048 - RNA, 1350 nt, Artificial Sequence
  derived and/or modified sequence opt3 from neuraminidase__InfluenzaA__ABE97708
augaaccccaaucagaagaucauuaccauaggcagcaucugcauggugacagggauugucucccugaugcuccaaguuggaaacaugaucucuauuugggugucacacaguauccauacugguaaucagcaccaggccgagccuauaagcaacacgaauuuccuuaccgaaaaagcuguagcauccgugaagcuggccggcaacucuucguuguguccaaucaaugggugggcggucuacucaaaagacaacagcauuagaaucggaaguaagggcgauguguuuguuauuagggagccguucaucuccugcucucauuuagaaugucggacauuuuuccugacucacggugcucuacucaaugacaaacauagcaacgggaccgugaaggaucgcucaccccaccgaacacugauguccugcccugucggagaggccccaagucccuauaauagccguuuugaaucuguggcaugguccgccucagcuugucacgacggcaccagcuggcuuacuauaggcauuagugggccugauaacggagcaguagccguucugaaguacaaugguaucauuacagacaccaucaaaucuuggagaaacaauaucuugaggacgcaggaguccgagugcgcuugugugaacggcagcugcuucacugucaugaccgaugggccaucgaacggacaagccucucauaagauuuuuaaaaugaagaaaggcaagguggugaaguccgucgaacucgacgcgcccaauuaucacuacgaggaauguucaugcuauccugaugccggugagauaacauguguuugccgggacaacuggcaugggaguaaucgcccaugggugagcuucaaccagaaucuggaguaccagaucggauauauuugcuccggcguauuuggcgauaacccgagacccaaugacgggacuggaucuugugguccugugagcucaaacggcgcauacggggucaaaggauucaguuuuaaguacggcaaugguguguggaucgggaggaccaaauccacaaacagccggucuggcuucgaaaugauaugggauccaaauggauggaccgagacggacucaaguuuuagcguuaagcaggacauuguggcuaucacugauugguccggcuauucugggucguucguccaacaccccgaacugacaggacucgacugcauccgcccuuguuucuggguggaguuaauucgagguagaccaaaagaaagcaccaucuggacuuccggcucaaguauuucuuuuugcgggguaaacagcgauacaguuggaugguccuggcccgacggcgccgagcugccguucaccauagauaaguga

SEQ ID NO: 137049 - RNA, 1350 nt, Artificial Sequence
  derived and/or modified sequence opt3 from neuraminidase__InfluenzaA__ABE97710
augaaccccaaucagaagaucauuaccauaggcagcaucugcauggugacagggauugucucccugaugcuccaaguuggaaacaugaucucuauuugggugucacacaguauccauacugguaaucagcaccaggccgagccuauaagcaacacgaauuuccuuaccgaaaaagcuguagcauccgugaagcuggccggcaacucuucguuguguccaaucaaugggugggcggucuacucaaaagacaacagcauuagaaucggaaguaagggcgauguguuuguuauuagggagccguucaucuccugcucucauuuagaaugucggacauuuuuccugacucagggugcucuacucaaugacaaacacagcaacgggaccgugaaggaucgcucaccccaucgaacacugauguccugcccugucggagaggccccaagucccuauaauagccguuuugaaucuguggcaugguccgccucagcuugucacgacggcaccagcuggcuuacuauaggcauuagugggccugauaacggagcaguagccguucugaaguacaaugguaucauuacagacaccaucaaaucuuggagaaacaauaucuugaggacgcaagaguccgagugcgcuugugugaacggcagcugcuucacugucaugaccgaugggccaucgaacggacaggccucucacaagauuuuuaaaauggaaaagggcaaaguggugaaguccgucgagcucaaugcgcccaacuaucauuacgaagaguguucaugcuauccugacgccggugagauaacauguguuugccgggauaauuggcacgggaguaaccgcccaugggugagcuucaaucagaaccuggaauaccagaucggauauauuugcuccggcguauuuggcgacaauccgagacccaacgaugggacuggaucuugugguccugugagcucaaauggcgcauacggggucaagggauucaguuuuaaauacggcaacgguguguggaucgggaggaccaaguccacaaauagccggucuggcuucgagaugauaugggacccaaacggauggaccgaaacggauucaaguuuuagccugaaacaagacauuguugcuaucacugacugguccggcuauucugggucguucgugcagcaucccgagcucacaggauuagauugcauccgcccuuguuucugggucgaacugauucgagguagaccaaaggagagcaccaucuggacuuccggcucaaguauuucuuuuugcggggugaauagcgacacaguaggaugguccuggcccgauggcgccgagcuuccguucaccauagacaaauga

SEQ ID NO: 137050 - RNA, 1350 nt, Artificial Sequence
  derived and/or modified sequence opt3 from neuraminidase__InfluenzaA__ABE97711
augaaccccaaucagaagaucauuaccauaggcagcaucugcauggugacagggauugucucccugaugcuccaaguuggaaacaugaucucuauuugggugucacacaguauccauacugguaaucagcaccaggccgagccuauaagcaacacgaauuuccuuaccgaaaaagcuguagcauccgugaagcuggccggcaacucuucguuguguccaaucaaugggugggcggucuacucaaaagacaacagcauuagaaucggaaguaagggcgauguguuuguuauuagggagccguucaucuccugcucucauuuagaaugucggacauuuuuccugacucagggugcucuacucaaugacaaacacagcaacgggaccgugaaggaucgcucaccccaucgaacacugauguccugcccugucggagaggccccaagucccuauaauagccguuuugaaucuguggcaugguccgccucagcuugucacgacggcaccagcuggcuuacuauaggcauuagugggccugauaacggagcaguagccguucugaaguacaaugguaucauuacagacaccaucaaaucuuggagaaacaauaucuugaggacgcaagaguccgagugcgcuugugugaacggcagcugcuucacugucaugaccgaugggccaucggacggacaggccucucacaagauuuuuaaaauggaaaagggcaaaguggugaaguccgucgagcucgaugcgcccaacuaucauuacgaagaguguucaugcuauccugacgccggugagauaacauguguuugccgggauaauuggcacgggaguaaccgcccaugggugagcuucaaucagaaccuggaauaccagaucggauauauuugcuccggcguauuuggcgacaauccgagacccaacgaugggacuggaucuugugguccugugagcucaaauggcgcauacggggucaagggauucaguuuuaaauacggcaacgguguguggaucgggaggaccaaguccacaaauagccggucuggcuucgagaugguuugggacccaaacggauggaccgaaacggacucaaguuuuagcgugaaacaagauauagucgcuauuacugacugguccggcuauucugggucguucgugcagcaucccgagcugacaggacucgauugcauccgcccuuguuucuggguagaauuaauccgagguagaccaaaggagagcaccauuuggacuuccggcucaaguaucucuuuuugcgggguuaauagcgacacagugggaugguccuggcccgauggcgccgagcugccguucaccauugacaaauga

SEQ ID NO: 137051 - RNA, 1350 nt, Artificial Sequence; identical to SEQ ID NO: 137036
  derived and/or modified sequence opt3 from neuraminidase__InfluenzaA__ABE97712

SEQ ID NO: 137052 - RNA, 1350 nt, Artificial Sequence; identical to SEQ ID NO: 137036
  derived and/or modified sequence opt3 from neuraminidase__InfluenzaA__ABE97713

SEQ ID NO: 137053 - RNA, 1350 nt, Artificial Sequence; identical to SEQ ID NO: 137036
  derived and/or modified sequence opt3 from neuraminidase__InfluenzaA__ABE97715

SEQ ID NO: 137054 - RNA, 1350 nt, Artificial Sequence
  derived and/or modified sequence opt3 from neuraminidase__InfluenzaA__ABE97717
augaaccccaaucagaagaucauuaccauaggcagcaucugcauggugacagggauugucaaccugaugcuccaaguuggaaauaugaucuccauuugggugucucacucaauccauacugguaaccagcaccaggccgagccuauaaguaauacgaacuuccuuaccgaaaaagcuguagcaagcgugaagcuggccggcaauuccucuuuguguccaaucaacgggugggcggucuacucgaaagacaauucaauuagaaucggaagcaagggcgauguguuuguuauuagggagccguucaucaguugcucccauuuagaaugucggacauuuuuccugacucagggugcucuacucaacgacaaacacucuaaugggaccgugaaggaucgcagcccccaucgaacacugauguccugcccugucggagaggccccaucacccuauaacagucguuuugaaagcguggcauggucugccuccgcuugucacgacggcaccucauggcuuacuauaggcauuagcgggccugauaauggagcaguagccguucugaaguacaacgguaucauuacagacaccaucaaaaguuggagaaauaacaucuugaggacgcaagagucugagugcgcuugugugaacggcuccugcuucacugucaugaccgaugggccaagcaauggacaggccucgcacaagauuuuuaaaauggaaaagggcaaaguggugaagucugucgagcucgacgcgcccaacuaucauuacgaagaguguuccugcuauccugaugccggugagauaacauguguuugccgggacaauuggcacgggucaaaccgcccaugggugaguuucaaucagaaccuggaauaccagaucggauauauuugcagcggcguauuuggcgauaauccgagacccaacgacgggacuggauccugugguccugugccaucuaauggcgcauacggggucaagggauucagcuuuaaauacggcaacgguguguggaucgggaggaccaagucaacaaauagucgguccggcuucgagaugauaugggaucccaacggauggaccgaaacggacagcucuuuuucaguuaaacaagacauuguggcuaucacugauuggaguggcuauagcggguccuucguccagcauccugagcugacaggacucgacugcauccgcccauguuucuggguggaauuaauucgagguagacccaaggagucuaccaucuggacuucgggcagcuccauuucauuuugcgggguaaauagugauacaguuggauggucuuggccggacggcgccgagcugccuuucaccauagauaaauga

SEQ ID NO: 137055 - RNA, 1350 nt, Artificial Sequence
  derived and/or modified sequence opt3 from neuraminidase__InfluenzaA__ABE97718
augaaccccaaucagaagaucauuaccauaggcagcaucugcauggugacagggauugucucccugaugcuccaaguuggaaacaugaucucuauuugggugucacacaguauccauacugguaaucagcaccaggccgagccuauaagcaacacgaauuuccuuaccgaaaaagcuguagcauccgugaagcuggccggcaacucuucguuguguccaaucaaugggugggcggucuacucaaaagacaacagcauuagaaucggaaguaagggcgauguguuuguuauuagggagccguucaucuccugcucucauuuagaaugucggacauuuuuccugacucagggugcucuacucaaugacaaacacagcaacgggaccgugaaggaucgcucaccccaucgaacacugauguccugcccugucggagaggccccaagucccuauaauagccguuuugaaucuguggcaugguccgccucagcuugucacgacggcaccagcuggcuuacuauaggcauuagugggccugauaacggagcaguagccguucugaaguacaaugguaucauuacagacaccaucaaaucuuggagaaacaauaucuugaggacgcaagaguccgagugcgcuugugugaacggcagcugcuucacugucaugaccgaugggccaucgaacggacaggccucucacaagauuuuuaaaauggaaaagggcaaaguggugaaguccgucgagcucgacgcgcccaauuaucauuacgaagaguguucaugcuauccugaugccggugagauaacauguguuugccgggacaacuggcacgggaguaaucgcccaugggugagcuucaaccagaaucuggaauaccagaucggauauauuugcuccggcguauuuggcgauaacccgagacccaaugacgggacuggaucuugugguccugugagcucaaacggcgcauacggggucaagggauucaguuuuaaauacggcaaugguguguggaucgggaggaccaaguccacaaacagccggucuggcuucgagaugauaugggauccaaauggauggaccgaaacggacucaaguuuuagcguuaaacaagacauuguggcuaucacugauugguccggcuauucugggucguucguccagcaucccgagcugacaggacucgacugcauccgcccuuguuucuggguggaauuaauucgagguagaccaaaggagagcaccaucuggacuuccggcucaaguauuucuuuuugcgggguagauagcgacacaguuggaugguccuggcccgauggcgccgagcugccguucaccauagacaaauga

SEQ ID NO: 137056 - RNA, 1350 nt, Artificial Sequence
  derived and/or modified sequence opt3 from neuraminidase__InfluenzaA__ABE97719
augaaccccaaucagaagaucauuaccauaggcagcaucugcauggugacagggauugucucccugaugcuccaaguuggaaacaugaucucuauuugggugucacacaguauccauacugguaaucagcaccaggccgagccuauaagcaacacgaauuuccuuaccgaaaaagcuguagcauccgugaagcuggccggcaacucuucguuguguccaaucaaugggugggcggucuacucaaaagacaacagcauuagaaucggaaguaagggcgauguguuuguuauuagggagccguucaucuccugcucucauuuagaaugucggacauuuuuccugacucagggugcucuacucaaugacaaacacagcaacgggaccgugaaggaucgcucaccccaucgaacacugauguccugcccugucggagaggccccaagucccuauaauagccguuuugaaucuguggcaugguccgccucagcuugucacgacggcaccagcuggcuuacuauaggcauuagugggccugauaacggagcaguagccguucugaaguacaaugguaucauuacagacaccaucaaaucuuggagaaacaauaucuugaggacgcaagaguccgagugcgcuugugugaacggcagcugcuucacugucaugaccgaugggccaucgaacggacaggccucucacaagauuuuuaaaaugaagaaaggcaagguggugaaguccgucgaacucgacgcgcccaauuaucauuacgaggaauguucaugcuauccugaugccggugagauaacauguguuugccgggacaacuggcacgggaguaaucgcccaugggugagcuucaaccagaaucuggaguaccagaucggauauauuugcuccggcguauuuggcgauaacccgagacccaaugacgggacuggaucuugugguccugugagcucaaacggcgcauacggggucaaaggauucaguuuuaaguacggcaaugguguguggaucgggaggaccaaauccacaaacagccggucuggcuucgaaaugauaugggauccaaauggauggaccgagacggacucaaguuuuagcguuaagcaagacauuguggcuaucacugauugguccggcuauucugggucguucguccagcaucccgaacugacaggacucgacugcauccgcccuuguuucuggguggaguuaauucgagguagaccaaaagaaagcaccaucuggacuuccggcucaaguauuucuuuuugcgggguaaacagcgauacaguuggaugguccuggcccgacggcgccgagcugccguucaccauagauaaguga

SEQ ID NO: 137057 - RNA, 1350 nt, Artificial Sequence
  derived and/or modified sequence opt3 from neuraminidase__InfluenzaA__ABE97720
augaaccccaaucagaagaucauuaccauaggcagcaucugcauggugacagggauugucucccugaugcuccaaguuggaaacaugaucucuauuugggugucacacaguauccauacugguaaucagcaccaggccgagccuauaagcaacgcuaauuuccuuacggaaaaagcaguagccuccgugaagcuggcgggcaacucuucguuguguccaaucaaugggugggcugucuacucaaaagacaacagcauuagaaucggaaguaagggcgauguguuuguuauuagggagccguucaucuccugcucucauuuagaaugucggaccuuuuuccugacacagggugcccuacucaaugacaaacacagcaacgggacugugaaggaucgcucaccccaucgaacccugauguccugcccugucggagaggcaccaagucccuauaauagccguuuugaaucuguggccugguccgcuucagcaugucacgacggcacaagcuggcuuaccauaggcauuagugggccugauaacggagccguagcuguucugaaguacaaugguaucauuacugacacaaucaaaucuuggagaaacaauaucuugaggacccaagaguccgagugcgccugugugaacggcagcugcuucacggucaugacugaugggccaucgaacggacaggcgucucacaagauuuuuaaaauggaaaagggcaaaguggugaaguccgucgagcucgacgcacccaauuaucauuacgaagaguguucaugcuauccugaugccggugagauaaccuguguuugccgggacaacuggcacgggaguaaucgcccaugggugagcuucaaccagaaucuggaauaccagaucggauauauuugcuccggcguauuuggcgauacaccgagacccaacgacgggacuggaucuugugguccugugagcucaaauggcgcuuacggggucaagggauucaguuuuaaauacggcaacgguguguggaucgggaggaccaaguccacaaauagccggucuggcuucgagaugauaugggauccaaacggauggaccgaaacggacucaaguuuuagcguuaaacaagacauuguggccaucacugauugguccggcuauucugggucguucguccagcaucccgagcugacaggacucgacugcauccgcccuuguuucuggguggaauuaauucgagguagaccaaaggagagcaccaucuggacuuccggcucaaguauuucuuuuugcgggguaaauagcgauacaguuggaugguccuggcccgacggcgcagagcugccguucaccauagauaaauga

SEQ ID NO: 137058 - RNA, 1410 nt, Artificial Sequence; identical to SEQ ID NO: 136829
  derived and/or modified sequence opt3 from neuraminidase__InfluenzaA__ABF47553

SEQ ID NO: 137059 - RNA, 1413 nt, Artificial Sequence; identical to SEQ ID NO: 136412
  derived and/or modified sequence opt3 from neuraminidase__InfluenzaA__ABF47564

SEQ ID NO: 137060 - RNA, 1413 nt, Artificial Sequence
  derived and/or modified sequence opt3 from neuraminidase__InfluenzaA__ABF47575
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguagcccuugcgggaaauucaagccuguguaguauuuccggcugggcuaucuacacaaaagauaacucuaucaggauugguagcaagggggacguguucgucauacgggagccuuuuaucuccugcucacauuucgagugucgcaccuuuuucuugacucaaggagccuuacugaaugauaaacacaguaacggcacagugaaggaccgaagcccauaucgugcacuaaugucuugcccgcucggcgaagcccccuccccuuacaauucaaaguuugagagcguugcuuggagugcaucugccugucaugaugggaugggauggcugaccauugguaucuccggcccagacaacggggcuguggccguccuuaaauauaacggaauaauuacggaaacuaucaagagcuggaaaaagcagauccugagaacccaggagucggagugcguguguguaaauggcucuugcuucacaauuaugacugauggucccuccaacggggcggcaucauacaaaaucuuuaagauugaaaagggaaaaguuaccaagaguauagaguugaaugccccuaacuuccacuaugaagaguguagcugcuacccagacacaggcaccgugaugugugucugcagggauaauuggcacggcuccaaccggcccugggugucuuuuaaucagaaccucgacuaccaaaucggguauauuugcagcggaguguucggugauaauccucgcccaaaagacggcgaggggucauguaacccggucacgguugauggagcuaauggcgugaaggguuuuaguuacaaauaugggaacggcguauggaucggaagaacuaaguccaauaggcugcggaaaggcuucgaaaugaucugggaccccaacggguggacagacaccgauagcgacuuuucugugaagcaggaugucguggccauuacugacuggucaggauacagugguagcuucguucagcauccugagcugacaggccucgauugcauacgcccauguuucuggguggaauuaguccgagggcugcccaaggagaauaccacgaucuggaccuccggaucuucgauuagcuuuugcggcgugaacuccgacacagcaaacuggucauggccugauggugcugaacuuccauucacuaucgacaaauga

SEQ ID NO: 137061 - RNA, 1413 nt, Artificial Sequence; identical to SEQ ID NO: 136412
  derived and/or modified sequence opt3 from neuraminidase__InfluenzaA__ABF47586

SEQ ID NO: 137062 - RNA, 1410 nt, Artificial Sequence; identical to SEQ ID NO: 136142
  derived and/or modified sequence opt3 from neuraminidase__InfluenzaA__ABF47597

SEQ ID NO: 137063 - RNA, 1413 nt, Artificial Sequence; identical to SEQ ID NO: 136984
  derived and/or modified sequence opt3 from neuraminidase__InfluenzaA__ABF47608

SEQ ID NO: 137064 - RNA, 1410 nt, Artificial Sequence
  derived and/or modified sequence opt3 from neuraminidase__InfluenzaA__ABF47619
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucuggucgcgccgacacuaagauauuauuuaucgaggaaggcaaaauugugcacaucuccccucugucagggagcgcucaacauguggaggaaugcaguuguuauccaagauacccgggagucaggugcguuugucgggauaacuggaagggcucuaaccgccccauaguggacauuaauguaaaggauuacuccaucgugagcucguaugucugcucuggucuugugggggacacaccucggaaaaacgacuccgccucaaguagccacuguuugaauccaaacaaugaggaaggaggccauggcguuaaggggugggcguucgaugacggaaacgauguguggauggguagaaccaucuccgagaaacugaggucuggcuacgagacguuuaaggucauugggggauggagcaaacccaauucaaagcuacagaucaaccgacaggugauuguagaccguggcaaucgcagugguuauuccgggauauucagcguugaaggcaaaucuugcaucaacagauguuuuuacguggagcucauuaggggacggaagcaggaaaccgaggucugguggacaucaaauaguaucguggucuucugcggcacuagcgggaccuauggaacagguuccuggccugauggcgcagacaucaaccugaugccaauuuga

SEQ ID NO: 137065 - RNA, 1413 nt, Artificial Sequence
  derived and/or modified sequence opt3 from neuraminidase__InfluenzaA__ABF47630
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaaccaaacauaugucaauauuaacaauacuaacguuguggcagggaaagacaagaccucgauggcccuugcgggaaauucaagccuguguccuaucaggggcugggcuaucuacacaaaagauaacaguauucggauagguuccaagggggacguauucgugauccgcgagccauuuauuucuugcagccacuuggagugucgaaccuucuuuuuaacucagggagcccugcuaaaugauaaacauuccaacggcacagucaaggaccguucaccguauagagcacucaugaguugcccccugggcgaagccccuagcccauacaauucuagguucgaguccguggcuuggucagcaagcgccugucacgaugggcuuggauggcugaccaucgguauaaguggccccgacaacggggcuguugccguguugaaguauaacggaauuaucacggaaacuaucaaaucuuggaagaaacggauucuccgcacccaggaguccgagugcgucuguaugaauggcagcugcuuuacaaucaugacugaugguccuucgaacggggcggcaucuuacagaauuuucaagauagaaaaaggaagggugaccaaguccaucgagcuggacgccccaaauuaucauuacgaagaguguucaugcuaccccgauacaggcaccguaauguguguuugccgggacaacuggcacggcaguaaucgcccuugggugagcuuuaaccagaaucuggauuaucaaauuggguacaucugcuccggagucuucggugacaacccacgaccgaaggauggcgaggggucuuguaaucccgugacgguggacggagcugacggcgucaaagguuuuagcuauagauacgggaacggcguuuggaucggaaggacuaagucaaaucggcuccguaaaggcuucgaaaugauuugggauccuaacggguggacagacaccgauagugacuuuuccaugaagcaggauauaguggccaugacugacuggagcggauauucugguucauucguacagcacccagaguuaacaggccuggauugcaugcgccccuguuuuuggguggaacuugucagaggguugccuagggagaauaccacgaucuggaccaguggaagcuccauuucuuucugcggcgugaacucggacacagcaaauuggagcuggccagauggugcugaacugcccuucacuaucgacaaauga

SEQ ID NO: 137066 - RNA, 1413 nt, Artificial Sequence
  derived and/or modified sequence opt3 from neuraminidase__InfluenzaA__ABF47652
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaaccaaacauaugugaauauuaacaauacuaacguuguggcagggaaagacaagaccucgaugacacuugccggaaauucaagccuguguccuaucaggggcugggcgaucuacaccaaagauaacaguauucggauagguuccaagggggacguauucgugauccgcgagccauuuauuucuugcagccacuuggagugucgaacuuucuuuuuaacacagggagcucugcuaaaugauaaacauuccaacggcaccgucaaggaccguucaccguauagagcccucaugaguugcccccugggcgaagcaccuagcccauacaauucuagguucgaguccguggccuggucagcuagcgcaugucacgaugggcuuggauggcugacgaucgguauaaguggccccgacaacggggccguugcuguguugaaguauaacggaauuaucacugaaaccaucaaaucuuggaagaaacggauucuccgcacacaggaguccgagugcgucuguaugaauggcagcugcuuuacuaucaugaccgaugguccuucgaacggggccgcgucuuacagaauuuucaagauagaaaaaggaagggugacaaaguccaucgagcuggacgcaccaaauuaucauuacgaagaguguucaugcuaccccaacaccggcacgguaauguguguuugccgggauaauuggcacggcaguaaccgcccuugggugagcuuuaaucagaaccuggacuaucaaauuggguacaucugcuccggagucuucggugauaauccacgaccgaaggacggcgaggggucuuguaaccccgugacuguggauggagccgacggcgucaaagguuuuagcuauagauacgggaauggcguuuggaucggaaggacaaagucaaaccggcuccguaaaggcuucgaaaugauuugggacccuaauggguggaccgauacugacagugauuuuuccaugaagcaggacauaguggcuaugacagauuggagcggauauucugguucauucguacagcacccagaguuaaccggccuggacugcaugcgccccuguuuuuggguggaacuugucagaggguugccuagggagaacacgaccaucuggacaaguggaagcuccauuucuuucugcggcgucaauucggauacugccaacuggagcuggccagacggugcagaacugcccuucaccaucgauaaauga

SEQ ID NO: 137067 - RNA, 1413 nt, Artificial Sequence; identical to SEQ ID NO: 136984
  derived and/or modified sequence opt3 from neuraminidase__InfluenzaA__ABF47663

SEQ ID NO: 137068 - RNA, 1413 nt, Artificial Sequence
  derived and/or modified sequence opt3 from neuraminidase__InfluenzaA__ABF47674
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcauccagagaauaauuacguacgagaacucuaccugggugaaucacacauauguuaacaucaauaacacuaaugugauugcagggaaagacaagaccucgguaacacuugccggaaacucaagccuguguaguaucuccggcugggcgaucuacaccaaagauaauucuauuaggauagguagcaagggggacguguucgucauccgggaaccuuuuauuuccugcucacauuuggagugucgcacuuucuuuuuaacacaaggagcucugcuaaacgauaaacacaguaauggcaccgugaaggaccgaagcccauaucgugcccucaugucuugcccgcugggcgaagcacccuccccuuacaacucaaaguucgagagcguugccuggagugcuucugcaugucaugaugggaugggauggcuuacgaucgguauauccggcccagacaauggggccguggcuguccugaaauauaacggaauuaucacugaaaccaucaagagcuggaaaaagcagauuuugagaacacaggagucggagugcguguguguaaacggcucuugcuuuacuaucaugaccgauggucccuccaauggggccgcgucauacaaaauuuucaagauagaaaagggaaaaguuacaaagaguaucgagcucaacgcaccuaauuuucacuaugaagaguguagcugcuacccagacaccggcacggugaugugugucugcagggauaacuggcacggcuccaaucggcccugggugucuuucaaccagaaucuggacuaccaaauuggguauaucugcagcggaguguuuggugauaacccucgcccaaaagacggcgaggggucauguaauccggucacuguugauggagccaacggcgugaaggguuucaguuacaaauaugggaauggcguauggaucggaagaacaaaguccaacaggcugcggaaaggcuuugaaaugauuugggaccccaauggguggaccgacacugauagcgacuucucugugaagcaggaugucguggcuauaacagacuggucaggauacagugguagcuuuguucagcauccugagcucaccggcuuagauugcauccgcccauguuucuggguggaacugguccgagggcuucccaaggagaacacgaccauuuggacauccggaucuucgaucagcuucugcggcgucaauuccgacacugccaacuggucauggccugauggugcagaauugccauuuaccauugacaaauga

SEQ ID NO: 137069 - RNA, 1413 nt, Artificial Sequence; identical to SEQ ID NO: 136967
  derived and/or modified sequence opt3 from neuraminidase__InfluenzaA__ABF47696

SEQ ID NO: 137070 - RNA, 1413 nt, Artificial Sequence
  derived and/or modified sequence opt3 from neuraminidase__InfluenzaA__ABF47707
augaaccccaaucagaagaucauuaccauaggcagcaucugcauggccauugggaucauuucccugauccuccaaauaggaaacaucauuucuaucugggugucacacaguauucagacagguagccagaaucauacuggcaucuguaaccagagaauaauuacguacgaaaauuccaccugggucaaccaaacauauguuaauaucucuaacacuaaugugguagcugggaaaggaaccacaucgaugacccuugcaggcaacucaagccugugcccuauuagggguugggccaucuacaguaaggacaauuccauccggauugggucuaaaggagauguguucgucauacgcgaaccauuuaucagcuguucccacuuggagugccgaacuuucuuuuuaacacagggcgcgcugcuaaacgacaagcauucaaauggcaccgugaaagaucguaguccguauagagcucucaugagcugucccauuggggaagccccuucuccauacaacuccagguucgagucaguugcauggagcgccagugcuugccacgacggaauggguuggcugacgaucggcauaucugggcccgaugacggagcaguggccguccuuaaguauaauggcauuaucacugaaaccaucaaguccuggcggaaacagauucugcgcacacaggagagcgagugugugugcguaaacgguucguguuuuacuaucaugaccgaugggccuucugacggaccagcuuccuacagaauuuucaagauagaaaaaggcaagaucacaaaaucaauugaguuggaugcccccaacagucauuaugaagagugcagcuguuacccugacaccggcacgguuaugugcgugugcagggauaauuggcacggguccaaccggccaugggucucuuuuaaucaaaaccucgacuaccagaucggauauaucuguagcgguguguucggcgauaauccgcgccccaaggacgggaagggaucaugcgacccugugaacgucgauggcgcggacgguguuaaaggguuuaguuaccgauauggcaauggaguguggauuggcagaacuaaguccaacagcucuaggaaaggguucgagaugauaugggauccaaauggauggacagacaccgauucaaacuuucugguaaagcaggacguggucgcaaugacugauuggagugguuacagcggcuccuucgugcagcaccccgaacugacagggcucgacuguaugcggccuugcuuuuggguugaguuaauccguggacgcccaagagagaaaaccacgauuuggaccucuggcucgagcaucuccuucuguggugucaauucagauacagugaacuggaguuggcccgacggggccgagcugccguucacuauugauaaguga

SEQ ID NO: 137071 - RNA, 1413 nt, Artificial Sequence; identical to SEQ ID NO: 136967
  derived and/or modified sequence opt3 from neuraminidase__InfluenzaA__ABF47718

SEQ ID NO: 137072 - RNA, 1413 nt, Artificial Sequence; identical to SEQ ID NO: 136967
  derived and/or modified sequence opt3 from neuraminidase__InfluenzaA__ABF47729

SEQ ID NO: 137073 - RNA, 1413 nt, Artificial Sequence; identical to SEQ ID NO: 136967
  derived and/or modified sequence opt3 from neuraminidase__InfluenzaA__ABF47740

SEQ ID NO: 137074 - RNA, 1413 nt, Artificial Sequence
  derived and/or modified sequence opt3 from neuraminidase__InfluenzaA__ABF47751
augaaccccaaucagaagaucauuaccauaggcagcaucugcauggccauugggaucauuucccugauccuccaaauaggaaacaucauuucuaucugggugucacacaguauucagacagguagccagaaucauacuggcaucuguaaccagagaauaauuacguacgaaaauuccaccugggucaaccaaacauauguuaauaucaacaauacuaacgugguagcugggaaagacaccacaucugugacccuugcaggaaauucgucacugugcccuauuaggggcugggccaucuacagcaaggauaacaguauccggauugguuccaaaggggacgucuucgugauacgcgaaccauuuaucucuuguagccacuuggagugccgaacuuucuuuuuaacacagggagcgcugcuaaaugauaagcauuccaacggcaccguuaaagaccguucaccguauagagcucucaugaguugucccauuggcgaagccccuagcccauacaauucuagguucgaguccguggcauggucagccagcgcuugccacgaugggaugggauggcugacgaucgguauaaguggccccgacgauggggcagucgccgugcuuaaguauaacggaauuaucacugaaaccaucaagucuuggcggaaacgcauucugagaacacaggaguccgaguguguaugcguuaacggcagcuguuuuacuaucaugaccgacgguccuucgaaugggccagcuucuuacaggauuuucaagauagaaaaaggaaagaucacaaaauccauugaguuggaugcccccaacucacauuaugaagagugcaguuguuacccugacaccggcacggugaugugcgucugccgggauaauuggcacggcagcaaccgcccauggguguccuuuaaucagaaccucgacuaccaaaucggguauaucuguucuggaguguucggugauaauccgcgacccaaggacggcaaggggagcugcgacccugucacuguugauggagcggacggcgugaaagguuuuucauacagauaugggaacggcguauggauuggaaggacaaagaguaauuccagccggaaaggcuucgagaugauaugggauccaaacggguggaccgacacugauucuaauuuucuggugaagcaggacgucguggcaaugacagauuggucaggauacagugguagcuucguucagcaccccgaacugaccggccucgacuguaugcguccuugcuuuuggguggaguuaauccgcgggagaccaagggagaaaacgaccauuuggacauccggaucuucgaucagcuucuguggcgucaacuccgauacugccaauuggucauggcccgacggugcugagcugccguucaccauugauaaguga

SEQ ID NO: 137075 - RNA, 1413 nt, Artificial Sequence
  derived and/or modified sequence opt3 from neuraminidase__InfluenzaA__ABF47773
augaaccccaaucagaagaucauuaccauaggcagcaucugcaugacaauugggaucauuucccugauccuccaaauaggaaacaucauuucuaucugggugucacacaguauucagacugguagccagaaucauacgggcaucuguaaccagagaauaauuaccuacgaaaauuccacaugggucaaccaaacuuauguuaauaucaacaauaccaacgugguagccgggaaagacacaaccucugugacucuugcuggaaauucgucacugugcccuauuaggggcugggcaaucuacagcaaggauaacaguauccggauugguuccaaaggggacgucuucgugauacgcgaaccauuuaucucuuguagccacuuggagugccgaacauucuuuuuaacccagggagcccugcuaaaugauaagcauuccaacggcacgguuaaagaccguucaccguauagagcgcucaugaguugucccauuggcgaagcuccuagcccauacaauucuagguucgaguccguggccuggucagcaagcgccugccacgaugggaugggauggcugacuaucgguauaaguggccccgacgauggggcugucgcagugcuuaaguauaacggaauuaucaccgaaacaaucaagucuuggcggaaacgcauucugagaacucaggaguccgaguguguaugcguuaacggcagcuguuuuaccaucaugacagacgguccuucgaaugggccagccucuuacaggauuuucaagauagaaaaaggaaagaucaccaaauccauugaguuggaugcucccaacucacauuaugaagagugcaguuguuacccugacacgggcacugugaugugcgucugccgggauaauuggcacggcagcaaccgcccauggguguccuuuaaucagaaccucgacuaccaaaucggguauaucuguucuggaguguucggugauaauccgcgacccaaggacggcaaggggagcugcgacccugucacaguugauggagccgacggcgugaaagguuuuucauacagauaugggaacggcguauggauuggaaggaccaagaguaauuccagccggaaaggcuucgagaugauaugggauccaaacggguggacugacacagauucuaauuuucuggugaagcaggacgucguggcgaugaccgauuggucaggauacagugguagcuucguucagcaccccgaacugacgggccucgacuguaugcguccuugcuuuuggguggaguuaauccgcgggagaccaagggagaaaaccacaauuuggacuuccggaucuucgaucagcuucuguggcgucaacuccgauaccgcaaauuggucauggcccgacggugccgagcugccguucacaauugauaaguga

SEQ ID NO: 137076 - RNA, 1413 nt, Artificial Sequence; identical to SEQ ID NO: 137075
  derived and/or modified sequence opt3 from neuraminidase__InfluenzaA__ABF47784

SEQ ID NO: 137077 - RNA, 1413 nt, Artificial Sequence; identical to SEQ ID NO: 137075
  derived and/or modified sequence opt3 from neuraminidase__InfluenzaA__ABF47795

SEQ ID NO: 137078 - RNA, 1413 nt, Artificial Sequence; identical to SEQ ID NO: 137075
  derived and/or modified sequence opt3 from neuraminidase__InfluenzaA__ABF47806

SEQ ID NO: 137079 - RNA, 1413 nt, Artificial Sequence; identical to SEQ ID NO: 137075
  derived and/or modified sequence opt3 from neuraminidase__InfluenzaA__ABF47817

SEQ ID NO: 137080 - RNA, 1413 nt, Artificial Sequence; identical to SEQ ID NO: 137075
  derived and/or modified sequence opt3 from neuraminidase__InfluenzaA__ABF47839

SEQ ID NO: 137081 - RNA, 1413 nt, Artificial Sequence; identical to SEQ ID NO: 137075
  derived and/or modified sequence opt3 from neuraminidase__InfluenzaA__ABF47850

SEQ ID NO: 137082 - RNA, 1413 nt, Artificial Sequence; identical to SEQ ID NO: 136844
  derived and/or modified sequence opt3 from neuraminidase__InfluenzaA__ABF47872

SEQ ID NO: 137083 - RNA, 1413 nt, Artificial Sequence; identical to SEQ ID NO: 136844
  derived and/or modified sequence opt3 from neuraminidase__InfluenzaA__ABF47883

SEQ ID NO: 137084 - RNA, 1413 nt, Artificial Sequence; identical to SEQ ID NO: 136844
  derived and/or modified sequence opt3 from neuraminidase__InfluenzaA__ABF47894

SEQ ID NO: 137085 - RNA, 1410 nt, Artificial Sequence; identical to SEQ ID NO: 136860
  derived and/or modified sequence opt3 from neuraminidase__InfluenzaA__ABF47905

SEQ ID NO: 137086 - RNA, 1362 nt, Artificial Sequence
  derived and/or modified sequence opt3 from neuraminidase__InfluenzaA__ABF47958
augaaccccaaucagaagaucauuaccauaggcagcaucugcaugguggucgggauuaucucccugauucuccaaaucggaaacauaaucucuauuuggaucucacacaguauucagacagguaaucagaaccauacuggcaucuguaaucaggggagcauaacguacaaaguuguggccggacaagacuccaccucuguaauucuuacaggcaacucgucacugugcccuaucagagguugggcuauucacagcaaggauaaugggaucaggaucggaaguaaaggcgacguguucgucauucgggagccauuuauauccuguucucauuuggaaugccgcacuuucuuuuuaacccagggcgcacugcuaaacgauaagcacagccgagggacauucaaagaccguuccccguauagagcccucaugucaugucccgugggagaggcgccuaguccauacaauagcagguuugaaucuguugcuugguccgccucagcaugccaugaugguaugggcuggcugaccaucgggauuagcggacccgacgauggcgccguggcuguccuuaaguauaacgguaucauaacugagacaauuaagaguuggcggaaaaauauccugcgcacccaggaaucugaguguacgugcgugaacggguccuguuucacuaucaugaccgacggaccuagcgauggcuuggcaucguacaagauuuuuaaaaucgagaagggcaaaguaacaaagucuauugaacucaaugccccaaacucccacuaugaggaaugcucauguuaccccgacacugggaagguuaugugcgugugcagagauaauuggcacggaaguaacaggccuugggucagcuucgaccagaaccuggauuauaaaauagguuacaucuguuccggcguguuuggggacaauccacggccgaaggacggaaccggcucuugcggucccgugagcgcugauggggccaacggcgucaaaggauucucauacaaguauggcaaugggguuuggauuggacgcacaaaaagugacuccagccgacaugguuuugagaugaucugggauccuaacggcuggaccgagacggacucuagauucucaaugaggcaagaugugguagcgaugacugaccggaguggguacagcggauccuuugugcagcacccagaacugacaggccucgauuguaugcgucccugcuucugggucgaguuaauccgcggucugccugaagaggacgcaauuuggaccucugggucgauaaucagcuucuguggcguuaauuccgauacuguggacuggucauggccagauggagccgaacuucccuuuacaauugacaaguga

SEQ ID NO: 137087 - RNA, 1350 nt, Artificial Sequence
  derived and/or modified sequence opt3 from neuraminidase__InfluenzaA__ABF56651
augaaccccaaucagaagaucauuaccauaggcagcaucugcauggugacagggauugucucccugaugcuccaaguuggaaacaugaucucuauuugggugucacacaguauccauacugguagccagcaccaggccgagccuauauccaauacgaacuuccuuaccgaaaaagcuguagcaucugugaagcuggccggcaauucgucauuguguccaaucaacgggugggcggucuacagcaaagacaauaguauuagaaucggauccaagggcgauguguuuguuauuagggagccguucaucucuugcagccauuuagaaugucggacauuuuuccugacucagggugcucuacucaacgacaaacacuccaaugggaccgugaaggaucgcucaccccaucgaacacugaugaguugcccugucggagaggccccaagccccuauaacucucguuuugaauccguggcauggucagccagcgcuugucacgacggcaccaguuggcuuacuauaggcauuucugggccugauaauggagcaguagccguucugaaguacaacgguaucauuacagacaccaucaaauccuggagaaauaacaucuugaggacgcaagagagcgagugcgcuugugugaauggcucgugcuucacugucaugaccgaugggccaucuaacggacaggccucccacaagauuuuuaaaauggaaaagggcaaaguggugaagucagucgagcucgacgcgcccaacuaucauuacgaagaguguaguugcuauccugaugccggugagauaacauguguuugccgggacaauuggcacgggagcaaccgcccauggguguccuucaaucagaaccuggaauaccagaucggauauauuugcucuggcguauuuggcgauaauccgagacccaacgacgggacuggaagcugugguccugugucaaguaauggcgcauacggggucaagggauucuccuuuaaauacggcaacgguguguggaucgggaggaccaagagcacaaauucucggucaggcuucgagaugauaugggauccaaacggauggaccgaaacggacaguagcuuuuccguuaaacaagacauuguggcuaucacugauuggucuggcuauucggggagcuucguccagcaucccgagcugacaggacucgacugcauccgcccuuguuucuggguggaauuaauucgagguagaccaaaggaguccaccaucuggacuucaggcaguucuauuagcuuuugcgggguaaauuccgauacaguuggauggucauggcccgacggcgccgagcugccguucaccauagauaaauga

SEQ ID NO: 137088 - RNA, 1410 nt, Artificial Sequence; identical to SEQ ID NO: 136843
  derived and/or modified sequence opt3 from neuraminidase__InfluenzaA__ABF82654

SEQ ID NO: 137089 - RNA, 1413 nt, Artificial Sequence; identical to SEQ ID NO: 136412
  derived and/or modified sequence opt3 from neuraminidase__InfluenzaA__ABF82665

SEQ ID NO: 137090 - RNA, 1413 nt, Artificial Sequence; identical to SEQ ID NO: 136412
  derived and/or modified sequence opt3 from neuraminidase__InfluenzaA__ABF82676

SEQ ID NO: 137091 - RNA, 1413 nt, Artificial Sequence
  derived and/or modified sequence opt3 from neuraminidase__InfluenzaA__ABF82687
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagcagaucuugagaacacaggagucggagugcguguguguaaauggcucuugcuuuacuauuaugaccgauggucccuccaacggggccgcgucauacaaaaucuucaagauugaaaagggaaaaacaaccaagaguauagagcucaaugcaccuaacuuucacuaugaagaguguagcugcuacccagacacgggcacuguuaugugugugugcagggauaauuggcacggcuccaaccggcccugggucucuuucaaucagaaccuggacuaccaaaucggguauauuugcagcggaguguuuggugauaauccucgcccaaaagacggcgaggggucauguaacccggugacagucgauggagccaauggcguuaaggguuucaguuacaaauaugggaacggcguguggaucggaagaaccaaguccaauaggcugcggaaaggcuuugaaaugaucugggaccccaacggguggacugacacagauagcgacuucucuguaaagcaggauguggucgcuauuaccgacuggucaggauacagugguagcuuugugcagcauccugagcucacgggcuuaaauugcauacgcccauguuucuggguugaacuggugcgagggcuucccaaggagaacaccacaaucuggacuuccggaucuucgauuagcuucugcggcgucaacuccgauaccgccaauuggucauggccugacggugcagaauugccauuuacaaucgauaaauga

SEQ ID NO: 137092 - RNA, 1410 nt, Artificial Sequence
  derived and/or modified sequence opt3 from neuraminidase__InfluenzaA__ABF82698
augaaccccaaucagaagaucauuaccauaggcagcgugucccugacaaucacuacgauuugcuuccucaugcaaaucgccauucuugucaucaccguuacacugcacuuuaaacagugugagugcaacucuccuccaaauaaccaggugauguugugugaaccgacuauaaucgagagaaauauuaccgaaaucguauacuuaacaaacaccacuauugagaaggaaaucugccccaaacuggcugaguauaggaauuggucaaagccucaguguaaaauaacaggguucgcaccauuuaguaaggacaacagcauucggcuauccgccggaggugauaucugggugacccgcgagcccuacgucucuugcgacccuggcaaguguuaucaauucgcgcucgggcagggaacgacucugaauaaccgacauucgaaugauaccgugcacgaccguacaccauacagaacucuucugaugaacgaauugggcguucccuuucaucucgguaccaaacaggugugcauugcuuggucaagcaguuccugucacgaugggaaggccuggcugcaugucugcgugacaggacacaaugagaacgcaaccgccucuuucaucuaugacggcaggcugguagauagcaucggcuccuggaguaaaaauauucuccggacgcaggaaagugaguguguuugcauaaacgggacuugcacaguggucaugaccgacggaagcgcuucuggucgcgcagauacuaagaucuuauuuauugaggaaggcaaaaucgugcacauauccccucugucagggagcgcccaacauguggaggaauguaguugcuacccaagauauccgggagucagguguguuugccgggacaacuggaagggcucuaaucgccccauuguggauaucaacguaaaggacuacuccaucgugagcucguacgucuguucuggucuugugggggauacaccucggaaaaaugacuccucaaguagcuccuauugcuuggacccaaacaaugaggaaggaggccacggcguuaaggggugggcuuucgaugacggaaacgauguguggauggguagaaccauuucugagaaacugaggagcggcuacgagacguuuaaggucaucgggggauggucaaaacccaauaguaagcuacagauuaaccgacaggugauaguagacaaaggcaaucguuccgguuauagcgggaucuucucuguugaaggcaagucauguaccaaccgcugcuuuuacguggagcucauuagaggaaggaagcaggaaacagaggucugguggacuucaaauagcaucguggucuucuguggcaccuccgggacauauggaacugguucuuggccugauggcgccgacaucaaccugaugccaauuuga

SEQ ID NO: 137093 - RNA, 1410 nt, Artificial Sequence; identical to SEQ ID NO: 136142
  derived and/or modified sequence opt3 from neuraminidase__InfluenzaA__ABF82709

SEQ ID NO: 137094 - RNA, 1413 nt, Artificial Sequence; identical to SEQ ID NO: 136431
  derived and/or modified sequence opt3 from neuraminidase__InfluenzaA__ABF82822

SEQ ID NO: 137095 - RNA, 1413 nt, Artificial Sequence; identical to SEQ ID NO: 136412
  derived and/or modified sequence opt3 from neuraminidase__InfluenzaA__ABF82833

SEQ ID NO: 137096 - RNA, 1413 nt, Artificial Sequence; identical to SEQ ID NO: 136412
  derived and/or modified sequence opt3 from neuraminidase__InfluenzaA__ABF82844

SEQ ID NO: 137097 - RNA, 1413 nt, Artificial Sequence
  derived and/or modified sequence opt3 from neuraminidase__InfluenzaA__ABF82855
augaaccccaaucagaagaucauuaccauaggcagcaucuccauugccaucgggauuaucucucugaugcuccaaauaggaaacaucauuucaaucugggcuagucacagcauucagaucgguucccagaaucauacaggcgugugcaaccagagaauaauuacuuacgaaaauucuacgugggucaaccacaccuauguuaauaucaacaauacaaacgugauugcagggaaagacaagacuucgguaacccuugccggaaauucaagccuguguaguaucuccggcugggcgaucuacacaaaagauaacucuauuaggauagguagcaagggggacguguucgucauccgggagccuuuuauuuccugcucacauuuggagugucgcaccuucuuuuuaacucaaggagcucugcuaaaugauaaacacaguaacggcacagugaaggaccgaagcccauaucgugcccucaugucuugcccgcugggcgaagcacccuccccuuacaauucaaaguucgagagcguugccuggagugcuucugcaugucaugaugggaugggauggcuuaccaucgguauauccggcccagacaacggggccguggcuguccugaaauauaacggaauuaucacggaaacuaucaagagcuggaaaaagcagauuuugagaacccaggagucggagugcguguguguaaauggcucuugcuuuacaaucaugacugauggucccuccaacggggccgcgucauacaaaauuuucaagauagaaaagggaaaaguuaccaagaguaucgagcucaaugcaccuaacuuucacuaugaagaguguagcugcuacccagacacaggcaccgugaugugugucugcagggauaauuggcacggcuccaaccggcccugggugucuuucaaucagaaccuggacuaccaaauuggguauaucugcagcggaguguuuggugauaauccucgcccaaaagacggcgaggggucauguaacccggucacgguugauggagccaauggcgugaaggguuucaguuacaaauaugggaacggcguauggaucggaagaacuaaguccaauaggcugcggaaaggcuuugaaaugauuugggaccccaacggguggacagacaccgauagcgacuucucugugaagcaggaugucguggcuauaacugacuggucaggauacagugguagcuuuguucagcauccugagcucacaggcuuagauugcauccgcccauguuucuggguggaacugguccgagggcuucccaaggagaauaccacgauuuggaccuccggaucuucgaucagcuucugcggcgugaacuccgacacagccaacuggucauggccugauggugcagaauugccauuuacuauugacaaauga

SEQ ID NO: 137098 - RNA, 1413 nt, Artificial Sequence; identical to SEQ ID NO: 136412
  derived and/or modified sequence opt3 from neuraminidase__InfluenzaA__ABF82866

SEQ ID NO: 137099 - RNA, 1413 nt, Artificial Sequence; identical to SEQ ID NO: 136946
  derived and/or modified sequence opt3 from neuraminidase__InfluenzaA__ABF82888

SEQ ID NO: 137100 - RNA, 1413 nt, Artificial Sequence; identical to SEQ ID NO: 136412
  derived and/or modified sequence opt3 from neuraminidase__InfluenzaA__ABF82910

SEQ ID NO: 137101 - RNA, 1413 nt, Artificial Sequence; identical to SEQ ID NO: 136412
  derived and/or modified sequence opt3 from neuraminidase__InfluenzaA__ABF82921

SEQ ID NO: 137102 - RNA, 1413 nt, Artificial Sequence; identical to SEQ ID NO: 136412
  derived and/or modified sequence opt3 from neuraminidase__InfluenzaA__ABF82932

SEQ ID NO: 137103 - RNA, 1413 nt, Artificial Sequence; identical to SEQ ID NO: 136412
  derived and/or modified sequence opt3 from neuraminidase__InfluenzaA__ABF82943

SEQ ID NO: 137104 - RNA, 1350 nt, Artificial Sequence
  derived and/or modified sequence opt3 from neuraminidase__InfluenzaA__ABG20474
augaaccccaaucagaagaucauuaccauaggcagcaucugcauggugauugggaucgucucccugaugcuccaaauuggaaacaugaucucuauauggguuucacacaguauccagacagguaaucagagacaggccgagccuauuagcaacacuaaauuccuuacggaaaaggcuguggcauccguaacccuggccggcaauucuucguuguguccaaucucagggugggcgguguacagcaaagacaacaguauuaggaucggaucccggggcgaugucuuugugauacgcgagccguucauuucuugcagccauuuagaaugucgaacauuuuuccugacucaaggugcucuacucaaugacaagcacuccaacgggaccguuaaagaucguucacccuauagaacacugaugaguugcccugugggagaggccccaagccccuacaauucuagguuugaauccgucgcauggucagccagcgcuugucaugacggcaccaguuggcuuacuaucggcauuucugggccugauaacggagcaguggccguacugaaguauaaugguaucaucacagacaccauuaaguccuggcggaacaauguuuugcgcacgcaggagagcgagugcgcuugugugaacggcucgugcuucacugucaugaccgaugggccaucuaauggacaggccuccuacaaaauauuuaagauggaaaaaggcaagguggugaaaucagucgagcucgacgcgcccaacuaucacuacgaagaguguaguugcuauccugaugccggugagaucacauguguuugcagagacaacuggcaugggagcaauaggccauggguguccuucaaccagaaucuggaauaccaaauuggauacaucugcucuggcguauuuggcgauaacccgcggcccaaugacgggacuggaagcugugguccugugucaccaaacggcgcauauggggucaagggauucaguuuuaaguacggcaaugguguguggauagggcgcaccaaauccacaaacagccgaucuggcuucgagaugauuugggaucccaauggauggaccggcacggacucaaacuuuaguguuaagcaggacaucguggcuaucacugauuggagcggguauuccggaucuuucguccagcacccugaacugacaggucucgacugcauuagaccauguuucuggguggaguuaaucaggggccggcccaaagaaucgaccauuuggacuagcggguccucaauauuuuucugcggaguaaauagugauacaguuucuuggagcuggccggacggcgccgagcugccuuuuaccaucgauaaguga

SEQ ID NO: 137105 - RNA, 1410 nt, Artificial Sequence; identical to SEQ ID NO: 136142
  derived and/or modified sequence opt3 from neuraminidase__InfluenzaA__ABG26761

SEQ ID NO: 137106 - RNA, 1410 nt, Artificial Sequence
  derived and/or modified sequence opt3 from neuraminidase__InfluenzaA__ABG26772
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucaaggaggguaagauugugcacaucuccccucugucaggcagcgcucaacauguggaagagugcaguuguuauccaagauacccgggggucaggugcguuugucgggacaauuggaaaggaucuaaccgccccauaguggauauuaacguaaaggacuacuccaucgugagcucguaugucugcucuggccuugugggugacacaccucggaaaaaugauuccucaaguagcucccacuguuugaacccaaauaacgaagaagggggacauggcguuaagggcugggccuucgacgaugggaaugacguguggaugggaagaaccaucucugagaaacugaggagcgguuacgagacguuuaaggucauugagggcuggucaaaacccaacaguaagcuacagaucaaucgacaggugauuguagaucgugggaaccgcuccggauauagcggcauauucucuguugaagguaagucaugcaucaauagauguuuuuacguggagcucauuagggggcggaaacaggaaaccgaggucugguggacaaguaacagcaucguggucuucugcggcacuuccggaaccuauggcacagggucuuggccugacggagcggauaucaaucugaugccaauuuga

SEQ ID NO: 137107 - RNA, 1413 nt, Artificial Sequence
  derived and/or modified sequence opt3 from neuraminidase__InfluenzaA__ABG26783
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaaccaaacauaugugaauauuaacaauacuaacguuguggcagggaaagacaagaccucgaugacacuugccggaaauucaagccuguguccuaucaggggcugggcgaucuacaccaaagauaacaguauucggauagguuccaagggggacguauucgugauccgcgagccauuuauuucuugcagccacuuggagugucgaacuuucuuuuuaacacagggagcucugcuaaaugauaaacauuccaacggcaccgucaaggaccguucaccguauagagcccucaugaguugcccccugggcgaagcaccuagcccauacaauucuagguucgaguccguggccuggucagcuagcgcaugucacgaugggcuuggauggcugacgaucgguauaaguggccccgacaacggggccguugcuguguugaaguauaacggaauuaucacugaaaccaucaaaucuuggaagaaacggauucuccgcacacaggaguccgagugcgucuguaugaauggcagcugcuuuacuaucaugaccgaugguccuucgaacggggccgcgucuuacagaauuuucaagauagaaaaaggaagggugacaaaguccaucgagcuggacgcaccaaauuaucauuacgaagaguguucaugcuaccccaacaccggcacgguaauguguguuugccgggauaauuggcacggcaguaaccgcccuugggugagcuuuaaucagaaccuggacuaucaaauuggguacaucugcuccggagucuucggugauaauccacgaccgaaggacggcgaggggucuuguaaccccgugacuguggauggagccgacggcgucaaagguuuuagcuauagauacgggaauggcguuuggaucggaaggacaaagucaaaccggcuccguaaaggcuucgaaaugauuugggacccuaauggguggaccgauacugacagugauuuuuccaugaagcaggacauaguggcuaugacagauuggagcggauauucugguucauucguacagcacccagaguuaaccggccuggacugcauccgccccuguuuuuggguggaacuugucagaggguugccuagggagaacacgaccauuuggacaaguggaagcuccaucucuuucugcggcgucaauucggauacugccaacuggagcuggccagacggugcagaacugcccuucaccauugauaaauga

SEQ ID NO: 137108 - RNA, 1413 nt, Artificial Sequence; identical to SEQ ID NO: 136984
  derived and/or modified sequence opt3 from neuraminidase__InfluenzaA__ABG26794

SEQ ID NO: 137109 - RNA, 1410 nt, Artificial Sequence
  derived and/or modified sequence opt3 from neuraminidase__InfluenzaA__ABG26805
augaaccccaaucagaagaucauuaccauaggcagcgugucccugacaaucgccacuauuugcuuccucacgcaaaucgcuauucuugucaccacaguuacucugcacuuuaaacaguacgaguguucuucaccuccaaacaaucaggugaugccgugcgaacccaucauaaucgagagaaacauuaccgaaaucguauauuugacaaauaccacuauugagaaggaaaucuguccuaaauuaguggaguacaggaacuggaguaagccacagugcaaaauaacaggguucgcacccuuuagcaaggacaauuccauucggcugucugccggaggugauaucugggucacccgcgagccuuaugugucgugugacccaggcaagugcuaccaauucgcgcuagggcagggaacgacucucaacaauaaacauucaaacgauaccauucacgaccgaacacccuaucguacucugcuuaugaaugaacugggcguuccuuuucauuuggguaccaaacagguguguaucgcuuggagcaguuccucuugccacgaugggaaggccuggcuccaugucuguaucacaggacacgacaagaacgcaaccgccagcuucauuuacgauggcagacugguggacuccauaggcucauggaguaaaaauauccugaggacgcaggagagcgaaugcguauguauuaacgggacuugcacaguugugaugaccgauggaucugcuuccgagcgggcagacacuaagauccucuuuauagaggaagguaagauuguccacaucucaccauuaagcggcagugcccaacauguggaggaaugcucuuguuauccgcgcuaccccggggugagaugcgucuguagggauaauuggaaaggauccaaccggccuaucguugacauuaacgugaaggauuacagcaucguaucgucuuaugugugcuccggccuggucggugacacaccacgcaaaaaugaccgaucaaguagcuccuacuguagaaaccccaauaacgagaaggggaaucacggagugaaaggcugggcuuucgaugacggcaacgauguuuggauggggaggaccauuggagaggaacuucggucugguuaugagacguuuaaggugauaggcggguggagcaccccuaauucaaaauugcagaucaaccgucagauuaucgucgacaguggaaaucgcuccggcuacagcgguaucuucucuguggaagggaagucaugcauuaacagauguuuuuauguagagcugauaaggggccgggaacaggagacacgaguuugguggaccaguaauagcaucguggucuucugcggaacuuccggcacauacgggacuggaucuuggccagauggugccgacauuaaccuaaugcccaucuga

SEQ ID NO: 137110 - RNA, 1413 nt, Artificial Sequence; identical to SEQ ID NO: 136967
  derived and/or modified sequence opt3 from neuraminidase__InfluenzaA__ABG26816

SEQ ID NO: 137111 - RNA, 1413 nt, Artificial Sequence; identical to SEQ ID NO: 137075
  derived and/or modified sequence opt3 from neuraminidase__InfluenzaA__ABG26827

SEQ ID NO: 137112 - RNA, 1413 nt, Artificial Sequence; identical to SEQ ID NO: 137075
  derived and/or modified sequence opt3 from neuraminidase__InfluenzaA__ABG26838

SEQ ID NO: 137113 - RNA, 1410 nt, Artificial Sequence
  derived and/or modified sequence opt3 from neuraminidase__InfluenzaA__ABG26860
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucugaccgcgccgauacuaagauauuauuuaucgaggaagguaaaauugugcacaucuccccucugucaggcagcgcucaacauguggaggaaugcaguuguuauccaagauacccgggggucaggugcguuugucgggacaacuggaagggaucuaaccgccccauaauugauaucaaugugaaggacuacuccaucguaagcucguaugugugcucuggccuugucggugacacaccucgaaagaacgauuccucaaguagcuccuacuguuggaauccaaacaaugagaaagggggacacggcgugaaaggcugggccuucgacgaugggaacgacguuuggaugggaagaaccauuucugaagagagcaggucagguuaugagacguuuaaggugaucggcggguggaguaaacccaauuccaaguugcagauuaaccggcaggucauaguggaucguggaaaucgcagcggcuacucugguaucuucucaguagaagggaaaaguugcauuaacagauguuuuuauguugagcugaucaggggccggaagcaggaaaccgaggugugguggacaagcaauuccaucgucguguucugcggaacuucuggcaccuacgggacaggaucguggccugacggugcggauauuaaccuaaugccaauauga

SEQ ID NO: 137114 - RNA, 1410 nt, Artificial Sequence
  derived and/or modified sequence opt3 from neuraminidase__InfluenzaA__ABG26871
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccauauaaucagaucauguugugcgaaccgacuauaaucgagagaaacauuaccgaaaucguguacuuaacaaauaccacuauugagaaggaaaucugucccaaacuggcagaguauaggaacuggucaaagccucagugcaaaauaacaggguucgccccauuuaguaaggacaauagcauucggcuauccgcgggaggugauaucuggguaacccgcgagcccuacgugucuugugacccuggcaagugcuaucaauucgcucucgggcagggaacgacucugaacaaucgacauucgaacgauaccguccacgaccguacaccauacagaacucuucugaugaaugaauugggcgugcccuuucaucucgguaccaaacagguuuguauugccuggucaagcaguuccugccacgaugggaaggcauggcugcaugugugugucacaggacacgacgagaacgccaccgcuucuuucaucuaugauggcaggcugguggacagcaucggcuccuggaguaaaaauauucuccggacgcaggaaucagagugcguauguauaaacgggacuugcacaguugugaugaccgauggaagcgcaucugaccgcgccgauacuaagaucuuauuuauugaggaagguaaaaucguccacauauccccucugucaggcagcgcucaacauguggaggaaugcaguuguuacccaagauacccgggggugaggugcgucugucgggacaauuggaagggaucuaaccgccccauuguugauaucaacgugaaggacuauuccaucguaagcucguacgugugcucuggccuugucggugacacaccucgaaagaaugauuccucaaguagcuccuauuguuggaacccaaauaacgagaaagggggacacggcgugaaaggcugggccuucgacgaugggaaugacguuuggaugggaagaaccauuucugaagagagcaggucagguuacgagacguuuaaggugaucggcggguggaguaaacccaacuccaaguugcagauuaaucggcaggucauaguggaucguggaaaccgcagcggcuauucugguaucuucucaguagaagggaaaaguugcauuaauagauguuuuuacguugagcugaucaggggccggaagcaggaaaccgaggugugguggacaagcaacuccaucgucguguucugcggaacuucuggcaccuaugggacaggaucguggccugacggugcggauauuaaucuaaugccaauauga

SEQ ID NO: 137115 - RNA, 1410 nt, Artificial Sequence
  derived and/or modified sequence opt3 from neuraminidase__InfluenzaA__ABG26893
augaaccccaaucagaagaucauuaccauaggcagcaucucccugacaauugccacuaucugcuuccucaugcaaauugcuauccuugugacgaccgucacacugcacuuuaaacaguacgaguguaacucuccuccaaauaaccagguuauguugugcgaaccgacuauaaucgagagaaauauuaccgaaaucguguauuuaacaaacaccacuauugagaaggaaaucugucccaaacuggcagaguacaggaauuggucaaagccucagugcaaaauaacaggguucgccccauuuaguaaggacaacagcauucggcuauccgcgggaggugauaucuggguaacccgcgagcccuaugugucuugugacccuggcaagugcuaccaauucgcucucgggcagggaacgacucugaauaaccgacauucgaaugauaccguccacgaccguacaccauauagaacucuucugaugaacgaauugggcgugcccuuucaucucgguaccaaacagguuuguauugccuggucaagcaguuccugccacgaugggaaggcauggcugcaugugugugucacaggacacgacgagaaugccaccgcuucuuucaucuacgauggcaggcugguggacagcaucggcuccuggaguaaaaacauucuccggacgcaggaaucagagugcguauguauaaaugggacuugcacaguugugaugaccgauggaagcgcaucugaccgcgccgauacuaagaucuuauuuauugaggaagguaaaaucguccacauauccccucugucaggcagcgcucaacauguggaggaaugcaguuguuauccaagauacccgggggugaggugcgucugucgggacaacuggaagggaucuaaccgccccauuguugauaucaaugugaaggacuacuccaucguaagcucguaugugugcucuggccuugucggugacacaccucgaaagaacgauuccucaaguagcuccuacuguuggaauccaaacaaugagaaagggggacacggcgugaaaggcugggccuucgacgaugggaacgacguuuggaugggaagaaccauuucugaagagagcaggucagguuaugagacguuuaaggugaucggcggguggaguaaacccaauuccaaguugcagauuaaccggcaggucauaguggaucguggaaaucgcagcggcuacucugguaucuucucaguagaagggaaaaguugcauuaacagauguuuuuauguugagcugaucaggggccggaagcaggaaaccgaggugugguggacaagcaauuccaucgucguguucugcggaacuucuggcaccuacgggacaggaucguggccugacggugcggauauuaaccuaaugccaauauga

SEQ ID NO: 137116 - RNA, 1410 nt, Artificial Sequence
  derived and/or modified sequence opt3 from neuraminidase__InfluenzaA__ABG26915
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucuccucauggaguaaaaacauccuccggacgcaggaaagcgagugcguuuguauuaauggcacuugcacaguggucaugaccgaugggucugcauccgagcgcgccgacacuaagauauuauuuaucgaagagggaaaaauugugcacaucucaccucugagcgguagugcucaacauguggaagagugcucuuguuauccaagauacccgggcgucaggugcguuugucgggauaacuggaagggguccaaccgccccauaguggacauuaauguaaaggauuacagcaucgugucgucuuaugucugcuccggacuugugggcgacacaccucggaaaaacgacucaaguagcuccucuuacuguuugaauccaaacaaugaagagggugggcacggaguuaagggcugggccuucgaugacggcaacgauguguggauggggagaaccaucagcgagaaacugaggucaggauaugaaacguuuaaggucauugguggcuggaguaaacccaauuccaagcuacagaucaaccgacaggugauuguagaccgugggaaucgcagcggauacucuggcauauucucaguugaggguaaaaguugcgugaacagauguuuuuaugucgaacucaucagggggcggaagcaggagaccgaagugugguggacaagcaauuccauugucguguucugcggcacuucuggaaccuacggcacagggucguggccugauggagcggacaucaaccugaugccaaucuga

SEQ ID NO: 137117 - RNA, 1410 nt, Artificial Sequence
  derived and/or modified sequence opt3 from neuraminidase__InfluenzaA__ABG26937
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaucaaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccuggcaagugcuaccaauucgcucucgggcagggaacgacucugaacaaucgacauucaaacgauaccgugcacgaccguacaccauauagaacucuucugaugaaugaauugggcguucccuuucaucucgguaccaaacagguguguaucgccuggagcaguuccucuugccacgaugggaaggcauggcugcaugucugugugacaggacacgacgagaacgccaccgcuagcuucauuuacgauggcaggcugguagacuccaucggcucauggaguaaaaauauccuccggacgcaggaaagcgagugcguuuguauuaacgggacuugcacaguggucaugaccgauggaucugcauccgagcgcgccgacacuaagauauuauuuaucgaagaggguaaaauugugcacaucucaccucugagcggcagugcucaacauguggaagagugcucuuguuauccaagauacccgggggucaggugcguuugucgggauaauuggaagggauccaaccgccccauaguggacauuaacguaaaggauuacagcaucgugucgucuuaugucugcuccggccuugugggugacacaccucgaaagaaugacucaaguagcuccucuuacuguagaaacccaaauaacgaaaaagggagccacggaguuaaaggcugggccuucgaugacggcaaugauguguggauggggaggaccaucucagaggaguugcggaguggauaugaaacguuuaaggucauugguggcugguccaaacccaacagcaagcugcagaucaaucgucaggugauuguagaccgcgggaacagaucuggauacucaggcauauucaguguugaggguaaaagcugcaucaauagguguuuuuauguggaacuaauucgggggcgaaagcaggagaccgaagucugguggacauccaacucuaucguggucuucugcggcacuucgggaaccuacggcacagggagcuggccugauggagcggacaucaaucucaugccaauuuga

SEQ ID NO: 137118 - RNA, 1413 nt, Artificial Sequence; identical to SEQ ID NO: 136412
  derived and/or modified sequence opt3 from neuraminidase__InfluenzaA__ABG26948

SEQ ID NO: 137119 - RNA, 1410 nt, Artificial Sequence; identical to SEQ ID NO: 136182
  derived and/or modified sequence opt3 from neuraminidase__InfluenzaA__ABG26959

SEQ ID NO: 137120 - RNA, 1413 nt, Artificial Sequence
  derived and/or modified sequence opt3 from neuraminidase__InfluenzaA__ABG37123
augaaccccaaucagaagaucauuaccauaggcagcaucuccauuacaaucgggauuaucucucugaugcuccaaauaggaaacaucauuucaaucugggccagucacagcauucagacugguucccagaaucauacgggcgugugcaaccagagaaucauaaccuacgaaaauucuacaugggucaaccacacuuauguuaauauuaacaauaccaacgugaucgcugggaaagacaagacaucgguaacccuugcaggaaauucaagccuguguaguauuuccggcugggccaucuacacuaaagauaacucuaucaggauugguagcaagggggacguguucgucauacgggagccuuuuaucuccugcucacauuuggagugucgcacauucuuuuuaacccaaggagcgcugcuaaaugauaaacacaguaacggcacggugaaggaccgaagcccauaucgugcucucaugucuugcccgcugggcgaagcccccuccccuuacaauucaaaguucgagagcguugcauggagugccucugcuugucaugaugggaugggauggcuuacuauugguaucuccggcccagacaacggggcaguggccguccugaaauauaacggaauaauuaccgaaacaaucaagagcuggaaaaagcagaucuugagaacucaggagucggagugcguguguguaaauggcucuugcuuuaccauuaugacagauggucccuccaacggggcugccucauacaaaaucuucaagauugaaaagggaaaaguuaccaagaguauagagcucaaugcgccuaacuuucacuaugaagaguguagcugcuacccagacacgggcacugugaugugugucugcagggauaauuggcacggcuccaaccggcccugggugucuuucaaucagaaccuggacuaccaaaucggguauauuugcagcggaguguuuggugauaauccucgcccaaaagacggcgaggggucauguaacccggucacaguugauggagcaaauggcgugaaggguuucaguuacaaauaugggaacggcguauggaucggaagaaccaaguccaauaggcugcggaaaggcuuugaaaugaucugggaccccaacggguggacugacacagauagcgacuucucugugaagcaggaugucguggccauuaccgacuggucaggauacagugguagcuuuguucagcauccugagcucacgggcuuagauugcauacgcccauguuucuggguggaacugguccgagggcuucccaaggagaauaccacaaucuggacuuccggaucuucgauuagcuucugcggcgugaacuccgacaccgcuaacuggucauggccugauggugccgaauugccauuuacaaucgacaaauga

SEQ ID NO: 137121 - RNA, 1410 nt, Artificial Sequence
  derived and/or modified sequence opt3 from neuraminidase__InfluenzaA__ABG37134
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauugugcacaucucccaacugcuuggcucagcucagcauguggaggaaugcagcuguuauccuagauacccaggggucaggugcguuugucgggacaauuggaagggaaguaaccgcccgauaguggauauuaacguaaaagacuacucuaucguguccagcuaugucugcucgggcuuggugggugacacaccccgaaagaaugauucuuccucaaguagccacugucugaacccuaauaacgaggaagggggacauggcguuaaaggcugggccuucgacgaugggaaugacguguggaugggaagaaccaucuccgagaagcuaaggucugguuacgagacguuuaaagucauugaaggcuggagcaagccaaacucaaaacuccagaucaaucgucaggugauuguagaucgggggaaccgcaguggauauuccggcauauucagcguugaggguaagucuugcaucaauagauguuuuuacguggaacugauuagggggcggaagcaagagaccgaagucugguggacaucaaacaguaucguggucuucugcggcacuagcggaaccuauggcacaggguccuggcccgacggagcggauaucaaucuuaugccuauuuga

SEQ ID NO: 137122 - RNA, 1410 nt, Artificial Sequence; identical to SEQ ID NO: 136142
  derived and/or modified sequence opt3 from neuraminidase__InfluenzaA__ABG37145

SEQ ID NO: 137123 - RNA, 1410 nt, Artificial Sequence
  derived and/or modified sequence opt3 from neuraminidase__InfluenzaA__ABG37156
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucuggucgcgccgacacuaagauauuauuuaucgaggaaggcaaaauugugcacaucuccccucugucagggagcgcucaacauguggaggaaugcaguuguuauccaagauacccgggagucaggugcguuugucgggauaacuggaagggcucuaaccgccccauaguggacauuaauguaaaggauuacuccaucgugagcaacuaugucugcucgggucuugugggggacacaccucggaaaaaugacucuuccucaaguagccacuguuugaacccaaauaacgaggaaggaggccauggcguuaaggggugggccuucgaugacggaaaugauguguggauggguagaaccaucuccgagaaacugaggucuggcuacgagacguuuaaggucauugggggauggagcaaacccaacucaaagcuacagaucaaucgacaggugauuguagaccguggcaaccgcagugguuauuccgggauauucagcguugaaggcaaaucuugcaucaauagauguuuuuacguggagcucauuaggggacggaagcaggaaaccgaggucugguggacaucaaacaguaucguggucuucugcggcacuagcgggaccuauggaacagguuccuggccugauggcgcggacaucaaucugaugccaauuuga

SEQ ID NO: 137124 - RNA, 1410 nt, Artificial Sequence
  derived and/or modified sequence opt3 from neuraminidase__InfluenzaA__ABG37167
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucuccucauggaguaaaaacauccuccggacgcaggaaagcgagugcguuuguauuaauggcacuugcacaguggucaugaccgacggcucugcauccgggcgcgccgauacuaagauauuauuuaucgaggaaggaaaaauugugcacaucucaccucugagcgguagugcucaacauguggaggaaugcucuuguuauccaagauacccgggcgucaggugcguuugucgggacaacuggaagggguccaaccgccccauaguggauauuaauguaaaggacuacagcaucgugucgucuuaugucugcuccggacuugugggcgacacaccucggaaaaacgauucaaguagcuccucuuacuguuugaauccaaacaaugaggaaggugggcacggaguuaagggcugggccuucgacgauggcaacgacguguggauggggagaaccaucagcgagaaacugaggucaggauaugagacguuuaaggucauugguggcuggaguaaacccaauuccaagcuacagaucaaccgacaggugauuguagaucgugggaaucgcagcggauacucuggcauauucucaguugaagguaaaaguugcgugaacagauguuuuuaugucgagcucaucagggggcggaagcaggaaaccgaggugugguggacaagcaauuccauugucguguucugcggcacuucuggaaccuacggcacagggucguggccugacggagcggauaucaaccugaugccaaucuga

SEQ ID NO: 137125 - RNA, 1410 nt, Artificial Sequence
  derived and/or modified sequence opt3 from neuraminidase__InfluenzaA__ABG37189
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccagguguuguuaugcgaaccgacuaucauagagagaaauaucaccgaaauuguauaucugacaaacaccacuaucgagaaggaaauuugucccaaacuagcagaguacaggaauuggucaaagccucagugcaaaaucacaggguucgccccauuuaguaaggacaacagcauacggcucuccgcgggaggugauauuugggugacccgcgagcccuaugucucuugugacccuggcaagugcuaccaauucgcucuggggcagggaacgacucuuaauaaccgacauucgaaugauaccgugcacgaccguacaccauauagaacucuguugaugaacgaacucggcguucccuuucaucuggguaccaaacagguguguaucgccuggucaagcaguuccugccacgaugggaaggcauggcugcaugucugugugacaggacacgacgagaaugccaccgcuucuuucauuuacgauggcaggcucguagacagcaucggcuccuggaguaaaaacaucuuacggacgcaggaaucagagugcguuuguauuaaugggacuugcacaguggucaugaccgauggaagcgcaucuggucgcgccgacacuaagauacuguuuaucgaggaaggcaaaauugugcacaucuccucacuuagcgggagugcucaacauguggaggaaugcucuuguuauccuagauacccaggagucaggugcguuugucgggauaacuggaagggcuccaaccgcccgauaguggacauuaauguaaaggauuacagcaucgugucgucuuaugucugcuccgguuuggugggggacacaccccggaaaaacgacucaaguagcuccucucacugucugaauccuaacaaugaggaaggaggccauggcguuaaggggugggccuucgaugacggaaacgauguguggauggguagaaccaucagcgagaaacuaaggucaggcuacgagacguuuaaggucauugggggauggaguaaaccaaauuccaagcuccagaucaaccgacaggugauuguagaccguggcaaucgcagcgguuauucugggauauucucaguugaaggcaaaaguugcaucaacagauguuuuuacguggagcugauuaggggacggaagcaggaaaccgaggucugguggacaagcaauuccaucguggucuucugcggcacuucugggaccuauggaacagguucguggcccgauggcgcggacaucaaccuuaugccuauuuga

SEQ ID NO: 137126 - RNA, 1410 nt, Artificial Sequence
  derived and/or modified sequence opt3 from neuraminidase__InfluenzaA__ABG37200
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacucgggcaagugcuaccaauucgcucucgggcagggaacgacucugaauaaccgacauucaaaugauaccgugcacgaccguacaccuuauagaacucuucugaugaacgaauugggcguuccauuucaucucgguaccaaacagguguguaucgccuggagcaguuccucuugccacgaugggaaggcauggcugcaugucugugugacaggacacgacgagaaugccaccgcuagcuucauuuacgauggcaggcugguagacuccaucggcucauggaguaaaaacauccuccggacgcaggaaagcgagugcguuuguauuaaugggacuugcacaguggucaugaccgauggaucugcauccggucgcgccgacacuaagauauuauuuaucgaggaaggcaaaauugugcacaucucaacacugagcgggagugcucaacauguggaggaaugcucuuguuaucccagauacccuggagucaggugcguuugucgggauaacuggaagggcuccaaccgcccaauaguggacauuaauguaaaggauuacagcaucgugucgucuuaugucugcuccggucuugugggggacaccccgcggaaaaacgacucaaguagcuccucucacuguuugaaucccaacaaugaggaaggaggccauggcguuaaggggugggccuucgaugacggaaacgauguguggauggguagaacgaucagcgagaaacugaggucaggcuacgagaccuuuaaggucauugggggauggaguaaaccuaauuccaagcuacagaucaaccgacaggugauuguagaccguggcaaucgcagcgguuauucugggauauucucaguugaaggcaaaaguugcaucaacagauguuuuuacguggagcucauuaggggacggaagcaggaaacagaggucugguggacuagcaauuccaucguggucuucugcggcaccucugggacauauggaacugguucguggccagauggcgcggacaucaaccugaugcccauuuga

SEQ ID NO: 137127 - RNA, 1410 nt, Artificial Sequence
  derived and/or modified sequence opt3 from neuraminidase__InfluenzaA__ABG37211
augaaccccaaucagaagaucauuaccauaggcagcgugucccugacaaucgccacuauuugcuuccucacgcaaaucgcuauucuugucaccacaguuacucugcacuuuaaacaguacgaguguucuucaccuccaaacaaucaggugaugccgugcgaacccaucauaaucgagagaaacauuaccgaaaucguauauuugacaaauaccacuauugagaaggaaaucuguccuaaauuaguggaguacaggaacuggaguaagccacagugcaaaauaacaggguucgcacccuuuagcaaggacaauuccauucggcugucugccggaggugauaucugggucacccgcgagccuuaugugucgugugacccaggcaagugcuaccaauucgcgcuagggcagggaacgacucucaacaauaaacauucaaacgauaccauucacgaccgaacacccuaucguacucugcuuaugaaugaacugggcguuccuuuucauuuggguaccaaacagguguguaucgcuuggagcaguuccucuugccacgaugggaaggccuggcuccaugucuguaucacaggacacgacaagaacgcaaccgccagcuucauuuacgauggcagacugguggacuccauaggcucauggaguaaaaauauccugaggacgcaggagagcgaaugcguauguauuaacgggacuugcacaguugugaugaccgauggaucugcuuccgagcgggcagacacuaagauccucuuuauagaggaagguaagauuguccacaucucaccauuaagcggcagugcccaacauguggaggaaugcucuuguuauccgcgcuaccccggggugagaugcgucuguagggauaauuggaaaggauccaaccggccuaucguugacauuaacgugaaggauuacagcaucguaucgucuuaugugugcuccggccuggucggugacacaccacgcaaaaaugaccgaucaaguagcuccuacuguagaaaccccaauaacgagaaggggaaucacggagugaaaggcugggcuuucgaugacggcaacgauguuuggauggggaggaccauuggagaggaacuucggucugguuaugagacguuuaaggugauaggcggguggagcaccccuaauucaaaauugcagaucaaccgucaggucauuguggacaguggaaaucgcuccggcuacagcgguaucuucucuguagaagggaagucaugcaucaacagauguuuuuauguugagcugauuaggggccgggaacaggagacacgagugugguggaccaguaauagcauagucguguucugcggaacuuccggcacauacgggacuggaucuuggccagauggugccgacaucaaccuaaugcccauuuga

SEQ ID NO: 137128 - RNA, 1410 nt, Artificial Sequence
  derived and/or modified sequence opt3 from neuraminidase__InfluenzaA__ABG37233
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaucaaaucaggcaauguugugcgaaccgacuaucauagagagaaacaucaccgaaauuguguauuuaacaaauaccacuaucgagaaggaaauuugucccaaacuggccgaguacaggaacuggaguaagccucagugcaaaaucacaggguucgcgccauuuagcaaggacaauuccauacggcuaucugcuggaggugauauuuggguaacccgcgagcccuaugugucgugugacccuggcaagugcuaccaauucgcccucgggcagggaacgacuaucaacaaucgacauucaaacgauaccguccacgaccguacaccauauagaacucugcuuaugaaugaacugggcgugcccuuucauuuggguaccaaacagguuuguauugcauggagcaguuccucuugccacgaugggaaggccuggcuccaugugugugucacaggacacgacgagaacgcuaccgccagcuucaucuacgauggcaggcugguggacuccaucggcucauggaguaaaaauauucugcggacgcaggaaagcgagugcguauguauaaacgggacuugcacaguugugaugaccgauggaucugcauccggucgcgcugacacuaagauccucuuuauugaggaaggcaaaaucguccacauaucaccuuuaagcgggagugcccaacauguggaggaaugcucuuguuauccaagauacccgggagugaggugcgucugucgggauaauuggaagggcuccaaccgccccauuguugacaucaacgugaaggauuacagcaucguaucgucuuaugugugcuccggucuggucggggacacaccucgaaagaaugacucaaguagcaacuccuacuguagaaauccaaacaaugagaagggaucucacggcgugaaaggcugggcguucgaugacgggaacgauguuuggaugggaaggaccauuagcgcagaaucacggagugguuaugagacguuuaaggugaucggcgggugguccaaacccaauagcaaacuucagauuaaccgucaggucauaguggaccgcggaaauagaucuggcuacucagguaucuucaguguagaggggaaaagcugcauuaacagguguuuuuauguugaauugauccggggccgaaagcaggagaccgaagugugguggacauccaauucuaucgucguguucugcggaacuucgggcaccuacgggacaggaagcuggccugauggugccgacauuaaccugaugccaauauga

SEQ ID NO: 137129 - RNA, 1410 nt, Artificial Sequence
  derived and/or modified sequence opt3 from neuraminidase__InfluenzaA__ABG37244
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggucaaagaacauccuccggacgcaggaaagugagugcguuuguauuaaugggacuugcacaguggucaugaccgauggaagcgcaucugaccgcgccgauacuaagauauuauuuaucgaggaagguaaaauugugcacaucuccccucugucaggcagcgcucaacauguggaggaaugcaguuguuauccaagauacccgggggucaggugcguuugucgggacaacuggaagggaucuaaccgccccauaguggauauuaauguaaaggacuacuccaucgugagcucguaugucugcucuggccuugugggugacacaccucggaaaaacgauuccucaaguagcuccuacuguuggaauccaaacaaugagaaagggggacacggcguuaaaggcugggccuucgacgaugggaacgacguguggaugggaagaaccaucucugaagagagcaggucagguuaugagacguuuaaggucauuggcggguggaguaaacccaauuccaaguugcagaucaaccgacaggugauuguagaucguggaaaucgcagcggcuacucugguauauucucaguugaagggaaaaguugcaucaacagauguuuuuauguggagcugauuaggggccggaagcaggaaaccgaggucugguggacaagcaauuccaucguggucuucugcggaacuucuggcaccuacgggacaggaucguggccugacggugcggauaucaaccuaaugccaauuuga

SEQ ID NO: 137130 - RNA, 1410 nt, Artificial Sequence; identical to SEQ ID NO: 137129
  derived and/or modified sequence opt3 from neuraminidase__InfluenzaA__ABG37255

SEQ ID NO: 137131 - RNA, 1410 nt, Artificial Sequence; identical to SEQ ID NO: 137116
  derived and/or modified sequence opt3 from neuraminidase__InfluenzaA__ABG37266

SEQ ID NO: 137132 - RNA, 1410 nt, Artificial Sequence; identical to SEQ ID NO: 137129
  derived and/or modified sequence opt3 from neuraminidase__InfluenzaA__ABG37277

SEQ ID NO: 137133 - RNA, 1410 nt, Artificial Sequence; identical to SEQ ID NO: 137129
  derived and/or modified sequence opt3 from neuraminidase__InfluenzaA__ABG37288

SEQ ID NO: 137134 - RNA, 1410 nt, Artificial Sequence; identical to SEQ ID NO: 137129
  derived and/or modified sequence opt3 from neuraminidase__InfluenzaA__ABG37310

SEQ ID NO: 137135 - RNA, 1410 nt, Artificial Sequence; identical to SEQ ID NO: 137116
  derived and/or modified sequence opt3 from neuraminidase__InfluenzaA__ABG37321

SEQ ID NO: 137136 - RNA, 1410 nt, Artificial Sequence
  derived and/or modified sequence opt3 from neuraminidase__InfluenzaA__ABG37332
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguacacuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcacgucugugugacaggacaugacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucugaccgcgccgauacuaagauauuauuuaucgaggaagguaaaauugugcacaucuccccucugucaggcggggcucaacauguggaggaaugcagcuguuauccaagauacccgggagucaggugcguuugucgggacaacuggaagggcaguaaccgccccauaguggauauuaauguaaaggacuauucuaucguguccagcuacgucugcucgggucuugugggggacacaccucggaaaaacgauucuuccucaaguagcuacuguuggaauccaaacaaugagaagggaggccacggcguuaaagggugggccuucgacgauggaaacgacguguggauggguagaaccaucuccgaagagucuaggagcggcuaugagacguuuaaggucauugggggauggucaaaacccaauaguaaguugcagaucaaccgacaggugauuguagaucguggcaaucgcuccgguuacagcgggauauucucuguugaaggcaaaucaugcaucaacagauguuuuuauguggagcugauuaggggacggaagcaggaaaccgaggucugguggacaaguaauagcaucguggucuucugcggcacuuccgggaccuacggaacagguucuuggccugacggcgcggauaucaaccuaaugccaauuuga

SEQ ID NO: 137137 - RNA, 1410 nt, Artificial Sequence
  derived and/or modified sequence opt3 from neuraminidase__InfluenzaA__ABG37343
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggucaaagaacauccuccggacgcaggaaagugagugcguuuguauuaaugggacuugcacaguggucaugaccgauggaagcgcaucugaccgcgccgauacuaagauauuauuuaucgaggaagguaaaauugugcacaucuccccucugucaggcagcgcucaacauguggaggaaugcaguuguuauccaagauacccgggggucaggugcguuugucgggacaacuggaagggaucuaaccgccccauaguggauauuaauguaaagaacuacuccaucgugagcucguaugucugcucuggccuugugggugacacaccucggaaaaaugacuccucaaguagcuccuacuguuggaacccaaauaacgagaaagggggacacggcguuaaaggcugggccuucgaugacgggaaugauguguggaugggaagaaccaucucugaagagagcaggucagguuaugagacguuuaaggucauuggcggguggaguaaacccaacuccaaguugcagaucaaucgacaggugauuguagaccguggaaaccgcagcggcuacucugguauauucucaguugaagggaaaaguugcaucaauagauguuuuuauguggagcugauuaggggccggaagcaggaaaccgaggucugguggacaagcaacuccaucguggucuucugcggaacuucuggcaccuacgggacaggaucguggccugauggugcggacaucaaucuaaugccaauuuga

SEQ ID NO: 137138 - RNA, 1410 nt, Artificial Sequence; identical to SEQ ID NO: 137117
  derived and/or modified sequence opt3 from neuraminidase__InfluenzaA__ABG37354

SEQ ID NO: 137139 - RNA, 1413 nt, Artificial Sequence; identical to SEQ ID NO: 136844
  derived and/or modified sequence opt3 from neuraminidase__InfluenzaA__ABG37365

SEQ ID NO: 137140 - RNA, 1413 nt, Artificial Sequence; identical to SEQ ID NO: 136946
  derived and/or modified sequence opt3 from neuraminidase__InfluenzaA__ABG37387

SEQ ID NO: 137141 - RNA, 1413 nt, Artificial Sequence
  derived and/or modified sequence opt3 from neuraminidase__InfluenzaA__ABG37398
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgagaauaacaccugggucaaucacacauauguuaacauuaauaacacuaaugugaucgcagggaaagacaagaccucuguaacacuugccggaaacucgucacuguguagcauuaguggcugggcgaucuacaccaaagauaauuccaucaggauugguucuaagggggacguguucgucauacgggaaccuuuuaucagcugcucccauuuggagugucgcacuuucuuuuuaacacaaggagcucugcuaaacgauaaacacucaaauggcaccgugaaggaccgaaguccauaucgugcccucaugagcugcccgcugggcgaagcacccucuccuuacaacuccaaguucgagucaguugccuggagcgcuagugcaugucaugaugggaugggauggcuuacgauugguaucucuggcccagacaacggggccguggcuguccugaaauauaauggaauaauuacugaaaccaucaaguccuggaaaaagcagaucuugagaacacaggagagcgagugcguguguguaaacggcucgugcuuuacuauuaugaccgauggucccucuaauggggccgcguccuacaaaaucuucaagauugaaaagggaaaaguuacaaagucaauagagcucaacgcaccuaauuuucacuaugaagaguguaguugcuacccagacaccggcacggugaugugugucugcagggauaacuggcacggcagcaaucggcccuggguguccuucaaccagaaucuggacuaccaaaucggguauauuugcucuggaguguuuggugauaacccucgcccaaaagacggcgaggggagcuguaauccggucacuguugauggagccaacggcgugaaggguuucucauacaaauaugggaauggcguauggaucggaagaacaaagaguaacaggcugcggaaaggcuuugaaaugaucugggaccccaauggguggaccgacacugauuccgacuucagcgugaagcaggaugucguggcuauuacagacuggucuggauacucagguaguuuuguucagcauccugagcucaccggcuuagauugcauacgcccauguuucuggguggaacugguccgagggcuucccaaggagaacacgaccaucuggacaagcggauccucuauuucguucugcggcgugaacagcgacacugccaauugguccuggccugauggugcagaauugccauuuaccaucgacaaauga

SEQ ID NO: 137142 - RNA, 1410 nt, Artificial Sequence
  derived and/or modified sequence opt3 from neuraminidase__InfluenzaA__ABG37409
augaaccccaaucagaagaucauuaccauaggcagcgugucccugacaaucgccacuauuugcuuccucaugcaaaucgucauucuuguuacgaccgugacacugcacuuuaaacaguacgaguguaacucuccuccaaauaaccagguaaugccgugcgaacccacuaucauagagagaaauaucaccgaaauuguguauuugacaaacaccacuaucgagaaggaaauuuguccuaaauuagcugaguacaggaauuggucaaagccacagugcaacaucacaggguucgcacccuuuaguaaagacaauagcauacggcuguccgccggaggugauauuugggucacccgcgagccuuaugugucuugugacccagauaagugcuaccaauucgcgcuaggccaggggacgacucucaacaauggacauucgaacgacaccguucacgaucgaacacccuaucguacucugcuuaugaaugaacugggcgugccuuuucauuuggguaccaagcaggucuguaucgcuuggucaagcaguuccugccacgacgggaaagccuggcuccauguguguguaacaggagaugacgagaacgcaaccgccucuuucauuuacaauggcagacugguugauagcaucggcuccuggucaaagaaaauccugaggacgcaggaaagugagugcguguguauuaacgggacuugcacagucgugaugaccgacggaagcgcuucugguaaggcagauacuaaaauacucuuuaucgaggaaggcaagauugugcacacauccuuacugucagggagcgcccaacacgucgaggaaugcaguuguuauccacgguacccgggaguucgcugcguguguagagacaacuggaagggcucuaauaggcccaucguagauauaaacgugaaagacuacuccauugucagcucguaugugugcucuggucuuguuggggacaccccucggaagaaugauuccucaaguagcucccauuguuuggacccaaacaaugaggaaggaggccacggcgugaaagggugggcuuucgaugaccgcaacgaugucuggaugggacgaacgaucucugagaagcugagaagcgguuacgagaccuuuaaagugaucgaaggcuggucaaagcccaauaguaaacuacagauuaacaggcagguaaucguugaccgggggaaucguuccggauauagcggcauuuucucuguggaggguaagucaugcauaaaccgcuguuuuuacgucgaacucaucagagggaggaagcaggagacagaagugcuguggaccaguaauagcauugucguguucugcggcacuuccggaacauauggcacugggucuuggccugauggagccgacaucaaccuuaugccaaucuga

SEQ ID NO: 137143 - RNA, 1410 nt, Artificial Sequence
  derived and/or modified sequence opt3 from neuraminidase__InfluenzaA__ABG37442
augaaccccaaucagaagaucauuaccauaggcagcgugucccugacaaucgccacuauuugcuuccucaugcaaaucgcuauucuugucacgaccguuacacugcacuuuaaacaguucgaguguaacucuccuccaaauaaccaggugauguugugcgaaccgacuaucauagaggggaauaucaccgaaauuguauacuuaacaaacaccacuaucgagaaggaaauuugucccaaacuggcagaguauagaaauuggucaaagccucagugcaacaucacaggauuugccccauucaguaaagacaauagcauaaggcuauccgcggguggcgauauuugggugacccgggagcccuacgucucuugugacccugauaagugcuaucaauuugcucucgggcagggaacgacucugaacaauggccauucgaacgacaccgugcacgaucgcacaccauaccgaacucuucugaugaaugaauuggguguucccuuccaucucgggacccgucagguguguaucgccuggucaagcaguuccugccacgacggaaaggcauggcugcaugucugugugacaggcgaugacgagaacgccaccgcuucuuuuauuuauaauggcagacugguagauagcaucggguccuggaguaaaaagauccucaggacgcaggaaucagagugcguuuguauuaacggaacuugcacaguggucaugaccgacgguagcgcaucuggcaaagccgauacuaagauauuauucaucgaggaagggaaaauugugcacaucuccacacugucaggaagcgcucaacacguggaggaaugcaguuguuacccucgguauccaggcguccgcugcguuuguagagacaacuggaaggguucuaauaggccgauaguggauauuaacguaaaggacuacuccaucgugagcucguacgucugcucugggcuugugggagacacgccccggaaaaaugauuccuuuucaaguagccauuguuuggacccuaacaaugaggaaggcggccacgggguuaagggaugggccuucgaugacgguaacgauguguggaugggccgcaccaucuccgagaaacugcgaucuggguaugagaccuuuaaggucauugaaggauggagcaaaccaaauucaaagcuacagacaaacagacaggugaucguagagaggggcaaucggagugguuacuccgggauuuucagcguugaaggcaaaucuugcauaaaccguuguuuuuauguggagcucauccgcggaagaaaggaagagacugaggucugguggaccucaaauaguauuguggucuucugcggcacaagcgggacuuacggaaccgguuccuggcccgacggcgcggauaucaaccugaugccuaucuga

SEQ ID NO: 137144 - RNA, 1410 nt, Artificial Sequence; identical to SEQ ID NO: 136170
  derived and/or modified sequence opt3 from neuraminidase__InfluenzaA__ABG37453

SEQ ID NO: 137145 - RNA, 1410 nt, Artificial Sequence; identical to SEQ ID NO: 136182
  derived and/or modified sequence opt3 from neuraminidase__InfluenzaA__ABG37464

SEQ ID NO: 137146 - RNA, 1410 nt, Artificial Sequence
  derived and/or modified sequence opt3 from neuraminidase__InfluenzaA__ABG37475
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacccccaggaaaaaugauuccuucucaaguagccauuguuuggacccuaacaaugaggaaggaggccacggcguuaaggggugggccuuugaugacggaaacgauguguggaugggucgaacgaucuccgagaaacugagaucuggcuacgagaccuucaaggucauugaaggguggagcaaaccaaauucaaagcuacagaucaaccgccaggugauuguagagcggggagaccguaguggcuauuccgguauauuuagcguugaagggaaaucuugcaucaaucgcuguuucuacguggagcucauuagaggcaggaaggaagagacagagguccuguggacuucaaacaguaucguggucuuuugcggaaccagcggcacauaugggacuggauccuggcccgauggugcggacaucaaucuuaugccuauuuga

SEQ ID NO: 137147 - RNA, 1410 nt, Artificial Sequence
  derived and/or modified sequence opt3 from neuraminidase__InfluenzaA__ABG37486
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaccuaacaggguucgccccauuuaguaaagacaauagcauccggcucuccgcgggaggugauauaugggugacccgcgagcccuaugucucuugugacccugauaagugcuaccaauucgcucugggccaggggacgacucuuaacaauggacauucgaacgacaccgugcacgaucgaacaccauaucguacucuguugaugaaugaacucggcguucccuuucaucuggguaccagacagguguguauugccuggucaagcaguuccugccacgacgggaaggcauggcugcaugucugugugacaggagaugacgagaacgccaccgcuucuuucaucuacaauggcaggcucguagauagcauuggcuccuggaguaaaaagaucuuacggacgcaggaaucagagugcguuuguaucaacgggacuugcacaguggucaugaccgacggaagcgcaucugguaaagccgauacuaagauucuguuuauagaggaaggcaaaaucgugcacauuuccacacuuucagggagcgcucaacacguggaggaaugcaguuguuauccucgcuacccaggagucagaugcguuuguagggacaacuggaagggcucuaaucggccgaucguggauauaaacguaaaggacuacuccauugugagcucguaugucugcucugguuuggugggggacacccccaggaaaaaugauuccuucucaaguagccauugucuggacccuaacaaugaggaaggaggccacggcguuaaggggugggccuuugaugacggaaacgauguguggaugggucgaacgaucuccgagaaacuaagaucuggcuacgagaccuucaaggucaucgaaggguggagcaaaccaaauucaaagcuccagacaaaccgccaggugauuguagagcggggaaaucguaguggcuauuccgguaucuuuagcguugaagggaaaucuugcauuaaccgcuguuucuacguggagcugauaagaggcaggaaggaagagacugaggucugguggaccucaaauaguaucguggucuuuugcggaacaagcggcacuuaugggaccggauccuggcccgacggugcggauauuaaccuuaugccuaucuga

SEQ ID NO: 137148 - RNA, 1410 nt, Artificial Sequence
  derived and/or modified sequence opt3 from neuraminidase__InfluenzaA__ABG37497
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauaaucuuuauugaggaaggcaaaaucgugcacauauccacauuaucagggagcgcucaacacguggaggaaugcaguuguuauccucgcuacccaggagucagaugcguuuguagggacaacuggaagggcucuaaucggccgauuguggauaucaacguaaaggacuacuccaucgugagcucguaugucugcucuggucuggugggggacacccccaggaaaaaugauuccuucucaaguagccauugucuugacccuaacaaugaggaaggaggccacggcguuaaggggugggccuuugaugacggaaacgauguguggaugggucgaacgauuuccgagaaauugagaucuggcuacgagaccuucaaggucaucgaaggguggagcaaaccaaauucaaagcugcagacaaaccgccaggugauuguagagcggggaaaucguaguggcuauuccgguauauuuagcguugaagggaaaucuugcaucaaccgcuguuucuacguggagcuaauuagaggcaggaaggaagagacugaggucugguggaccucaaauaguaucguggucuuuugcggaacaagcggcacuuaugggaccggauccuggcccgacggugcggauaucaaccucaugccuauuuga

SEQ ID NO: 137149 - RNA, 1410 nt, Artificial Sequence; identical to SEQ ID NO: 136196
  derived and/or modified sequence opt3 from neuraminidase__InfluenzaA__ABG37508

SEQ ID NO: 137150 - RNA, 1410 nt, Artificial Sequence; identical to SEQ ID NO: 136607
  derived and/or modified sequence opt3 from neuraminidase__InfluenzaA__ABG37519

SEQ ID NO: 137151 - RNA, 1410 nt, Artificial Sequence; identical to SEQ ID NO: 136607
  derived and/or modified sequence opt3 from neuraminidase__InfluenzaA__ABG37530

SEQ ID NO: 137152 - RNA, 1410 nt, Artificial Sequence; identical to SEQ ID NO: 136607
  derived and/or modified sequence opt3 from neuraminidase__InfluenzaA__ABG37541

SEQ ID NO: 137153 - RNA, 1410 nt, Artificial Sequence; identical to SEQ ID NO: 136607
  derived and/or modified sequence opt3 from neuraminidase__InfluenzaA__ABG37552

SEQ ID NO: 137154 - RNA, 1410 nt, Artificial Sequence; identical to SEQ ID NO: 136607
  derived and/or modified sequence opt3 from neuraminidase__InfluenzaA__ABG37563

SEQ ID NO: 137155 - RNA, 1410 nt, Artificial Sequence; identical to SEQ ID NO: 136607
  derived and/or modified sequence opt3 from neuraminidase__InfluenzaA__ABG37585

SEQ ID NO: 137156 - RNA, 1410 nt, Artificial Sequence; identical to SEQ ID NO: 136607
  derived and/or modified sequence opt3 from neuraminidase__InfluenzaA__ABG37596

SEQ ID NO: 137157 - RNA, 1410 nt, Artificial Sequence; identical to SEQ ID NO: 136607
  derived and/or modified sequence opt3 from neuraminidase__InfluenzaA__ABG37607

SEQ ID NO: 137158 - RNA, 1410 nt, Artificial Sequence; identical to SEQ ID NO: 136607
  derived and/or modified sequence opt3 from neuraminidase__InfluenzaA__ABG37618

SEQ ID NO: 137159 - RNA, 1413 nt, Artificial Sequence; identical to SEQ ID NO: 136844
  derived and/or modified sequence opt3 from neuraminidase__InfluenzaA__ABG47810

SEQ ID NO: 137160 - RNA, 1413 nt, Artificial Sequence
  derived and/or modified sequence opt3 from neuraminidase__InfluenzaA__ABG47832
augaaccccaaucagaagaucauuaccauaggcagcaucuccauugccaucgggauuaucucucugauacuccaagugggaaacaucauuucaaucugggcuagucacagcauucagacagguucccagaaucauacuggcaucugcaaccagagaauaauuacguacgaaaauucuaccugggucaaccaaacauauguuaauaucaacaauacuaacgugguagcagggaaagacaagaccucgaugacacuugccggaaauucaagccuguguccuauuaggggcugggcgaucuacaccaaagauaacaguauccggauugguuccaagggggacguguucgucauacgcgagccauuuaucucuugcagccacuuggagugucgaacuuucuuuuuaacacagggagcucugcuaaaugauaaacauuccaacggcaccgugaaggaccguucaccguauagagcccucaugaguugcccccugggcgaagcaccuagcccauacaauucuagguucgaguccguugccuggucagcuagcgcaugucacgaugggcuuggauggcugacgauugguaucaguggccccgacaacggggccguggcugucuugaaguauaacggaauaauuacugaaaccaucaaaucuuggaagaaacggauccuccgcacacaggaguccgagugcguguguaugaauggcagcugcuuuacuauuaugaccgaugguccuucgaacggggccgcgucuuacagaaucuucaagauugaaaaaggaaggguaacaaaguccauagagcuggacgcaccaaauuaucauuacgaagaguguucaugcuaccccaacaccggcacgguuaugugugugugccgggauaauuggcacggcaguaaccgcccuugggucagcuuuaaucagaaccuggacuaucaaaucggguacauuugcuccggaguguucggugauaauccacgaccgaaggacggcgaggggucuuguaaccccgugacugucgauggagccgacggcguuaaagguuuuagcuauagauacgggaauggcguguggaucggaaggacaaagucaaaccggcuccguaaaggcuucgaaaugaucugggacccuaauggguggaccgauacugacagugauuuuuccaugaagcaggacauuguagcuaugacagauuggagcggauauucugguucauucgugcagcacccagaguuaaccggccuggacugcaugcgccccuguuuuugggucgaacuugugagaggguugccuagggagaacacgaccauauggacaaguggaagcuccaucucuuucugcggcguuaauucggauacugccaacuggagcuggccagacggugcagaacugcccuucaccauugauaaauga

SEQ ID NO: 137161 - RNA, 1413 nt, Artificial Sequence; identical to SEQ ID NO: 136984
  derived and/or modified sequence opt3 from neuraminidase__InfluenzaA__ABG47843

SEQ ID NO: 137162 - RNA, 1410 nt, Artificial Sequence
  derived and/or modified sequence opt3 from neuraminidase__InfluenzaA__ABG47865
augaaccccaaucagaagaucauuaccauaggcagcgugucccugacaaucgccacuauuugcuuccucaugcaaaucgcuauucuugucaucacgguuacccugcacuuuaaacaguacgaguguaacucuccuccaaauaaccaggugauguugugcgaaccgacaauaaucgagagaaauauuacugaaaucguauauuuaaccaacacaaccauugagaaggaaaucugucccaaacuggcagaguacaggaauuggucaaagccucagugcaaaauaacuggguucgccccauuuaguaaggacaacagcauucggcuauccgcgggaggugauaucugggugacacgcgagcccuaugucucuugugacccugauaagugcuaccaauucgcucucggccaggggaccacgcugaauaaccgacauucgaaugacacugugcacgaucguaccccauauagaacacuucugaugaacgaauugggaguucccuuucaucucggcacuaaacagguguguauugccuggucaagcaguuccugccacgacgguaaggcauggcugcaugucugugugaccgggcacgaugagaaugccacagcuucuuucaucuacgacggaaggcugguagauagcaucggcuccuggaguaaaaagauucuccggacccaggaaucagagugcguuuguauaaacggcacgugcacuguggucaugacagacgggagcgcaucuggacgcgccgauaccaaaaucuuauuuauugaggaagguaagaucgugcacauauccccucugucaggcagcgcucaacauguggaggaaugcaguuguuauccaagauacucuggggucaggugcguuugucgggacaauuggaagggauccaaccgcccgauuguggauaucaacguaaaagacuacagcaucgugucgucuuaugucugcuccggccuugugggugacacuccccgaaagaaugauucaaguagcuccucucacuguuugaacccuaauaacgaggaagggggacauggcguuaaaggcugggccuucgacgaugggaaugacguguggaugggaagaacaauuagcgagaagcugaggucagguuacgagaccuuuaaagucaucggcggguggaguaagccaaacuccaaacuacagauuaaucgucaggugauaguagaucggggaaaccgcagcggcuauucugguaucuucucaguugaagggaagaguugcauuaauagauguuuuuacguggagcucaucaggggccggaagcaggaaacggaggucugguggaccagcaacuccaucguggucuucugcggaacaucuggcacuuaugggaccggaucguggcccgacggugcggauauuaaucugaugccuauauga

SEQ ID NO: 137163 - RNA, 1410 nt, Artificial Sequence; identical to SEQ ID NO: 137129
  derived and/or modified sequence opt3 from neuraminidase__InfluenzaA__ABG47876

SEQ ID NO: 137164 - RNA, 1410 nt, Artificial Sequence; identical to SEQ ID NO: 137129
  derived and/or modified sequence opt3 from neuraminidase__InfluenzaA__ABG47887

SEQ ID NO: 137165 - RNA, 1410 nt, Artificial Sequence; identical to SEQ ID NO: 137116
  derived and/or modified sequence opt3 from neuraminidase__InfluenzaA__ABG47898

SEQ ID NO: 137166 - RNA, 1410 nt, Artificial Sequence; identical to SEQ ID NO: 137129
  derived and/or modified sequence opt3 from neuraminidase__InfluenzaA__ABG47909

SEQ ID NO: 137167 - RNA, 1410 nt, Artificial Sequence; identical to SEQ ID NO: 137117
  derived and/or modified sequence opt3 from neuraminidase__InfluenzaA__ABG47920

SEQ ID NO: 137168 - RNA, 1410 nt, Artificial Sequence; identical to SEQ ID NO: 137117
  derived and/or modified sequence opt3 from neuraminidase__InfluenzaA__ABG47931

SEQ ID NO: 137169 - RNA, 1410 nt, Artificial Sequence; identical to SEQ ID NO: 137117
  derived and/or modified sequence opt3 from neuraminidase__InfluenzaA__ABG47942

SEQ ID NO: 137170 - RNA, 1410 nt, Artificial Sequence
  derived and/or modified sequence opt3 from neuraminidase__InfluenzaA__ABG47953
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaucaaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccuggcaagugcuaccaauucgcucucgggcagggaacgacucugaacaaucgacauucaaacgauaccgugcacgaccguacaccauauagaacucuucugaugaaugaauugggcguucccuuucaucucgguaccaaacagguguguaucgccuggagcaguuccucuugccacgaugggaaggcauggcugcaugucugugugacaggacacgacgagaacgccaccgcuagcuucauuuacgauggcaggcugguagacuccaucggcucauggaguaaaaauauccuccggacgcaggaaagcgagugcguuuguauuaacgggacuugcacaguggucaugaccgauggaucugcauccgagcgcgccgacacuaagauauuauuuaucgaagaggguaaaauugugcacaucucaccucugagcggcagugcucaacauguggaagagugcucuuguuauccaagauacccgggggucaggugcguuugucgggauaauuggaagggauccaaccgccccauaguggacauuaacguaaaggauuacagcaucgugucgucuuaugucugcuccggccuugugggugacacaccucgaaagaaugacucaaguagcuccucuuacuguagaaacccaaauaacgaaaaagggagccacggaguuaaaggcugggccuucgaugacggcaaugauguguggauggggaggaccaucucagaggaguugcggaguggauaugaaacguuuaaggucauugguggcugguccaaacccaacagcaagcugcagaucaaucgucaggugauuguagaccgcgggaacagaucuggauacucaggcauauucaguguugaggguaaaagcugcaucaauagguguuuuuauguggaacuaauucgggggcgaaagcaggagaccgaagucugguggacauccaacucuaucguggucuucugcggcacuucgggaaccuacggcacagggagcuggccugauggagcgaauaucaaccucaugccaauuuga

SEQ ID NO: 137171 - RNA, 1410 nt, Artificial Sequence
  derived and/or modified sequence opt3 from neuraminidase__InfluenzaA__ABG47964
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaguggacauuaauguaaaggauuacuccaucgugagcucguaugucugcucuggccuugugggugacacaccucggaaaaacgacuccucaaguagcuccuacugucagaauccaaacaaugaaaaggggucucacggaguuaaaggcugggccuucgaugacggcaacgauguguggauggggagaaccaucagcgaggaguugaggucaggauaugaaacguuuaaggucauugguggcuggaguaaacccaauuccaagcugcagaucaaccgacaggugauuguagaccgugggaaucgcagcggauacucuggcauauucucaguugaggguaaaaguugcaucaacagauguuuuuauguggaacuaauuagggggcggaagcaagagaccgaagucugguggacaagcaauuccaucguggucuucugcggcacuucuggaaccuacggcacagggucguggccugauggagcggacaucaaccucaugccaauuuga

SEQ ID NO: 137172 - RNA, 1410 nt, Artificial Sequence
  derived and/or modified sequence opt3 from neuraminidase__InfluenzaA__ABG47975
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaucaaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccuggcaagugcuaccaauucgcucucgggcagggaacgacucugaacaaucgacauucaaacgauaccgugcacgaccguacaccauauagaacucuucugaugaaugaauugggcguucccuuucaucucgguaccaaacagguguguaucgccuggagcaguuccucuugccacgaugggaaggcauggcugcaugucugugugacaggacacgacgagaacgccaccgcuagcuucauuuacgauggcaggcugguagacuccaucggcucauggaguaaaaauauccuccggacgcaggaaagcgagugcguuuguauuaacgggacuugcacaguggucaugaccgauggaucugcauccgagcgcgccgacacuaagauauuauuuaucgaagaggguaaaauugugcacaucucaccucugagcggcagugcucaacauguggaagagugcucuuguuauccaagauacccgggggucaggugcguuugucgggauaauuggaagggauccaaccgccccauaguggacauuaacguaaaggauuacagcaucgugucgucuuaugucugcuccggccuugugggugacacaccucgaaagaaugacucaaguagcuccucuuacuguagagauccaaacaaugaaagggggagccacggaguuaaaggcugggccuucgacgauggcaacgacguguggauggggcggaccaucucagaggaguugcguaguggauaugaaacguuuaaagucauugguggcugguccaagcccaauagcaaacugcagaucaaccgccaggugauuguagauagagggaauaggucuggauacucaggcauauucaguguugaggguaagagcugcaucaaccgguguuuuuauguggaacuaauucgagggcgcaaacaggagaccgaagucugguggacauccaauucuaucguggucuucugcggcacuucgggaaccuacggcacagggagcuggccugacggagcggauaucaaccucaugccaauuuga

SEQ ID NO: 137173 - RNA, 1410 nt, Artificial Sequence
  derived and/or modified sequence opt3 from neuraminidase__InfluenzaA__ABG47986
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaucaaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccuggcaagugcuaccaauucgcucucgggcagggaacgacucugaacaaucgacauucaaacgauaccgugcacgaccguacaccauauagaacucuucugaugaaugaauugggcguucccuuucaucucgguaccaaacagguguguaucgccuggagcaguuccucuugccacgaugggaaggcauggcugcaugucugugugacaggacacgacgagaacgccaccgcuagcuucauuuacgauggcaggcugguagacuccaucggcucauggaguaaaaauauccuccggacgcaggaaagcgagugcguuuguauuaacgggacuugcacaguggucaugaccgauggaucugcauccgagcgcgccgacacuaagauauuauuuaucgaagaggguaaaauugugcacaucucaccucugagcggcagugcucaacauguggaagagugcucuuguuauccaagauacccgggggucaggugcguuugucgggauaauuggaagggauccaaccgccccauaguggacauuaacguaaaggauuacagcaucgugucgucuuaugucugcuccggccuugugggugacacaccucgaaagaaugacucaaguagcuccucuuacuguagaaaaccaaacaaugaaaaagggagccacggaguuaagggcugggccuucgaugacggcaacgauguguggauggggaggaccaucucagaggaguugcggaguggauaugaaacguuuaaagucauugguggcugguccaagcccaauagcaaacugcagaucaaccgucaggugauuguagaccgcgggaauagaucuggauacucaggcauauucaguguugaggguaagagcugcaucaacagguguuuuuauguggaacuaauucgggggcgaaagcaggagaccgaagucugguggacauccaauucuaucguggucuucugcggcacuucgggaaccuacggcacagggagcuggccugauggagcggacaucaaccucaugccaauuuga

SEQ ID NO: 137174 - RNA, 1410 nt, Artificial Sequence; identical to SEQ ID NO: 137117
  derived and/or modified sequence opt3 from neuraminidase__InfluenzaA__ABG47997

SEQ ID NO: 137175 - RNA, 1410 nt, Artificial Sequence
  derived and/or modified sequence opt3 from neuraminidase__InfluenzaA__ABG48008
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaucaaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccuggcaagugcuaccaauucgcucucgggcagggaacgacucugaacaaucgacauucaaacgauaccgugcacgaccguacaccauauagaacucuucugaugaaugaauugggcguucccuuucaucucgguaccaaacagguguguaucgccuggagcaguuccucuugccacgaugggaaggcauggcugcaugucugugugacaggacacgacgagaacgccaccgcuagcuucauuuacgauggcaggcugguagacuccaucggcucauggaguaaaaauauccuccggacgcaggaaagcgagugcguuuguauuaacgggacuugcacaguggucaugaccgauggaucugcauccgagcgcgccgacacuaagauauuauuuaucgaagaggguaaaauugugcacaucucaccucugagcggcagugcucaacauguggaagagugcucuuguuauccaagauacccgggggucaggugcguuugucgggauaauuggaagggauccaaccgccccauaguggacauuaacguaaaggauuacagcaucgugucgucuuaugucugcuccggccuugugggugacacaccucgaagaaaugacucaaguagcuccucuuacuguaggaaaccaaacaaugaaaaggggagccacggaguuaaaggcugggccuucgaugacggcaacgauguguggauggggcggaccaucucagaggaguugcguaguggauaugaaacguuuaaggucauugguggcugguccaaacccaauagcaagcugcagaucaaccgccaggugauuguagacagagggaauaggucuggauacucaggcauauucaguguugaggguaaaagcugcaucaaccgguguuuuuauguggaacuaauucgagggcgcaagcaggagaccgaagucugguggacauccaauucuaucguggucuucugcggcacuucgggaaccuacggcacagggagcuggccugauggagcggacaucaaccucaugccaauuuga

SEQ ID NO: 137176 - RNA, 1410 nt, Artificial Sequence
  derived and/or modified sequence opt3 from neuraminidase__InfluenzaA__ABG48019
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaucaaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccuggcaagugcuaccaauucgcucucgggcagggaacgacucugaacaaucgacauucaaacgauaccgugcacgaccguacaccauauagaacucuucugaugaaugaauugggcguucccuuucaucucgguaccaaacagguguguaucgccuggagcaguuccucuugccacgaugggaaggcauggcugcaugucugugugacaggacacgacgagaacgccaccgcuagcuucauuuacgauggcaggcugguagacuccaucggcucauggaguaaaaauauccuccggacgcaggaaagcgagugcguuuguauuaacgggacuugcacaguggucaugaccgauggaucugcauccgagcgcgccgacacuaagauauuauuuaucgaagaggguaaaauugugcacaucucaccucugagcggcagugcucaacauguggaagagugcucuuguuauccaagauacccgggggucaggugcgccugucgggauaauuggaagggauccaaccgccccauaguugacauuaacgugaaggauuacagcaucguaucgucuuaugugugcuccggccuugucggugacacaccucgaaagaaugacucaaguagcuccucuuacuguagaaacccaaauaacgaaaaagggagccacggagugaaaggcugggcguucgaugacggcaaugauguuuggauggggaggaccaucucagaggaguugcggaguggauaugaaacguuuaaggugauugguggcugguccaaacccaacagcaagcugcagaucaaucgucaggucauuguggaccgcgauaacagaucuggguacucaggaauauucaguguagagggcaaaagcugcaucaauagguguuuuuauguugaacuaauucggggucgaaagcaggagaccgaagugugguggacauccaacucuaucgucguguucugcgggacuucgggcaccuacggaacaggcagcuggccugacggggcagauaucaaucucaugccaauuuga

SEQ ID NO: 137177 - RNA, 1410 nt, Artificial Sequence; identical to SEQ ID NO: 137117
  derived and/or modified sequence opt3 from neuraminidase__InfluenzaA__ABG48030

SEQ ID NO: 137178 - RNA, 1410 nt, Artificial Sequence; identical to SEQ ID NO: 137117
  derived and/or modified sequence opt3 from neuraminidase__InfluenzaA__ABG48041

SEQ ID NO: 137179 - RNA, 1413 nt, Artificial Sequence; identical to SEQ ID NO: 136844
  derived and/or modified sequence opt3 from neuraminidase__InfluenzaA__ABG48052

SEQ ID NO: 137180 - RNA, 1410 nt, Artificial Sequence; identical to SEQ ID NO: 136746
  derived and/or modified sequence opt3 from neuraminidase__InfluenzaA__ABG48063

SEQ ID NO: 137181 - RNA, 1410 nt, Artificial Sequence; identical to SEQ ID NO: 136869
  derived and/or modified sequence opt3 from neuraminidase__InfluenzaA__ABG48074

SEQ ID NO: 137182 - RNA, 1410 nt, Artificial Sequence; identical to SEQ ID NO: 136170
  derived and/or modified sequence opt3 from neuraminidase__InfluenzaA__ABG48085

SEQ ID NO: 137183 - RNA, 1410 nt, Artificial Sequence
  derived and/or modified sequence opt3 from neuraminidase__InfluenzaA__ABG48107
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagacgcuccggacucaggaaucagagugcguuuguaucaacgggacaugcaccguggucaugacugacggaagcgcaucugguaaagccgauacaaagauuuuauuuauagaggaaggcaaaaucgugcacauuuccacccugucagggagcgcucaacacguggaggaaugcaguuguuauccucgcuacccaggagucagaugcguuuguagggacaacuggaagggcucuaaucggccgaucguggauauaaacguaaaggacuacuccauugugagcucguaugucugcucuggucuugugggggacacgccccgcaaaaaugauuccuucucaaguagccauuguuuggacccuaacaaugaggaaggaggccacggcguuaaggggugggccuuugaugacggaaacgauguguggaugggucgaaccaucuccgagaaacugagaucuggcuacgagacauucaaggucaucgaaggguggagcaaaccaaauucaaagcuacagauuaacaggcaagugaucguagagcggggaaaucguaguggcuauuccgguauuuuuagcguugaagggaaaucuugcauaaaccgcuguuucuacguggagcucaucagaggcaggaaggaagagacugaggucugguggaccucaaauaguauuguggucuuuugcggaacaagcggcacuuaugggaccggauccuggcccgacggugcggauaucaaccugaugccuaucuga

SEQ ID NO: 137184 - RNA, 1410 nt, Artificial Sequence; identical to SEQ ID NO: 136182
  derived and/or modified sequence opt3 from neuraminidase__InfluenzaA__ABG48118

SEQ ID NO: 137185 - RNA, 1410 nt, Artificial Sequence; identical to SEQ ID NO: 136182
  derived and/or modified sequence opt3 from neuraminidase__InfluenzaA__ABG48129

SEQ ID NO: 137186 - RNA, 1410 nt, Artificial Sequence; identical to SEQ ID NO: 136170
  derived and/or modified sequence opt3 from neuraminidase__InfluenzaA__ABG48140

SEQ ID NO: 137187 - RNA, 1410 nt, Artificial Sequence; identical to SEQ ID NO: 136182
  derived and/or modified sequence opt3 from neuraminidase__InfluenzaA__ABG48151

SEQ ID NO: 137188 - RNA, 1410 nt, Artificial Sequence; identical to SEQ ID NO: 136170
  derived and/or modified sequence opt3 from neuraminidase__InfluenzaA__ABG48173

SEQ ID NO: 137189 - RNA, 1410 nt, Artificial Sequence; identical to SEQ ID NO: 136182
  derived and/or modified sequence opt3 from neuraminidase__InfluenzaA__ABG48184

SEQ ID NO: 137190 - RNA, 1410 nt, Artificial Sequence
  derived and/or modified sequence opt3 from neuraminidase__InfluenzaA__ABG48195
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacccccaggaaaaaugauuccuucucaaguagccauuguaucgacccuaacaaugaggaaggaggccacggcguuaaggggugggccuuugaugacggaaacgauguguggaugggucgaacgauuuccgagaaauugagaucuggcuacgagaccuucaaggucaucgaaggguggagcaaaccaaauucaaagcugcagacaaaccgccaggugauuguagagcggggaaaucguaguggcuauuccgguauauuuagcguugaagggaaaucuugcaucaaccgcuguuucuacguggagcuaauuagaggcaggaaggaagagacugaggucugguggaccucaaauaguaucguggucuuuugcggaacaagcggcacuuaugggaccggauccuggcccgacggugcggauaucaaccucaugccuauuuga

SEQ ID NO: 137191 - RNA, 1410 nt, Artificial Sequence
  derived and/or modified sequence opt3 from neuraminidase__InfluenzaA__ABG48206
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacugguggaguauaggaauuggucaaagccucagugcaacaucacaggguucgcaccauuuaguaaagacaauagcauacggcuauccgccggaggugauauuugggucacccgcgagcccuacgugucuugugacccugauaagugcuaucaauucgcgcucggccaggggacgacucugaacaauggacacucgaacgacaccguucaugaucgaacaccauaccguacucuucugaugaaugaauugggcgugcccuuucaccucgguaccagacaggucuguaucgcuuggucaagcaguuccugccaugacgggaaggccuggcugcacguguguguaacaggagaugacaaaaacgcaaccgccucuuucauuuauaauggcaggcugguugauagcaucggcuccuggucaaagaaaauccuccggacgcaggagagugaaugcguguguauuaacgggacuugcacagucgugaugaccgacggaagcgcuucugguaaggcagauacuaaaauauuauuuaucgaggagggcaagauugugcacaucuccacacugucagggagcgcccaacaugucgaagagugcaguuguuacccucgcuauccaggaguuagaugcguguguagggacaacuggaagggcucuaaucggccgauaguagauauuaacgugaaagacuacuccaucgucagcucguacgugugcucuggucuuguuggggacacgccccgcaagaaugauuccuucucaaguagccacuguuuggacccuaacaaugaagagggaggccauggcgugaaagggugggcuuuugaugacggaaacgaugucuggaugggucgaaccaucaaugaaaagcugagauccggcuaugagaccuucaaagugauugagggguggucuaagccaaacagcaaacuacagaucaauaggcagguaauuguugaacggggaaaccguucaggcuacagugguauauuuuccguggagggcaagagcugcaucaaucgcuguuucuaugucgaacucauuagagggaggaaggaggaaacagaggugugguggacuucuaacucaaucgucguguuuugcggaaccaguggcacauacgggacuggaagcuggcccgacggugccgauaucaaucugaugccuauuuga

SEQ ID NO: 137192 - RNA, 1410 nt, Artificial Sequence; identical to SEQ ID NO: 136607
  derived and/or modified sequence opt3 from neuraminidase__InfluenzaA__ABG48217

SEQ ID NO: 137193 - RNA, 1410 nt, Artificial Sequence; identical to SEQ ID NO: 136607
  derived and/or modified sequence opt3 from neuraminidase__InfluenzaA__ABG48228

SEQ ID NO: 137194 - RNA, 1410 nt, Artificial Sequence; identical to SEQ ID NO: 137191
  derived and/or modified sequence opt3 from neuraminidase__InfluenzaA__ABG48239

SEQ ID NO: 137195 - RNA, 1410 nt, Artificial Sequence; identical to SEQ ID NO: 136607
  derived and/or modified sequence opt3 from neuraminidase__InfluenzaA__ABG48250

SEQ ID NO: 137196 - RNA, 1410 nt, Artificial Sequence
  derived and/or modified sequence opt3 from neuraminidase__InfluenzaA__ABG48272
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgacucaaguagcuccucucauugccuugauccuaauaacgaagagggugggcacggaguuaagggcugggcuuucgacgauggcaaugacguguggauggggcgcaccauuagcgaaaaaucacgaaguggauacgagacauuuaaggucaucgaggguugguccaacccaaauagcaaauugcagauuaacagacaggugauaguagauaggggcaaucggucuggguauucaggaaucuucaguguugaaggcaagagcuguauuaaccguugcuuuuacguggagcugauccgcgguagaaaggaagagacugaaguccuauggaccuccaauucuaucguggucuucugugggacaucgggcacuuauggaaccggcagcuggcccgacggggccgauauuaaccucaugccuauauga

SEQ ID NO: 137197 - RNA, 1410 nt, Artificial Sequence
  derived and/or modified sequence opt3 from neuraminidase__InfluenzaA__ABG48294
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaucccgugccagcccacuauaaucgaaagaaacauuaccgagaucguauauuugacaaauaccacuauugaaaaggagaucuguccuaaauuaguggaauacaggaacuggaguaagccacaaugcaaaauaacaggguucgcacccuuuagcaaggacaauuccauucggcugucugccggaggugauaucugggucacccgcgagccuuaugugucgugugacccaggcaagugcuaccaguucgcgcuagggcagggaacgacucucaacaaucgacauucaaacgauaccguucacgaccguacacccuauagaacucugcuuaugaaugagcugggcgugccuuuucauuuggguaccaaacaggucuguauugcuuggagcaguuccucuugccacgaugggaaggccuggcuccauguguguguaacaggacacgacgaaaacgcaaccgccagcuucaucuacgauggcaggcugguugacuccaucggcucauggagucggaauauucugcgcacgcaagagagcgaaugcguguguauaaacgggacuugcacagucgugaugaccgauggaucugcuuccgagagagcagacacuaaaauccucuuuauugaggaagguaaggugguccacaucucaccauuaagcggcagugcccagcauguugaggaaugcucuuguuauccgagguaccccggggugcggugcguaugucgcgauaauuggaaaggauccaaccgaccuauaguggacauuaacgucaaggauuacagcaucaucucgucuuaugugugcuccggccugguuggugacacaccaagaaggaaugacucaaguagcuccucuuacugucagaaccccaauaacgagaaggggagccacggagugaaaggcugggcuuucgaugacggcaaugaugucuggauggggcggaccauuucagaggaacuucguaguggauaugagacguuuaaggugaucgguggcugguccaccccuaacagcaaauugcagauuaaucgccaaguaauaguugacucugggaacagaucaggauacaguggcaucuucagcguggaagguaaguccugcauuaauagguguuuuuaugucgagcugauccgggggcgaaaacaggaaacaaaggugugguggacuucuaacucgaucgucguguucugcggcaccagcggaacauacggcacuggguccuggccagauggagccgacauugaucuaaugcccauauga

SEQ ID NO: 137198 - RNA, 1410 nt, Artificial Sequence
  derived and/or modified sequence opt3 from neuraminidase__InfluenzaA__ABG48305
augaaccccaaucagaagaucauuauaaucggcagcgugucccugaccauugccacaaucugcuuccucaugcaaauugcuauccuugucacuacgguuacccugcacuuuaaacaguacgaguguaacucuccuccaaauaaccaggugauguugugcgaaccgacaauaaucgagagaaauauuacugaaaucguauauuuaaccaacacaaccauugagaaggaaaucugucccaaacuggcagaguacaggaauuggucaaagccucagugcaaaauaacuggguucgccccauuuaguaaggacaacagcauucggcuauccgcgggaggugauaucugggugacacgcgagcccuaugucucuugugacccuggcaagugcuaccaauucgcucucgggcagggaaccacgcugaauaaccgacauucgaaugauacugugcacgaccguaccccauauagaacacuucugaugaacgaauugggcguucccuuucaucucgguacuaaacagguguguauugccuggucaagcaguuccugccacgaugggaaggcauggcugcaugucugugugaccggacacgacgagaaugccacagcuucuuucaucuacgauggcaggcugguagacagcaucggcuccuggaguaaaaacauucuccggacccaggaaucagagugcguuuguauaaaugggacgugcacuguggucaugacagauggaagcgcaucugagcgcgccgacaccaagaucuuauuuauugaagaggguaaaaucgugcacauauccccucugucaggcagcgcucaacauguggaagagugcaguuguuauccaagauacccgggggucaggugcguuugucgggauaacuggaagggaucuaaccgccccauuguggacaucaauguaaaggauuacuccaucgugagcucguaugucugcucuggccuugugggugacacuccucgaaagaacgacuccucaaguagcuccuacuguagaaauccaaacaaugaaaaagggucucacggaguuaaaggcugggccuucgaugacggcaacgauguguggauggggaggacaauuagcgaggaguugcggucaggauaugaaaccuuuaaggucaucgguggcuggaguaaacccaauuccaagcugcagauuaaccgucaggugauaguagaccgcgggaauagaagcggauacucuggcaucuucucaguugaggguaaaaguugcauuaacagguguuuuuauguggaacuaauccgggggcgaaagcaggagacggaagucugguggaccagcaauuccaucguggucuucugcggcacaucuggaacuuacggcaccgggucguggccugauggagcggacauuaaccucaugccaauauga

SEQ ID NO: 137199 - RNA, 1410 nt, Artificial Sequence
  derived and/or modified sequence opt3 from neuraminidase__InfluenzaA__ABG48316
augaaccccaaucagaagaucauuaccauaggcagcgugucccugacagucgccacuaucugcuuccucaugcaaauugcuauccuuguuacgaccgugacacugcacuuuaaacaguacgaguguaacucuccuccaaauaaccagguaauguugugcgaaccgacuauuaucgagagaaauauaaccgaaaucguguauuuaacaaacaccacuauugagaaggaaaucugucccaaacuggcagaguacaggaauuggucaaagccucagugcaaaauuacaggguucgccccauuuaguaaggacaacagcauccggcuauccgcgggaggugauauaugggucacccgcgagcccuaugugucuugugacccuggcaagugcuaccaauucgcucucgggcagggaacgacucugaauaaccgacauucgaaugauaccguucacgaccguacaccauauagaacucuucugaugaacgaauugggcgugcccuuucaucucgguaccaaacaggucuguauugccuggucaagcaguuccugccacgaugggaaggcauggcugcauguguguguaacaggacacgacgagaaugccaccgcuucuuucaucuacgauggcaggcugguugacagcauuggcuccuggaguaaaaacauccuccggacgcaggaaucagagugcguguguaucaaugggacuugcacagucgugaugaccgauggaagcgcaucugagcgcgccgacacuaagauuuuauuuauagaagaggguaaaaucgugcacauuuccccucugucaggcagcgcucaacaugucgaagagugcaguuguuauccaagauacccggggguuaggugcgugugucgggauaacuggaagggaucuaaccgccccaucguagacauaaaugugaaggauuacuccauugucagcucguaugugugcucuggccuuguuggugacacaccucgaaagaacgacuccucaaguagcuccuacuguagaaauccaaacaaugaaaaagggucucacggagugaaaggcugggccuucgaugacggcaacgaugucuggauggggaggaccaucagcgaggaguugcggucaggauaugaaacguuuaaggugaucgguggcuggaguaaacccaauuccaagcugcagauuaaccgucagguaaucguugagcgcgggaauagaagcggauacucuggcauuuucucaguggaagguaaaaguugcauaaacagguguuuuuaugucgagcuaauccgggggcgaaagcaggaaaccgaggugugguggacaagcaauuccauugucguguucugcggcacuucuggaaccuacggcacagggucguggccugacggagcggauaucaaccucaugccaaucuga

SEQ ID NO: 137200 - RNA, 1410 nt, Artificial Sequence
  derived and/or modified sequence opt3 from neuraminidase__InfluenzaA__ABG48327
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaguggacauuaauguaaaggauuacuccaucgugagcucguaugucugcucuggccuugugggugacacaccucgaaagaacgacuccucaaguagcuccuacuguagaaauccaaacaaugaaaaagggucuaggggaguuaaaggcugggccuucgaugacggcaacgauguguggauggggcggaccaucagcgaggaguugcguucaggauaugaaacguuuaaggucauugguggcuggaguaaacccaauuccaagcugcagaucaaccgccaggugauuguagacagagggaauaggagcggauacucuggcauauucucaguugaggguaaaaguugcaucaaccgguguuuuuauguggaacuaauucgagggcgcaagcaggagaccgaagucugguggacaagcaauuccaucguggucuucugcggcacuucuggaaccuacggcacagggucguggccugauggagcggacaucaaccucaugccaauuuga

SEQ ID NO: 137201 - RNA, 1410 nt, Artificial Sequence
  derived and/or modified sequence opt3 from neuraminidase__InfluenzaA__ABG48338
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaguggacauuaauguaaaggauuacuccaucgugagcucguaugucugcucuggccuugugggugacacaccucgaaagaacgacuccucaaguagcuccuacuguagaaauccaaacaaugaaaaagggucucacggaguuaaaggcugggccuucgaugacggcaacgauguguggauggggaggaccaucagcgaggaguugcggucaggauaugaaacguuuaaggucauugguggcuggaguaaacccaauuccaagcugcagaucaaccgucaggugauuguagaccgcgggaauagaagcggauacucuggcauauucucaguugaggguaaaaguugcaucaacagguguuuuuauguggaacuaauucgggggcgaaagcaggagaccgaagucugguggacaagcaauuccaucguggucuucugcggcacuucuggaaccuacggcacagggucguggccugauggagcggacaucaaccucaugccaauuuga

SEQ ID NO: 137202 - RNA, 1410 nt, Artificial Sequence; identical to SEQ ID NO: 137201
  derived and/or modified sequence opt3 from neuraminidase__InfluenzaA__ABG48349

SEQ ID NO: 137203 - RNA, 1410 nt, Artificial Sequence
  derived and/or modified sequence opt3 from neuraminidase__InfluenzaA__ABG48360
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugucagaauugggcguucccuuucaucucgguaccaaacagguguguaucgccuggagcaguuccucuugccacgaugggaaggcauggcugcaugucugugugacaggacacgacgagaacgccaccgcuagcuucauuuacgauggcaaacugguagacuccaucggcucauggaguaagaauauccucaggacgcaggaaagcgagugcguuuguauuaacgggacuugcacaguggucaugaccgauggaucugcauccgagcgggccgacacuaaaauauuauuuaucgaagaggguaagauugugcacaucucaccucugagcggcagugcucaacauguggaagagugcucuuguuauccacgcuacccgggggucagaugcguuuguagggauaauuggaagggauccaaccggcccauaguggacauuaacguaaaagaucacagcaucgugucgucuuacgucugcuccggccuugugggugacacaccucgcaagaaugacucaaguagcuccucuuauugucgaaacccaaauaacgaaaaagggagccauggaguuaagggcugggccuucgaugacggcaaugauguguggauggggagaaccaucucagaggaguugaggaguggauacgaaacguuuaaagucauugguggcugguccaagcccaacagcaaacugcagaucaaucgucaggugauuguagaccgggggaaccgcucuggauauucaggcauauucaguguugaggguaagagcugcaucaauagauguuuuuacguggaacuaauuagggggcggaagcaggagaccgaagucugguggacauccaacucuaucguggucuucugcggcacuucgggaaccuauggcacagggagcuggccugauggagcggacaucaaucucaugccaauuuga

SEQ ID NO: 137204 - RNA, 1410 nt, Artificial Sequence; identical to SEQ ID NO: 137201
  derived and/or modified sequence opt3 from neuraminidase__InfluenzaA__ABG48371

SEQ ID NO: 137205 - RNA, 1410 nt, Artificial Sequence
  derived and/or modified sequence opt3 from neuraminidase__InfluenzaA__ABG67138
augaaccccaaucagaagaucauuaccauaggcagcgugucccugacaaucgccacuauuugcuuccucacgcaaaucgcuauucuugucaccacaguuacucugcacuuuaaacaguacgaguguaacucuccuccaucaaaucaggugauguugugcgaaccgaccacaaucgagagaaacauaaccgaaaucguauauuuaacuaauacaaccauugagaaggaaaucugucccaaacuggcagaguacaggaacuggaguaagccucagugcaaaauuacgggguucgccccauuuagcaaggacaauuccauccggcuaucugcgggaggugauauaugggugacucgcgagcccuaugucucgugugacccugauaagugcuaccaauucgcucucggccaggggaccacacugaacaaucgacauucaaacgacacugugcacgaucguaccccauauagaacacuucugaugaaugaauugggaguucccuuucaucucggcaccaaacagguguguauugccuggagcaguuccucuugccacgacgguaaggcauggcugcaugucugugugacggggcacgaugagaacgccacugcuagcuucaucuacgacggaaggcugguagauuccauuggcucauggaguaaaaagauccuccggacacaggaaagcgagugcguuuguaucaaugggaccugcacuguggucaugacagacggcucugcauccggacgcgccgauaccaaaauuuuauuuauagaggaagguaagaucgugcacauuucaccucugagcggcagugcucaacauguggaggaaugcucuuguuauccaagauacccgggggucaggugcguuugucgggacaacuggaagggauccaaucgccccaucguggauauaaacguaaaagacuacagcauugugucgucuuaugucugcuccggccuugugggugacacgccucgaaagaacgauucaaguagcuccucucacuguuugaauccaaacaaugaggaagggggacauggcguuaaaggcugggccuucgacgaugggaacgacguguggaugggaagaaccaucagcgagaagcugaggucagguuacgagacauuuaaagucaucgaaggcuggaguaagcccaauuccaaacuacagauuaaccgucaggugaucguagaucgggggaaucgcagcggauauucuggcauuuucucaguugaggguaagaguugcauaaacagauguuuuuacguggaacucaucagggggcggaagcaggagacugaagucugguggaccagcaauuccauuguggucuucugcggcacaucuggaacuuauggcaccgggucguggccugacggagcggauaucaaccugaugccaaucuga

SEQ ID NO: 137206 - RNA, 1410 nt, Artificial Sequence; identical to SEQ ID NO: 136142
  derived and/or modified sequence opt3 from neuraminidase__InfluenzaA__ABG67149

SEQ ID NO: 137207 - RNA, 1410 nt, Artificial Sequence
  derived and/or modified sequence opt3 from neuraminidase__InfluenzaA__ABG67160
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggucauggaguaagccucagugcaaaaucacaggguucgccccauuuagcaaggacaauuccauacggcuaucugcgggaggugauauuugggugacccgcgagcccuaugucucgugugacccuggcaagugcuaccaauucgcucucgggcagggaacgacucugaacaaucgacauucaaacgauaccgugcacgaccguacaccauauagaacucuucugaugaaugaauugggcguucccuuucaucucgguaccaaacagguguguaucgccuggagcaguuccucuugccacgaugggaaggcauggcugcaugucugugugacaggacacgacgagaacgccaccgcuagcuucauuuacgauggcaggcugguagacuccaucggcucauggaguaaaaauauccuccggacgcaggaaagcgagugcguuugugugaacgggacuugcacagucgugaugaccgauggaucugcauccgagcgcgccgacacuaagauuuuauuuauagaagaggguaaaaucgugcacauuucaccucugagcggcagugcucaacaugucgaagagugcucuuguuauccaagauacccggggguuaggugcgugugucgggauaauuggaagggauccaaccgccccaucguagacauaaacgugaaggauuacagcauugucucgucuuaugugugcuccggccuuguuggugacacaccucgaaagaaugacucaaguagcuccucuuacuguuggaacccaaauaacgaaaaagggggacacggcgugaaaggcugggccuucgaugacgggaaugaugucuggaugggaagaaccaucagcgaggaguugaggucagguuaugaaacguuuaaggugaucggcggguggaguaaacccaacuccaagcugcagauuaaucggcagguaaucguugaccguggaaaccgcagcggcuacucugguauuuucucaguggaggggaaaaguugcauaaauagauguuuuuaugucgaacuaaucaggggccggaagcaggagaccgaagugugguggacaagcaacuccauugucguguucugcggaacuucuggcaccuacgggacaggaucguggccugauggugcggacaucaaucucaugccaaucuga

SEQ ID NO: 137208 - RNA, 1410 nt, Artificial Sequence
  derived and/or modified sequence opt3 from neuraminidase__InfluenzaA__ABG67171
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacaaaaaugccaccgcuucuuucauuuacgauggcaggcugguagacagcaucggcuccuggucaaagaacauccuccggacgcaggagagugaaugcguuuguauuaaugggacuugcacaguggucaugaccgauggaagcgcaucugaccgcgccgauacuaaaauauuauuuaucgaggaggguaagauugugcacaucuccccucugucaggcagcgcucaacauguggaagagugcaguuguuauccaagauacccgggggucaggugcguuugucgggacaacuggaagggaucuaaccgccccauaguggauauuaauguaaaagacuacuccaucgugagcucguaugucugcucuggccuugugggugacacaccucgaaagaacgauuccucaaguagcuccuacuguuggaauccaaacaaugaaaaagggggacacggcguuaagggcugggccuucgacgaugggaacgacguguggaugggaagaaccaucucugaggaaagcaggucagguuaugagacguuuaaagucauuggcggguggaguaagcccaauuccaaauugcagaucaaccgucaggugauuguagaucggggaaaucgcagcggcuacucugguauauucucaguugaggggaagaguugcaucaacagauguuuuuauguggaacugauuaggggccggaagcaggagaccgaagucugguggacaagcaauuccaucguggucuucugcggaacuucuggcaccuacgggacaggaucguggccugacggugcggauaucaaccuaaugccaauuuga

SEQ ID NO: 137209 - RNA, 1410 nt, Artificial Sequence; identical to SEQ ID NO: 137129
  derived and/or modified sequence opt3 from neuraminidase__InfluenzaA__ABG67182

SEQ ID NO: 137210 - RNA, 1410 nt, Artificial Sequence
  derived and/or modified sequence opt3 from neuraminidase__InfluenzaA__ABG67193
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaccaucgagagaaauauaacagaaaucguauauuuaaccaacacuacaauugagaaggaaaucugucccaaacuggcagaguacaggaauuggucaaagccucagugcaaaauuaccggguucgccccauuuaguaaggacaacagcauccggcuauccgcgggaggugauauaugggugacgcgcgagcccuaugucucuugugacccuggcaagugcuaccaauucgcucucgggcagggaacuacccugaauaaccgacauucgaaugauacagugcacgaccguacuccauauagaacccuucugaugaacgaauugggcguucccuuucaucucgguacaaaacagguguguauugccuggucaagcaguuccugccacgaugggaaggcauggcugcaugucugugugaccggacacgacgagaaugccacggcuucuuucaucuacgauggcaggcugguagacagcauuggcuccuggucaaagaacauccuccggacucaggaaagugagugcguuuguaucaaugggacaugcaccguggucaugacugauggaagcgcaucugaccgcgccgauacaaagauuuuauuuauagaggaagguaaaaucgugcacauuuccccucugucaggcagcgcucaacauguggaggaaugcaguuguuauccaagauacccgggggucaggugcguuugucgggacaacuggaagggaucuaaccgccccaucguggauauaaauguaaagaacuacuccauugugagcucguaugucugcucuggccuugugggugacaccccucggaaaaaugacuccucaaguagcuccuacuguuggaacccaaauaacgagaaagggggacacggcguuaaaggcugggccuucgaugacgggaaugauguguggaugggaagaacgaucucugaagagagcaggucagguuaugagaccuuuaaggucaucggcggguggaguaaacccaacuccaaguugcagauuaaucgacaggugaucguagaccguggaaaccgcagcggcuacucugguauuuucucaguugaagggaaaaguugcauaaauagauguuuuuauguggagcugaucaggggccggaagcaggaaacagaggucugguggacuagcaacuccauuguggucuucugcggaaccucuggcacauacgggacuggaucguggccugauggugcggacaucaaucuaaugccaaucuga

SEQ ID NO: 137211 - RNA, 1410 nt, Artificial Sequence; identical to SEQ ID NO: 137129
  derived and/or modified sequence opt3 from neuraminidase__InfluenzaA__ABG67204

SEQ ID NO: 137212 - RNA, 1410 nt, Artificial Sequence
  derived and/or modified sequence opt3 from neuraminidase__InfluenzaA__ABG67215
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaucaaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucguguggcccugggaagugcuaccaauucgcucucggacagggcacgacucugaacaaucgacauucaaacgacaccgugcacgaucguacaccauauagaacucuucugaugaaugaauuggguguucccuuucaucucgggaccaaacagguguguaucgccuggagcaguuccucuugccacgacggaaaggcauggcugcaugucugugugacaggccacgaugagaacgccaccgcuagcuucauuuacgacggcaggcugguagauuccaucgggucauggaguaaaaauauccuccggacgcaggaaagcgagugcguuuguauuaacggaacuugcacaguggucaugaccgacgguucugcauccgagcgcgccgauacuaagauauuauuuaucgaagagggcaaaauugugcacaucucaccucugagcgggagugcucaacauguggaagagugcucuuguuauccaagauacccgggagucaggugcguuugucgggacaauuggaagggcuccaaccgccccauaguggauauuaacguaaaggacuacagcaucgugucgucuuaugucugcuccggucuugugggggauacaccucgaaagaaugacucaaguagcuccucuuacuguagaaacccaaauaacgaaaaaggaagccacggcguuaaaggcugggccuucgacgaugggaaugacguguggaugggaaggaccaucucagaggaguugcggagugguuaugaaacguuuaaggucauuggcgggugguccaaacccaacagcaagcugcagaucaaucgucaggugauuguagaucgcggaaacagaucuggcuacucagguauauucaguguugaggggaaaagcugcaucaauagguguuuuuauguggaacuaauucggggccgaaagcaggagaccgaagucugguggacauccaacucuaucguggucuucugcggaacuucgggcaccuacgggacaggaagcuggccugacggugcggauaucaaucucaugccaauuuga

SEQ ID NO: 137213 - RNA, 1410 nt, Artificial Sequence; identical to SEQ ID NO: 137117
  derived and/or modified sequence opt3 from neuraminidase__InfluenzaA__ABG67226

SEQ ID NO: 137214 - RNA, 1410 nt, Artificial Sequence; identical to SEQ ID NO: 137117
  derived and/or modified sequence opt3 from neuraminidase__InfluenzaA__ABG67248

SEQ ID NO: 137215 - RNA, 1413 nt, Artificial Sequence; identical to SEQ ID NO: 136844
  derived and/or modified sequence opt3 from neuraminidase__InfluenzaA__ABG67480

SEQ ID NO: 137216 - RNA, 1413 nt, Artificial Sequence; identical to SEQ ID NO: 136412
  derived and/or modified sequence opt3 from neuraminidase__InfluenzaA__ABG67494

SEQ ID NO: 137217 - RNA, 1410 nt, Artificial Sequence; identical to SEQ ID NO: 136170
  derived and/or modified sequence opt3 from neuraminidase__InfluenzaA__ABG67505

SEQ ID NO: 137218 - RNA, 1410 nt, Artificial Sequence; identical to SEQ ID NO: 136170
  derived and/or modified sequence opt3 from neuraminidase__InfluenzaA__ABG67516

SEQ ID NO: 137219 - RNA, 1410 nt, Artificial Sequence; identical to SEQ ID NO: 137183
  derived and/or modified sequence opt3 from neuraminidase__InfluenzaA__ABG67527

SEQ ID NO: 137220 - RNA, 1410 nt, Artificial Sequence
  derived and/or modified sequence opt3 from neuraminidase__InfluenzaA__ABG67538
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaccaucgagagaaauacaaccgaaauaguauauuuaacuaacacaaccaucgagaaggaaauuugucccaaacuggcagaguacaggaauuggucaaagccucagugcaacaucacgggguucgccccauuuaguaaagacaauagcauucggcuauccgcgggaggugauaucugggugacucgcgagcccuaugucucuugugacccugauaagugcuaccaauucgcucucggccaggggaccacacugaacaauggacauucgaacgacacugugcacgaucgaaccccauaucguacacuucugaugaaugaauugggcguucccuuucaucucgguaccagacagguguguauagccuggucaagcaguuccugccacgacgggaaggcauggcugcaugucugugugacgggagaugacgagaacgccacugcuucuuucauuuacaauggcaggcugguagauagcaucggcuccuggaguaaaaagauucuccggacacaggaaucagagugcguuuguaucaacgggaccugcacuguggucaugacagacggaagcgcaucugguaaagccgauaccaagaucuuauuuauugaggaaggcaaaauagugcacaucuccacgcugucagggagcgcucaacacguggaggaaugcaguuguuauccucgcuacccaggagucagaugcguuuguagggacaacuggaagggcucuaaucggccgauuaucgauauaaacgugaaggacuacuccauuguaagcucguaugugugcucuggucuugucggggacacaccccgcaaaaaugauuccuucucaaguagccauuguuuggacccuaacaaugaggaaggaggccacggcgugaaggggugggccuuugaugacggaaacgauguuuggaugggucgaaccaucuccgagaaacugagaucuggcuacgagacuuucaaggugaucgaaggguggagcaaaccaaauucaaagcuacagaccaacaggcaggucauuguggagcggggaaaucguaguggcuauuccgguaucuuuagcguagaagggaaaucuugcauuaaccgcuguuucuacguugagcucauaagaggcaggaaggaagagacagaggugugguggacuucaaauaguaucgucguguuuugcggaaccagcggcacauaugggaccggauccuggcccgacggugcggauauuaaccugaugccuaucuga

SEQ ID NO: 137221 - RNA, 1410 nt, Artificial Sequence
  derived and/or modified sequence opt3 from neuraminidase__InfluenzaA__ABG67549
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacugguggaguauaggaauuggucaaagccucagugcaacaucacaggguucgcaccauuuaguaaagacaauagcauacggcuauccgccggaggugauauuugggucacccgcgagcccuacgugucuugugacccugauaagugcuaucaauucgcgcucggccaggggacgacucugaacaauggacacucgaacgacaccguucaugaucgaacaccauaccguacucuucugaugaaugaauugggcgugcccuuucaccucgguaccagacaggucuguaucgcuuggucaagcaguuccugccaugacgggaaggccuggcugcacguguguguaacaggagaugacaaaaacgcaaccgccucuuucauuuauaauggcaggcugguugauagcaucggcuccuggucaaagaaaauccuccggacgcaggagagugaaugcguguguauuaacgggacuugcacagucgugaugaccgacggaagcgcuucugguaaggcagauacuaaaauauuauuuaucgaggagggcaagauugugcacaucuccacacugucagggagcgcccaacaugucgaagagugcaguuguuacccucgcuauccaggaguuagaugcguguguagggacaacuggaagggcucuaaucggccgauaguagauauuaacgugaaagacuacuccaucgucagcucguacgugugcucuggucuuguuggggacacgccccgcaagaaugauuccuucucaaguagccacuguuuggacccuaacaaugaagagggaggccauggcgugaaagggugggcuuuugaugacggaaacgaugucuggaugggucgaaccaucuccgaaaagcugagaucuggcuaugagaccuucaaagugauugagggguggagcaagccaaauucaaaacuacagaucaacaggcagguaauuguugaacggggaaaucguaguggcuacuccgguauauuuagcguggaggggaagucuugcaucaaccgcuguuucuaugucgaacucauuagaggcaggaaggaggaaaaugaggugugguggacaucaaacaguaucgucguguuuugcggaacuagcggcaccuacgggacaggauccuggcccgacggugccgauaucaaucugaugccuauuuga

SEQ ID NO: 137222 - RNA, 1410 nt, Artificial Sequence; identical to SEQ ID NO: 136607
  derived and/or modified sequence opt3 from neuraminidase__InfluenzaA__ABG67560

SEQ ID NO: 137223 - RNA, 1410 nt, Artificial Sequence; identical to SEQ ID NO: 136607
  derived and/or modified sequence opt3 from neuraminidase__InfluenzaA__ABG67571

SEQ ID NO: 137224 - RNA, 1410 nt, Artificial Sequence
  derived and/or modified sequence opt3 from neuraminidase__InfluenzaA__ABG67582
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacugguggaguauaggaauuggucaaagccucagugcaacaucacaggguucgcaccauuuaguaaagacaauagcauacggcuauccgccggaggugauauuugggucacccgcgagcccuacgugucuugugacccugauaagugcuaucaauucgcgcucggccaggggacgacucugaacaauggacacucgaacgacaccguucaugaucgaacaccauaccguacucuucugaugaaugaauugggcgugcccuuucaccucgguaccagacaggucuguaucgcuuggucaagcaguuccugccaugacgggaaggccuggcugcacguguguguaacaggagaugacaaaaacgcaaccgccucuuucauuuauaauggcaggcugguugauagcaucggcuccuggucaaagaaaauccuccggacgcaggagagugaaugcguguguauuaacgggacuugcacagucgugaugaccgacggaagcgcuucugguaaggcagauacuaaaauauuauuuaucgaggagggcaagauugugcacaucuccacacugucagggagcgccaagcaugucgaagagugcaguuguuacccucgcuauccaggaguuagaugcguguguagggacaacuggaaaggcucuaaucggccgauaguagauauuaacgugaaggacuacuccaucgucagcucguacgugugcucuggucuuguuggggacacgccccgcaaaaaugauuccuucucaaguagccacuguuuggacccuaacaaugaagagggaggccauggcgugaaggggugggcuuuugaugacggaaacgaugucuggaugggucgaaccaucuccgaaaaacugagaucuggcuaugagaccuucaaggugauugagggguggagcaaaccaaauucaaagcuacaaaucaacaggcagguaauuguugaacggggaaaucguaguggcuacuccgguauauuuagcguggaggggaagucuugcaucaaccgcuguuucuaugucgaacucauuagaggcaggaaagaggaaacagaggugugguggacuucaaauaguaucgucguguuuugcggaaccagcggcacauacgggacuggauccuggcccgacggugccgauaucaaccugaugccuauuuga

SEQ ID NO: 137225 - RNA, 1410 nt, Artificial Sequence; identical to SEQ ID NO: 137191
  derived and/or modified sequence opt3 from neuraminidase__InfluenzaA__ABG67593

SEQ ID NO: 137226 - RNA, 1410 nt, Artificial Sequence; identical to SEQ ID NO: 136607
  derived and/or modified sequence opt3 from neuraminidase__InfluenzaA__ABG67604

SEQ ID NO: 137227 - RNA, 1410 nt, Artificial Sequence; identical to SEQ ID NO: 136607
  derived and/or modified sequence opt3 from neuraminidase__InfluenzaA__ABG67615

SEQ ID NO: 137228 - RNA, 1410 nt, Artificial Sequence; identical to SEQ ID NO: 136607
  derived and/or modified sequence opt3 from neuraminidase__InfluenzaA__ABG67626

SEQ ID NO: 137229 - RNA, 1410 nt, Artificial Sequence; identical to SEQ ID NO: 136607
  derived and/or modified sequence opt3 from neuraminidase__InfluenzaA__ABG67637

SEQ ID NO: 137230 - RNA, 1410 nt, Artificial Sequence; identical to SEQ ID NO: 136607
  derived and/or modified sequence opt3 from neuraminidase__InfluenzaA__ABG67648

SEQ ID NO: 137231 - RNA, 1410 nt, Artificial Sequence
  derived and/or modified sequence opt3 from neuraminidase__InfluenzaA__ABG67659
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacugguggaguauaggaauuggucaaagccucagugcaacaucacaggguucgcaccauuuagucgggacaauagcauacgccuauccgccggaggugauauuugggucacccgagagcccuacgugucuugugacccugauaaaugcuaucaauucgcgcucggccaggggacgacucugaacaauggacacucgaacgacaccguucaugaucguacaccauacagaacucuucugaugaaugaauugggcgugcccuuucaccucgguaccaggcaggucuguaucgcuuggucaagcaguuccugccaugacgggaaggccuggcugcacguguguguaacaggagaugacaagaacgcaaccgccucuuucauuuauaauggccggcugguugauagcaucggcuccuggaguaaaaagauccuccgcacgcaggagucagaaugcguguguauuaacgggacuugcacagucgugaugaccgacggaagcgcuucugguaaagcagauacuaagauauuauuuaucgaggagggcaaaauugugcacaucuccacacugucagggagcgcccaacaugucgaagagugcaguuguuacccuagauauccaggaguuaggugcgugugucgggacaacuggaagggcucuaaucgcccgauaguagauauuaacgugaaggacuacuccaucgucagcucguacgugugcucuggucuuguuggggacacccccagaaagaaugauuccuucucaaguagccacuguuuggacccuaacaaugaagagggaggccauggcgugaaagggugggcuuuugaugacggaaacgaugucuggaugggucgaacgaucuccgaaaaacugaggucuggcuaugagaccuucaaggugauugagggguggagcaaaccaaauucaaagcuacagaucaaccggcagguaauuguugaacguggaaaucgcaguggcuacuccgguauauuuagcguggaggggaaaucuugcaucaacagauguuucuaugucgaacucauuaggggccggaaggaggaaacagaggugugguggacuucaaauaguaucgucguguuuugcggaaccagcggcacauacgggacuggauccuggcccgacggugccgauaucaaccugaugccuauuuga

SEQ ID NO: 137232 - RNA, 1410 nt, Artificial Sequence
  derived and/or modified sequence opt3 from neuraminidase__InfluenzaA__ABG67670
augaaccccaaucagaagaucauuaccauaggcagcgugucccugacaaucgccacuauuugcuuccucaugcaaaucgcuauucuuaucacgaccgucacacugcacuuuaaacaguacgaguguaacucuccuccaaauaaccagguuauguugugcgaaccgacuauaaucgagagaaauauuaccgaaaucguguauuuaacaaacaccacuauugagaaggaaaucugucccaaacuggcagaguacaggaauuggucaaagccucagugcaaaauaacaggguucgccccauuuaguaaggacaacagcauucggcuauccgcgggaggugauaucuggguaacccgcgagcccuaugugucuugugacccuggcaagugcuaccaauucgcucucgggcagggaacgacucugaauaaccgacauucgaaugauaccguccacgaccguacaccauauagaacucuucugaugaacgaauugggcgugcccuuucaucucgguaccaaacagguuuguauugccuggucaagcaguuccugccacgaugggaaggcauggcugcaugugugugucacaggacacgacgagaaugccaccgcuucuuucaucuacgauggcaggcugguggacagcaucggcuccuggaguaaaaacauucuccggacgcaggaaucagagugcguauguauaaaugggacuugcacaguugugaugaccgauggaagcgcaucuggucgcgccgacacuaagaucuuauuuauugaggaaggcaaaaucguccacauauccccucugucagggagcgcucaacauguggaggaaugcaguuguuauccaagauacccgggagugaggugcgucugucgggauaacuggaagggcucuaaccgccccauuguugacaucaaugugaaggauuacuccaucguaagcucguaugugugcucuggucuugucggggacacaccucgaaagaacgacuccucaaguagcucccacuguuugaauccaaacaaugaggaaggaggccauggcgugaaagggugggccuucgaugacggaaacgauguuuggauggguagaaccauuucugagaaacugaggagcggcuacgagacguuuaaggugaucgggggauggucaaaacccaauaguaagcuacagauuaaccggcaggucauaguggaccguggcaaucgcuccgguuauagcgggaucuucucuguagaaggcaaaucaugcauuaacagauguuuuuacguugagcucaucaggggacggaagcaggaaaccgaggugugguggacaaguaauagcaucgucguguucugcggcacuuccgggaccuauggaacagguucuuggccugauggcgcggacauuaaccugaugccaauauga

SEQ ID NO: 137233 - RNA, 1410 nt, Artificial Sequence; identical to SEQ ID NO: 136746
  derived and/or modified sequence opt3 from neuraminidase__InfluenzaA__ABG79944

SEQ ID NO: 137234 - RNA, 1413 nt, Artificial Sequence; identical to SEQ ID NO: 137075
  derived and/or modified sequence opt3 from neuraminidase__InfluenzaA__ABG79955

SEQ ID NO: 137235 - RNA, 1410 nt, Artificial Sequence
  derived and/or modified sequence opt3 from neuraminidase__InfluenzaA__ABG79966
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaucaaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccuggcaagugcuaccaauucgcucucgggcagggaacgacucugaacaaucgacauucaaacgauaccgugcacgaccguacaccauauagaacucuucugaugaaugaauugggcguucccuuucaucucgguaccaaacagguguguaucgccuggagcaguuccucuugccacgaugggaaggcauggcugcaugucugugugacaggacacgacgagaacgccaccgcuagcuucauuuacgauggcaggcugguagacuccaucggcucauggaguaaaaauauccuccggacgcaggaaagcgagugcguuuguauuaacgggacuugcacaguggucaugaccgauggaucugcauccgagcgcgccgacacuaagauauuauuuaucgaagaggguaaaauugugcacaucucaccucugagcggcagugcucaacauguggaagagugcucuuguuauccaagauacccgggggucaggugcguuugucgggauaauuggaagggauccaaccgccccauaguggacauuaacguaaaggauuacagcaucgugucgucuuaugucugcuccggccuugugggugacacaccucggaaaaaugacucaaguagcuccucuuacugucagaacccaaauaacgaaaaggggagccacggaguuaaaggcugggccuucgaugacggcaaugauguguggauggggagaaccaucucagaggaguugaggaguggauaugaaacguuuaaggucauugguggcugguccaaacccaacagcaagcugcagaucaaucgacaggugauuguagaccgugggaaccgcucuggauacucaggcauauucaguguugaggguaaaagcugcaucaauagauguuuuuauguggaacuaauuagggggcggaagcaagagaccgaagucugguggacauccaacucuaucguggucuucugcggcacuucgggaaccuacggcacagggagcuggccugauggagcggacaucaaucucaugccaauuuga

SEQ ID NO: 137236 - RNA, 1410 nt, Artificial Sequence
  derived and/or modified sequence opt3 from neuraminidase__InfluenzaA__ABG79977
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggcaauguugugcgaaccgacuaucauagagagaaauaucaccgaaauuguguauuuaacaaacaccacuaucgagaaggaaauuugucccaaacuggccgaguacaggaauuggucaaagccucagugcaaaaucacaggguucgcgccauuuaguaaggacaacagcauacggcuauccgcuggaggugauauuuggguaacccgcgagcccuaugugucuugugacccuggcaagugcuaccaauucgcccucgggcagggaacgacucugaauaaccgacauucgaaugauaccguccacgaccguacaccauauagaacucuucugaugaacgaauugggcgugcccuuucaucucgguaccaaacagguuuguaucgcauggucaagcaguuccugccacgaugggaaggccuggcugcaugugugugucacaggacacgacgagaaugcuaccgcaucuuucauuuacgauggcaggcugguggacagcaucggcuccuggaguaaaaacauccuccggacgcaggaaucagagugcguauguauuaaugggacuugcacaguugugaugaccgauggaagcgccucugaccgcgcugauacuaagauauuauuuaucgaggaagguaaaauuguccacaucuccccucugucaggcagcgcccaacauguggaggaaugcaguuguuauccaagauacccgggggugaggugcgucugucgggacaacuggaagggaucuaaccgccccauaguugauauuaaugugaaggacuacuccaucguaagcucguaugugugcucuggccuugucggugacacaccucgaaagaacgauuccucaaguagcuccuacuguuggaauccaaacaaugagaaagggggacacggcgugaaaggcugggcguucgacgaugggaacgacguuuggaugggaagaaccaucucugaagagagcaggucagguuaugagacguuuaaggugauuggcggguggaguaaacccaauuccaaguugcagaucaaccggcaggucauuguggaucguggaaaucgcagcggcuacucugguauauucucaguagaagggaaaaguugcaucaacagauguuuuuauguugagcugauuaggggccggaagcaggaaaccgaggugugguggacaagcaauuccaucgucguguucugcggaacuucuggcaccuacgggacaggaucguggccugacggugcagauaucaaccuaaugccaauuuga

SEQ ID NO: 137237 - RNA, 1410 nt, Artificial Sequence; identical to SEQ ID NO: 137129
  derived and/or modified sequence opt3 from neuraminidase__InfluenzaA__ABG79988

SEQ ID NO: 137238 - RNA, 1410 nt, Artificial Sequence; identical to SEQ ID NO: 137129
  derived and/or modified sequence opt3 from neuraminidase__InfluenzaA__ABG79999

SEQ ID NO: 137239 - RNA, 1410 nt, Artificial Sequence
  derived and/or modified sequence opt3 from neuraminidase__InfluenzaA__ABG80010
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggaaaggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggucaaagaacauccuccggacgcaggaaagugagugcguuuguauuaaugggacuugcacaguggucaugaccgauggaagcgcaucugaccgcgccgauacuaaaauauuauuuaucgaggaagguaagauugugcacaucuccccucugucaggcagcgcucagcauguggaggaaugcaguuguuauccaagauacccgggggucaggugcguuugucgggacaacuggaagggaucuaaccgccccauaguggauauuaauguaaaagacuacuccaucgugagcucguaugucugcucuggccuugugggugacacaccucgaaagaacgauuccucaaguagcuccuacuguuggaauccaaacaaugagaaagggggacacggcguuaagggcugggccuucgacgaugggaacgacguguggaugggaagaaccaucucugaagagagcaggucagguuaugagacguuuaaagucauuggcggguggaguaagcccaauuccaaauugcaaaucaaccgucaggugauuguagaucggggaaaucgcagcggcuacucugguauauucucaguugaagggaagaguugcaucaacagauguuuuuauguggagcugauuaggggccggaagcaggaaaccgaggucugguggacaagcaauuccaucguggucuucugcggaacuucuggcaccuacgggacaggaucguggccugacggugcggauaucaaccuaaugccaauuuga

SEQ ID NO: 137240 - RNA, 1410 nt, Artificial Sequence; identical to SEQ ID NO: 137129
  derived and/or modified sequence opt3 from neuraminidase__InfluenzaA__ABG80021

SEQ ID NO: 137241 - RNA, 1410 nt, Artificial Sequence
  derived and/or modified sequence opt3 from neuraminidase__InfluenzaA__ABG80032
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuauuaucuacgauggcaggcugguagacagcaucuccucauggaguaaaaacauucuccggacgcaggaaagcgagugcguuuguauaaauggcacuugcacaguggucaugaccgaugggucugcauccgagcgcgccgacacuaagaucuuauucauugaagagggaaaaaucgugcacauaucaccucugagcgguagugcucaacauguggaagagugcucuuguuauccaagauacccgggcgucaggugcguuugucgggauaacuggaagggguccaaccgccccauuguggacaucaauguaaaggauuacagcaucgugucgucuuaugucugcuccggacuugugggcgacacaccucggaaaaacgacucaaguagcuccucuuacuguuugaauccaaacaaugaagagggugggcacggaguuaagggcugggccuuugaugacggcaacgauguguggauggggagaaccauuagcgagaaacugaggucaggauaugaaacguucaaggucaucgguggcuggaguaaacccaauuccaagcuacagauuaaccgacaggugauaguagaccgugggaaucgcagcggauacucuggcaucuuuucaguugaggguaaaaguugcgugaacagauguuucuaugucgaacucauuagggggcggaagcaggagaccgaagugugguggacaagcaauuccaucgucguguuuugcggcacuucuggaaccuacggcacagggucguggccugauggagcggacaucaaccugaugccaauuuga

SEQ ID NO: 137242 - RNA, 1410 nt, Artificial Sequence; identical to SEQ ID NO: 137116
  derived and/or modified sequence opt3 from neuraminidase__InfluenzaA__ABG80043

SEQ ID NO: 137243 - RNA, 1410 nt, Artificial Sequence; identical to SEQ ID NO: 137129
  derived and/or modified sequence opt3 from neuraminidase__InfluenzaA__ABG80054

SEQ ID NO: 137244 - RNA, 1410 nt, Artificial Sequence; identical to SEQ ID NO: 137116
  derived and/or modified sequence opt3 from neuraminidase__InfluenzaA__ABG80065

SEQ ID NO: 137245 - RNA, 1410 nt, Artificial Sequence
  derived and/or modified sequence opt3 from neuraminidase__InfluenzaA__ABG80076
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaguggacauuaauguaaaggauuacuccaucgugagcucguaugucugcucuggccuugugggugacacaccucgaaagaacgacuccucaaguagcuccuacuguagaaauccaaacaaugaaaaagggucucacggaguuaaaggcugggccuucgaugacggcaacgauguguggauggggaggaccaucagcgaggaguugcggucaggauaugaaacguuuaaggucauugguggcuggaguaaacccaauuccaagcugcagaucaaccgucaggugauuguagaccgcgggaauagaagcggauacucuggcauauucucaguugaggguaaaaacugcaucaauagguguuuuuauguggaacuaauucgggggcgaaagcaggagaccgaagucugguggacaaguaacagcaucguggucuucugcggcacuuccggaaccuacggcacagggucuuggccugauggagcggacaucaaucucaugccaauuuga

SEQ ID NO: 137246 - RNA, 1410 nt, Artificial Sequence
  derived and/or modified sequence opt3 from neuraminidase__InfluenzaA__ABG80087
augaaccccaaucagaagaucauuaccauaggcagcgugucccugacaaucgccacuauuugcuuccucaugcaaaucgcuguccuuguuacgaccgugacacugcacuuuaaacaguacgaguguaacucuccuccaucaaaucagguaauguugugcgaaccgacuauuaucgagagaaacauaaccgaaaucguguauuuaacaaauaccacuauugagaaggaaaucugucccaaacuggcagaguacaggaacuggaguaagccucagugcaaaauuacaggguucgccccauuuagcaaggacaauuccauccggcuaucugcgggaggugauauaugggucacccgcgagcccuaugugucgugugacccuggcaagugcuaccaauucgcucucgggcagggaacgacucugaacaaucgacauucaaacgauaccguucacgaccguacaccauauagaacucuucugaugaaugaauugggcgugcccuuucaucucgguaccaaacaggucuguauggccuggagcaguuccucuugccacgaugggaaggcauggcugcauguguguguaacaggacacgacgagaacgccaccgcuagcuucauuuacgauggcaggcugguugacuccaucggcucauggaguaaaaauauucuccggacgcaggaaagcgagugcguguguaucaacgggacuugcacagucgugaugaccgauggaucugcauccgagcgcgccgacacuaagaucuuauuuauugaagaggguaaaauagugcacaucucaccucugagcggcagugcucaacaugucgaagagugcucuuguuauccaagauacccggggguuaggugcgugugucgggauaauuggaagggauccaaccgccccauuguagacaucaacgugaaggauuacagcauagucucgucuuaugugugcuccggccuuguuggugacacaccucgaaagaaugacucaaguagcuccucuuacuguagaaacccaaauaacgaaaaagggagccacggagugaaaggcugggccuucgaugacggcaaugaugucuggauggggaggaccauuucagaggaguugcggaguggauaugaaacguuuaaggugaucgguggcugguccaaacccaacagcaagcugcagaucaaucgucagguaauuguugaccgcgggaacagaucuggauacucaggcaucuucaguguggaggguaaaagcugcauuaauagguguuuuuaugucgaacuaauacgggggcgaaagcaggagaccgaagugugguggacauccaacucuaucgucguguucugcggcacuucgggaaccuacggcacagggagcuggccugauggagcggacauuaaucucaugccaaucuga

SEQ ID NO: 137247 - RNA, 1410 nt, Artificial Sequence; identical to SEQ ID NO: 137173
  derived and/or modified sequence opt3 from neuraminidase__InfluenzaA__ABG80098

SEQ ID NO: 137248 - RNA, 1410 nt, Artificial Sequence; identical to SEQ ID NO: 137117
  derived and/or modified sequence opt3 from neuraminidase__InfluenzaA__ABG80109

SEQ ID NO: 137249 - RNA, 1410 nt, Artificial Sequence
  derived and/or modified sequence opt3 from neuraminidase__InfluenzaA__ABG80120
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaucaaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccuggcaagugcuaccaauucgcucucgggcagggaacgacucugaacaaucgacauucaaacgauaccgugcacgaccguacaccauauagaacucuucugaugaaugaauugggcguucccuuucaucucgguaccaaacagguguguaucgccuggagcaguuccucuugccacgaugggaaggcauggcugcaugucugugugacaggacacgacgagaacgccaccgcuagcuucauuuacgauggcaggcugguagacuccaucggcucauggaguaaaaauauccuccggacgcaggaaagcgagugcauuuguauaaacgggacuugcacaguugugaugaccgauggaucugcauccgagcgcgccgacacuaagaucuuauuuauugaagaggguaaaaucguccacauaucaccucugagcggcagugcucaacauguggaagagugcucuuguuauccaagauacccgggggugaggugcgucugucgggauaauuggaagggauccaaccgccccauuguugacaucaacgugaaggauuacagcaucguaucgucuuaugugugcuccggccuugucggugacacaccucgaaagaaugacucaaguagcuccucuuacuguagaaacccaaauaacgaaaaagggagccacggagugaaaggcugggccuucgaugacggcaaugauguuuggauggggaggaccauuucagaggaguugcggaguggauaugaaacguuuaaggugaucgguggcugguccaaacccaacagcaagcugcagauuaaucgucaggucauaguggaccgcgggaacagaucuggauacucaggcaucuucaguguagaggguaaaagcugcauuaauagguguuuuuauguugaacuaauccgggggcgaaagcaggagaccgaagugugguggacauccaacucuaucgucguguucugcggcacuucgggaaccuacggcacagggagcuggccugauggagcggacauuaaucucaugccaauauga

SEQ ID NO: 137250 - RNA, 1410 nt, Artificial Sequence
  derived and/or modified sequence opt3 from neuraminidase__InfluenzaA__ABG80131
augaaccccaaucagaagaucauuaccauaggcagcgugucccugacaaucgccacuauuugcuuccucaugcaaaucgcuauuauggucacgaccguuacacuucacuuuaaacaguacgaguguaacucuccuccaucaaaucaggugaugcugugcgaaccgacuaucauagagagaaacaucaccgaaauuguauauuugacaaauaccacuaucgagaaggaaauuugucccaaauuagcagaguacaggaacuggaguaagccucagugcaaaaucacaggguucgccccauuuagcaaggacaauuccauacggcugucugcgggaggugauauuugggugacccgcgagcccuaugucucgugugacccuggcaagugcuaccaauucgcucuagggcagggaacgacucucaacaaucgacauucaaacgauaccgugcacgaccguacaccauauagaacucugcuuaugaaugaacugggcguucccuuucauuuggguaccaaacagguguguaucgccuggagcaguuccucuugccacgaugggaaggcauggcuccaugucugugugacaggacacgacgagaacgccaccgcuagcuucauuuacgauggcaggcugguagacuccaucggcucauggaguaaaaauauccugcggacgcaggaaagcgagugcguuuguauuaacgggacuugcacaguggucaugaccgauggaucugcauccgagcgcgccgacacuaagauacucuuuaucgaagaggguaaaauugugcacaucucaccuuuaagcggcagugcucaacauguggaagagugcucuuguuauccaagauacccgggggucaggugcguuugucgggauaauuggaagggauccaaccgccccauaguggacauuaacguaaaggauuacagcaucgugucgucuuaugucugcuccggccuggugggugacacaccucgaaagaaugacucaaguagcuccucuuacuguagaaacccaaauaacgaaaaagggagccacggaguuaaaggcugggccuucgaugacggcaaugauguguggauggggaggaccaucucagaggagcuucggaguggauaugaaacguuuaaggucauugguggcugguccaaacccaacagcaaguugcagaucaaucgucaggugauuguagaccgcgggaacagaucuggauacucaggcauauucaguguugaggguaaaagcugcaucaauagguguuuuuauguggaacugauucgggggcgaaagcaggagaccgaagucugguggacauccaacucuaucguggucuucugcggcacuucgggaaccuacggcacagggagcuggccugauggagcggacaucaaucuaaugccaauuuga

SEQ ID NO: 137251 - RNA, 1410 nt, Artificial Sequence; identical to SEQ ID NO: 137117
  derived and/or modified sequence opt3 from neuraminidase__InfluenzaA__ABG80142

SEQ ID NO: 137252 - RNA, 1410 nt, Artificial Sequence; identical to SEQ ID NO: 137173
  derived and/or modified sequence opt3 from neuraminidase__InfluenzaA__ABG80153

SEQ ID NO: 137253 - RNA, 1410 nt, Artificial Sequence; identical to SEQ ID NO: 137117
  derived and/or modified sequence opt3 from neuraminidase__InfluenzaA__ABG80164

SEQ ID NO: 137254 - RNA, 1413 nt, Artificial Sequence; identical to SEQ ID NO: 136844
  derived and/or modified sequence opt3 from neuraminidase__InfluenzaA__ABG80186

SEQ ID NO: 137255 - RNA, 1410 nt, Artificial Sequence; identical to SEQ ID NO: 136077
  derived and/or modified sequence opt3 from neuraminidase__InfluenzaA__ABG80197

SEQ ID NO: 137256 - RNA, 1410 nt, Artificial Sequence; identical to SEQ ID NO: 136269
  derived and/or modified sequence opt3 from neuraminidase__InfluenzaA__ABG80219

SEQ ID NO: 137257 - RNA, 1410 nt, Artificial Sequence
  derived and/or modified sequence opt3 from neuraminidase__InfluenzaA__ABG80230
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaacauccuccggacgcaggaaucagagugcguuuguauuaacgggacuugcacaguggucaugaccgacggaagcgcaucugguaaggccgauacuaaaauauuauuuaucgaggaaggcaagauugugcacaucuccacacugucagagagcgcucaacacguggaagagugcaguuguuauccucgcuacccaggggucagaugcguuuguagggacaauuggaaaggaucuaaccggccgauaguggauauuaauguaaaggacuacuccaucgugagcucguaugucugcucuggccuugugggugacacccccaggaagaacgauuccuucucaaguagccauuguuuggacccuaauaacgaagaagggggacacggcguuaaaggcugggccuuugaugacgggaaugauguguggaugggacgaacgaucuccgagaagcugagaucugguuacgagaccuucaaagucauugagggcuggagcaagccaaacucaaaacuacagacaaaucgccaggugaucguagaacgggggaaccguaguggauauuccggcauuuuuagcguugaggguaagucuugcauaaaucgcuguuucuacguggaacucaucagagggaggaaagaggagacugaagucugguggaccucaaacaguauuguggucuuuugcggcacaagcggaacuuauggcaccggguccuggcccgacggagcggauaucaaucugaugccuaucuga

SEQ ID NO: 137258 - RNA, 1410 nt, Artificial Sequence; identical to SEQ ID NO: 136607
  derived and/or modified sequence opt3 from neuraminidase__InfluenzaA__ABG80241

SEQ ID NO: 137259 - RNA, 1410 nt, Artificial Sequence; identical to SEQ ID NO: 136607
  derived and/or modified sequence opt3 from neuraminidase__InfluenzaA__ABG80252

SEQ ID NO: 137260 - RNA, 1410 nt, Artificial Sequence; identical to SEQ ID NO: 137191
  derived and/or modified sequence opt3 from neuraminidase__InfluenzaA__ABG80263

SEQ ID NO: 137261 - RNA, 1410 nt, Artificial Sequence; identical to SEQ ID NO: 136752
  derived and/or modified sequence opt3 from neuraminidase__InfluenzaA__ABG80274

SEQ ID NO: 137262 - RNA, 1410 nt, Artificial Sequence; identical to SEQ ID NO: 136343
  derived and/or modified sequence opt3 from neuraminidase__InfluenzaA__ABG80285

SEQ ID NO: 137263 - RNA, 1410 nt, Artificial Sequence; identical to SEQ ID NO: 136343
  derived and/or modified sequence opt3 from neuraminidase__InfluenzaA__ABG80296

SEQ ID NO: 137264 - RNA, 1410 nt, Artificial Sequence; identical to SEQ ID NO: 136343
  derived and/or modified sequence opt3 from neuraminidase__InfluenzaA__ABG80307

SEQ ID NO: 137265 - RNA, 1410 nt, Artificial Sequence; identical to SEQ ID NO: 136730
  derived and/or modified sequence opt3 from neuraminidase__InfluenzaA__ABG80318

SEQ ID NO: 137266 - RNA, 1410 nt, Artificial Sequence; identical to SEQ ID NO: 136343
  derived and/or modified sequence opt3 from neuraminidase__InfluenzaA__ABG80329

SEQ ID NO: 137267 - RNA, 1410 nt, Artificial Sequence; identical to SEQ ID NO: 136343
  derived and/or modified sequence opt3 from neuraminidase__InfluenzaA__ABG80340

SEQ ID NO: 137268 - RNA, 1410 nt, Artificial Sequence; identical to SEQ ID NO: 137201
  derived and/or modified sequence opt3 from neuraminidase__InfluenzaA__ABG80351

SEQ ID NO: 137269 - RNA, 1410 nt, Artificial Sequence
  derived and/or modified sequence opt3 from neuraminidase__InfluenzaA__ABG80373
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaguggacauuaauguaaaggaucacuccaucgugagcucguacgucugcucuggccuugugggugacacaccucgaaagaacgacuccucaaguagcuccuauuguagaaauccaaacaaugaaaaagggucucauggaguuaaaggcugggccuucgaugacggcaacgauguguggauggggaggaccaucagcgaggaguugcggucaggauacgaaacguuuaaggucauugguggcuggaguaaacccaauuccaagcugcagaucaaccgucaggugauuguagaccgcgggaauagaagcggauauucuggcauauucucaguugaggguaaaaguugcaucaacagguguuuuuacguggaacuaauucgggggcgaaagcaggagaccgaagucugguggacaagcaauuccaucguggucuucugcggcacuucuggaaccuauggcacagggucguggccugauggagcggacaucaaccucaugccaauuuga

SEQ ID NO: 137270 - RNA, 1410 nt, Artificial Sequence; identical to SEQ ID NO: 137269
  derived and/or modified sequence opt3 from neuraminidase__InfluenzaA__ABG80384

SEQ ID NO: 137271 - RNA, 1410 nt, Artificial Sequence
  derived and/or modified sequence opt3 from neuraminidase__InfluenzaA__ABG80395
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucuaagcgcgccgacacuaaaauauuauuuaucgaggaagguaagauugugcacaucuccccucugucaggcagcgcucaacauguggaggaaugcaguuguuauccaagauacccgggggucaggugcguuugucgggauaacuggaagggaucuaaccgccccauaguggacauuaauguaaaagauuacuccaucgugagcucguaugucugcucuggccuugugggugacacaccucgaaagaacgacuccucaaguagcuccuacuguagaaauccaaacaaugagaaagggucucacggaguuaagggcugggccuucgaugacggcaacgauguguggauggggaggaccaucagcgaagaguugcggucaggauaugagacguuuaaagucauugguggcuggaguaagcccaauuccaaacugcagaucaaccgucaggugauuguagaccgcgggaauaugagcggauacucuggcauauucucaguugaagguaagaguugcaucaacagauguuuuuauguggagcuaauuagggggcggaagcaggaaaccgaggucugguggacaagcaauuccaucguggucuucugcggcacuucuggaaccuacggcacagggucguggccugauggagcggacaucaaccucaugccaauuuga

SEQ ID NO: 137272 - RNA, 1410 nt, Artificial Sequence; identical to SEQ ID NO: 137201
  derived and/or modified sequence opt3 from neuraminidase__InfluenzaA__ABG80406

SEQ ID NO: 137273 - RNA, 1410 nt, Artificial Sequence; identical to SEQ ID NO: 137201
  derived and/or modified sequence opt3 from neuraminidase__InfluenzaA__ABG80417

SEQ ID NO: 137274 - RNA, 1410 nt, Artificial Sequence; identical to SEQ ID NO: 137201
  derived and/or modified sequence opt3 from neuraminidase__InfluenzaA__ABG80428

SEQ ID NO: 137275 - RNA, 1410 nt, Artificial Sequence; identical to SEQ ID NO: 136142
  derived and/or modified sequence opt3 from neuraminidase__InfluenzaA__ABG88292

SEQ ID NO: 137276 - RNA, 1413 nt, Artificial Sequence; identical to SEQ ID NO: 137066
  derived and/or modified sequence opt3 from neuraminidase__InfluenzaA__ABG88314

SEQ ID NO: 137277 - RNA, 1413 nt, Artificial Sequence
  derived and/or modified sequence opt3 from neuraminidase__InfluenzaA__ABG88325
augaaccccaaucagaagaucauuaccauaggcagcacauccaucgccauugggaucauuucucugauccuccaaauaggaaacaucauuucaaucugggcuagucacagcauucagacugguucccagaaucauacgggcaucugcaaccagagaauaauuaccuacgaaaauucuacaugggugaaccaaacuuaugucaauaucaacaauaccucgguuguggcagggaaagacaagacaucaaugacccuugccggaaacagcagucuguguccuauuaggggcugggcgaucuacacuaaagauaauuccauccggauugguucuaagggggacguauucgugauacgcgagccauuuaucagcugcucccacuuggagugucgaacauucuuuuuaacccagggagcucugcuaaacgauaaacauucaaauggcacggucaaggaccguaguccguauagagcccucaugagcugcccccugggcgaagcaccuucuccauacaacuccagguucgagucaguggccuggagcgcuagugcaugucacgaugggcuuggauggcugacuauugguaucucuggccccgacaauggggccguugcuguguugaaguauaacggaauaauuaccgaaacaaucaaauccuggaagaaacggauccuccgcacucaggagagcgagugcgucuguaugaacggcucgugcuuuaccauuaugacagaugguccuucuaauggggccgcguccuacagaaucuucaagauugaaaaaggaagggugaccaagucaauagagcuggacgcaccaaacuaucauuacgaagaguguaguugcuaccccgauacgggcacuguaauguguguuugccgggacaauuggcacggcagcaaccgcccuuggguguccuuuaaucagaaccuggauuaucaaacaggguacaucugcucuggagucuucggugacaauccacgaccgaaggauggcgaggggagcuguaaccccgugaccgccgacggagcugacggcgugaaagguuuuucauauagauacgggaauggcgucuggauuggaaggacuaagaguaaccggcuccguaaaggcuucgaaaugaucugggauccuaauggguggacagacaccgauuccgacuuuagcaugaagcaggauaucguugccaugacggacuggucuggauauucagguaguuucgugcagcacccagaguuaaccggccuggauugcaugcgccccuguuuuuggguagaacuugugagaggguugccuagggagaacacaacuauuuggaccagcggauccucuauaucguucugcggcgucaauagcgacacagcaaacugguccuggccagauggugcugaacugcccuucacuaucgacaaauga

SEQ ID NO: 137278 - RNA, 1413 nt, Artificial Sequence
  derived and/or modified sequence opt3 from neuraminidase__InfluenzaA__ABG88336
augaaccccaaucagaagaucauuaccauaggcagcaucugcauggccauugggaucauuucccugauccuccaaauaggaaacaucauuucuaucugggugucacacaguauucagacagguaaucagaaccauacuggcaucuguaaucagagaauaauuacguacgagaacagcaccugggucaaucaaacauauguuaacaucaauaacacuaaugugguagcugggaaagacaccacauccgugacccuugcaggaaacucuucgcugugcccugucaggggcugggccauuuacucaaaggauaauagcauccggaucgguaguaaaggggacguguucguuauucgcgaaccauuuauauccuguucucacuuggagugccgaacuuucuuuuuaacacagggagcgcugcuaaacgauaagcauagcaauggcaccgugaaagaccguuccccguauagagcucucaugucaugucccaucggcgaagccccuaguccauacaacagcagguucgagucugucgcaugguccgccucagcuugccacgaugggaugggauggcugacgauugguaucagcggccccgacgauggggcaguggccguacuuaaguauaacggaauaauuacugaaaccaucaagaguuggcggaaacgcauccugagaacacaggagucugaguguguuugcgugaauggcuccuguuuuacuauuaugaccgacgguccuagcaacgggccagcuucguacaagaucuucaaaauugaaaagggaaaaauaacaaagucuaucgaguuggaugcccccaauucccauuaugaagagugcucauguuacccugacaccggcacggucaugugcgugugcagggauaacuggcacggcaguaaucggccaugggugagcuuuaaccagaaucucgacuaccaacugggguauauuuguuccggaaucuucggugauaacccgcgccccaaggacggcaaagggucuugcggaccugucacuguugacggcgcggauggugugaagggguuuagcuaccgauauggcaauggaguauggaucggcagaacaaaaucaaacaguuccaggaagggguucgagaugauuugggacccaaauggauggaccgauacugacagcaacuuucuggugaaacaggaugucguggcaaugacagacuggucugguuacucaggcaguuucguucagcaccccgaacucaccggguuagauuguaugcggccuugcuuuuggguggagcugauacguggacgcccaagagaaacgaccacaaucuggacuagcggcuccucuauuucguucuguggugucaauagcgacaccgugaacugguccuggcccgauggggccgagcuuccguucacaaucgacaaguga

SEQ ID NO: 137279 - RNA, 1413 nt, Artificial Sequence
  derived and/or modified sequence opt3 from neuraminidase__InfluenzaA__ABG88347
augaaccccaaucagaagaucauuaccauaggcagcaucugcauggccauugggaucauuggacugauccuccaaauagguaacaucauuuccaucugggugucucacucaauucagacaggcagucagaaucauacugggaucuguaaccagagaauaauuacguacgagaauagcaccugggucaaccaaacauauguuaauaucaacaauacuaacgugguagcuggaaaagacaccacauccgugacccuugcaggcaauucuucgcugugcccugucagggguugggccauuuacucaaaggauaacagcauccggaucgggaguaaaggagacguguucguuauucgcgaaccauuuauauccuguucucacuuggagugccgaacuuucuuuuuaacacagggcgcgcugcuaaaugauaagcauagcaacggcaccgugaaagaccguuccccguauagagcucucaugucaugucccaucggggaagccccuaguccauacaauagcagguucgagucugucgcaugguccgccucagcuugccacgauggaauggguuggcugacgauuggcaucagcgggcccgacgauggagcaguggccguacuuaaguauaacggcauaauuacugaaaccaucaagaguuggcggaaacgcauccugagaacacaggagucugaguguguuugcgugaacgguuccuguuuuacuauuaugaccgacgggccuagcaauggaccagcuucguacaagaucuucaaaauugaaaagggcaaaauaacaaagucuaucgaguuggaugcccccaacucccauuaugaagagugcucauguuacccugacaccggcacggucaugugcgugugcagggauaauuggcacgggaguaaccggccaugggugagcuuuaaucagaaccucgacuaccaacugggauauauuuguuccgguaucuucggcgauaauccgcgccccaaggacgggaaaggaucuugcggcccugucacuguugacggugcggauggggugaagggcuuuagcuaccgauauggaaacggcguauggaucgggagaacaaaaucaaauaguuccaggaagggauucgagaugauuugggacccaaacgguuggaccgauacugacagcaauuuucuggugaaacaggaugucguggcaaugacagacuggucuggcuacucagggaguuucguucagcaccccgaacucaccggauuagauuguaugcggccuugcuuuuggguggagcugauacguggccgcccaagagaaacgaccacaaucuggacuagcgguuccucuauuucguucuguggggucaacagcgacaccgugaauugguccuggcccgauggcgccgagcuuccguucacaaucgacaaguga

SEQ ID NO: 137280 - RNA, 1410 nt, Artificial Sequence
  derived and/or modified sequence opt3 from neuraminidase__InfluenzaA__ABG88358
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacaaaaaugccaccgcuucuuucauuuacgauggcaggcugguagacagcaucggcuccuggucaaagaacauccuccggacgcaggagagugaaugcguuuguauuaaugggacuugcacaguggucaugaccgauggaagcgcaucugaccgcgccgauacuaaaauauuauuuaucgaggaggguaagauugugcacaucagaccucuguccggcucagcucaacauguggaagagugcagcuguuauccaagguacccggggguccggugcguuugucgcgacaacuggaagggaaguaaccgacccauaguggauauuaauguaaaagacuacucuaucguguccagcuaugucugcucgggccuugugggugacacaccuagaaagaacgauucuuccucaaguagcuacuguuggaauccaaacaaugaaaaagggggacacggcguuaagggcugggccuucgacgaugggaacgacguguggaugggaaggaccaucuccgaggaaucucggagcgguuaugagacguuuaaagucauuggcggguggucaaagcccaauaguaaauugcagaucaaccgucaggugauuguagaucgcggaaauagauccggcuacagcgguauauucucuguugaggggaagucaugcaucaacagguguuuuuauguggaacugauucggggccgaaagcaggagaccgaagucugguggacaaguaauagcaucguggucuucugcggaacuuccggcaccuacgggacaggaucuuggccugacggugcggauaucaaccuaaugccaauuuga

SEQ ID NO: 137281 - RNA, 1410 nt, Artificial Sequence; identical to SEQ ID NO: 137129
  derived and/or modified sequence opt3 from neuraminidase__InfluenzaA__ABG88369

SEQ ID NO: 137282 - RNA, 1410 nt, Artificial Sequence; identical to SEQ ID NO: 137129
  derived and/or modified sequence opt3 from neuraminidase__InfluenzaA__ABG88380

SEQ ID NO: 137283 - RNA, 1410 nt, Artificial Sequence; identical to SEQ ID NO: 137129
  derived and/or modified sequence opt3 from neuraminidase__InfluenzaA__ABG88391

SEQ ID NO: 137284 - RNA, 1410 nt, Artificial Sequence; identical to SEQ ID NO: 137116
  derived and/or modified sequence opt3 from neuraminidase__InfluenzaA__ABG88402

SEQ ID NO: 137285 - RNA, 1410 nt, Artificial Sequence; identical to SEQ ID NO: 137173
  derived and/or modified sequence opt3 from neuraminidase__InfluenzaA__ABG88413

SEQ ID NO: 137286 - RNA, 1410 nt, Artificial Sequence; identical to SEQ ID NO: 137117
  derived and/or modified sequence opt3 from neuraminidase__InfluenzaA__ABG88424

SEQ ID NO: 137287 - RNA, 1410 nt, Artificial Sequence; identical to SEQ ID NO: 137117
  derived and/or modified sequence opt3 from neuraminidase__InfluenzaA__ABG88435

SEQ ID NO: 137288 - RNA, 1410 nt, Artificial Sequence; identical to SEQ ID NO: 137117
  derived and/or modified sequence opt3 from neuraminidase__InfluenzaA__ABG88446

SEQ ID NO: 137289 - RNA, 1410 nt, Artificial Sequence
  derived and/or modified sequence opt3 from neuraminidase__InfluenzaA__ABG88457
augaaccccaaucagaagaucauuaccauaggcagcgugucccugacaacugccacgaucugcuuccucaugcaaauugcuauccuugucaccacaguuacucugcacuuuaaacaguacgaguguaacucuccuccaaauaaccaggugauguugugcgaaccgaccauuaucgagagaaauauaacagaaaucguauauuuaaccaacacuacaauugagaaggaaaucugucccaaacuggcagaguacaggaauuggucaaagccucagugcaaaauuaccggguucgccccauuuaguaaggacaacagcauccggcuauccgcgggaggugauauaugggugacgcgcgagcccuaugucucuugugacccuggcaagugcuaccaauucgcucucgggcagggaacuacccugaauaaccgacauucgaaugauacagugcacgaccguacuccauauagaacccuucugaugaacgaauugggcguucccuuucaucucgguacaaaacagguguguauugccuggucaagcaguuccugccacgaugggaaggcauggcugcaugucugugugaccggacacgacgagaaugccacggcuucuuucaucuacgauggcaggcugguagacagcauuggcuccuggaguaaaaacauccuccggacucaggaaucagagugcguuuguaucaaugggacaugcaccguggucaugacugauggaagcgcaucugagcgcgccgacacaaagauuuuauuuauaaaagaagguaagaucgugcacauuuccccucugucaggcagcgcucaacauguggaggaaugcaguuguuauccaagauacccgggggucaggugcguuugucgggauaacuggaagggaucuaaccgccccaucguggacauaaauguaaaagauuacuccauugugagcucguaugucugcucuggccuugugggugacaccccucgaaagaacgacuccucaaguagcuccuacugucagaauccaaacaaugagaaagggucucacggaguuaagggcugggccuucgaugacggcaacgauguguggauggggagaacgaucagcgaagaguugaggucaggauaugagaccuuuaaagucaucgguggcuggaguaagcccaauuccaaacugcagauuaaccgucaggugaucguagaccgggggaaucgcagcggauacucuggcauuuucucaguugaagguaagaguugcauaaacagauguuuuuauguggagcuaaucagggggcggaagcaagaaacagaggucugguggacuagcaauuccauuguggucuucugcggcaccucuggaacauacggcacugggucguggccugauggagcggacaucaaccucaugccaaucuga

SEQ ID NO: 137290 - RNA, 1410 nt, Artificial Sequence; identical to SEQ ID NO: 137117
  derived and/or modified sequence opt3 from neuraminidase__InfluenzaA__ABG88468

SEQ ID NO: 137291 - RNA, 1410 nt, Artificial Sequence; identical to SEQ ID NO: 137117
  derived and/or modified sequence opt3 from neuraminidase__InfluenzaA__ABG88479

SEQ ID NO: 137292 - RNA, 1410 nt, Artificial Sequence; identical to SEQ ID NO: 137117
  derived and/or modified sequence opt3 from neuraminidase__InfluenzaA__ABG88490

SEQ ID NO: 137293 - RNA, 1410 nt, Artificial Sequence; identical to SEQ ID NO: 137117
  derived and/or modified sequence opt3 from neuraminidase__InfluenzaA__ABG88501

SEQ ID NO: 137294 - RNA, 1410 nt, Artificial Sequence; identical to SEQ ID NO: 137117
  derived and/or modified sequence opt3 from neuraminidase__InfluenzaA__ABG88512

SEQ ID NO: 137295 - RNA, 1410 nt, Artificial Sequence; identical to SEQ ID NO: 137117
  derived and/or modified sequence opt3 from neuraminidase__InfluenzaA__ABG88523

SEQ ID NO: 137296 - RNA, 1410 nt, Artificial Sequence
  derived and/or modified sequence opt3 from neuraminidase__InfluenzaA__ABG88534
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaucaaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaaaaucacaggguucgccccauuuagcaaggacaauuccauacggcuaucugcgggaggugauauuugggugacccgcgagcccuaugucucgugugacccuggcaagugcuaccaauucgcucucgggcagggaacgacucugaacaaucgacauucaaacgauaccgugcacgaccguacaccauauagaacucuucugaugaaugaauugggcguucccuuucaucucgguaccaaacagguguguaucgccuggagcaguuccucuugccacgaugggaaggcauggcugcaugucugugugacaggacacgacgagaacgccaccgcuagcuucauuuacgauggcaggcugguagacuccaucggcucauggaguaaaaauauccuccggacgcaggaaagcgagugcguuuguauuaacgggacuugcacaguggucaugaccgauggaucugcauccgagcgcgccgacacuaagauauuauuuaucgaagaggguaaaauugugcacaucucaccucugagcggcagugcucaacauguggaagagugcucuuguuauccaagauacccgggggucaggugcguuugucgggauaauuggaagggauccaaccgccccauaguggacauuaacguaaaggauuacagcaucgugucgucuuaugucugcuccggccuugugggugacacaccucgaaagaaugacucaaguagcuccucuuacuguagaaacccaaauaacgaaaaagggagccacggaguuaaaggcugggccuucgaugacggcaaugauguguggauggggaggaccaucucagaggaguugcggaguggauaugaaacguuuaaggucauugguggcugguccaaacccaacagcaagcugcagaucaaucgucaggugauuguagaccgcgggaacagaucuggauacucaggcauauucaguguugagaauaaaagcugcaucaacagguguuuuuauguggaacuaauucggggucgaaagcaggagaccgaagucugguggacauccaauucuaucguggucuucugcgggacuucgggcaccuacggaacaggcagcuggccugauggggcggacaucaaccucaugccaauuuga

SEQ ID NO: 137297 - RNA, 1410 nt, Artificial Sequence; identical to SEQ ID NO: 136809
  derived and/or modified sequence opt3 from neuraminidase__InfluenzaA__ABG88567

SEQ ID NO: 137298 - RNA, 1410 nt, Artificial Sequence
  derived and/or modified sequence opt3 from neuraminidase__InfluenzaA__ABG88600
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaaccugcagaguacaggaauuggucaaagccacagugcaacaucacaggguucgcccccuuuaguaaagacaauagcauacggcuguccgcgggaggugauauuugggugacccgcgagccuuaugucucuugugacccagauaagugcuaccaauucgcucuaggccaggggacgacucucaacaauggacauucgaacgacaccgugcacgaucgaacacccuaucguacucugcuuaugaaugaacugggcguuccuuuucauuuggguaccaaacagguguguaucgccuggucaagcaguuccugccacgacgggaaggcauggcuccaugucugugugacaggagaugacgagaacgccaccgcuucuuucauuuacaauggcagacugguagauagcaucggcuccuggucaaagaaaauccugaggacgcaggaaagugagugcguuuguauuaacgggacuugcacaguggucaugaccgacggaagcgcaucugguaaggccgauacuaaaauacucuuuaucgaggaaggcaagauugugcacacauccuuacugucagggagcgcucaacacguggaggaaugcaguuguuauccacgguacccgggaguccgcugcguuuguagagacaacuggaagggcucuaauaggcccaucguggauauaaacguaaaagacuacuccauugugagcucguaugucugcucuggucuugugggggacaccccucggaagaaugauuccucaaguagcucccauuguuuggacccaaacaaugaggaaggaggccacggcguuaaagggugggccuucgaugacggaaacgauguguggaugggucgcacgaucucugagaagcugcgaagcggcuacgagaccuuuaaagucaucgaaggguggucaaagcccaauaguaaacuacagauuaacagacaggugaucguagacaggggaaaucgguccggcuauagcgguauuuucucuguugaggggaagucaugcauaaaccguuguuuuuacguggaacucauccgcggcagaaagcaggagacagaaguccuguggaccaguaauagcauuguggucuucugcggaacuuccggcacauaugggacuggaucuuggccugauggugcggacaucaaccuuaugccaaucuga

SEQ ID NO: 137299 - RNA, 1410 nt, Artificial Sequence; identical to SEQ ID NO: 136170
  derived and/or modified sequence opt3 from neuraminidase__InfluenzaA__ABG88611

SEQ ID NO: 137300 - RNA, 1410 nt, Artificial Sequence; identical to SEQ ID NO: 136182
  derived and/or modified sequence opt3 from neuraminidase__InfluenzaA__ABG88622

SEQ ID NO: 137301 - RNA, 1410 nt, Artificial Sequence; identical to SEQ ID NO: 136170
  derived and/or modified sequence opt3 from neuraminidase__InfluenzaA__ABG88633

SEQ ID NO: 137302 - RNA, 1410 nt, Artificial Sequence; identical to SEQ ID NO: 137221
  derived and/or modified sequence opt3 from neuraminidase__InfluenzaA__ABG88655

SEQ ID NO: 137303 - RNA, 1410 nt, Artificial Sequence; identical to SEQ ID NO: 137221
  derived and/or modified sequence opt3 from neuraminidase__InfluenzaA__ABG88666

SEQ ID NO: 137304 - RNA, 1410 nt, Artificial Sequence; identical to SEQ ID NO: 136607
  derived and/or modified sequence opt3 from neuraminidase__InfluenzaA__ABG88677

SEQ ID NO: 137305 - RNA, 1410 nt, Artificial Sequence; identical to SEQ ID NO: 137221
  derived and/or modified sequence opt3 from neuraminidase__InfluenzaA__ABG88688

SEQ ID NO: 137306 - RNA, 1410 nt, Artificial Sequence; identical to SEQ ID NO: 136607
  derived and/or modified sequence opt3 from neuraminidase__InfluenzaA__ABG88699

SEQ ID NO: 137307 - RNA, 1410 nt, Artificial Sequence; identical to SEQ ID NO: 136343
  derived and/or modified sequence opt3 from neuraminidase__InfluenzaA__ABG88710

SEQ ID NO: 137308 - RNA, 1410 nt, Artificial Sequence; identical to SEQ ID NO: 136343
  derived and/or modified sequence opt3 from neuraminidase__InfluenzaA__ABG88721

SEQ ID NO: 137309 - RNA, 1410 nt, Artificial Sequence
  derived and/or modified sequence opt3 from neuraminidase__InfluenzaA__ABG88732
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaguggacauuaauguaaaggauuacuccaucgugagcucguaugucugcucuggccuugugggugacacaccucgaaagaacgacuccucaaguagcuccuacuguagaaauccaaacaaugaaaaagggucucacggaguuaaaggcugggccuucgaugacggcaacgauguguggauggggaggaccaucagcgaggaguugcggucaggauaugaaacguuuaaggucauugguggcuggaguaaacccaauuccaagcugcagaucaaccgucaggugauuguagagcgcgggaauagaagcggauacucuggcauauucucaguugaagguaaaaguugcaucaacagguguuuuuauguggagcuaauucgggggcgaaagcaggaaaccgaggucugguggacaagcaauuccaucguggucuucugcggcacuucuggaaccuacggcacagggucguggccugacggagcggauaucaaccucaugccaauuuga

SEQ ID NO: 137310 - RNA, 1410 nt, Artificial Sequence; identical to SEQ ID NO: 137269
  derived and/or modified sequence opt3 from neuraminidase__InfluenzaA__ABG88743

SEQ ID NO: 137311 - RNA, 1410 nt, Artificial Sequence; identical to SEQ ID NO: 137269
  derived and/or modified sequence opt3 from neuraminidase__InfluenzaA__ABG88754

SEQ ID NO: 137312 - RNA, 1410 nt, Artificial Sequence; identical to SEQ ID NO: 136535
  derived and/or modified sequence opt3 from neuraminidase__InfluenzaA__ABG88765

SEQ ID NO: 137313 - RNA, 1410 nt, Artificial Sequence; identical to SEQ ID NO: 137201
  derived and/or modified sequence opt3 from neuraminidase__InfluenzaA__ABG88776

SEQ ID NO: 137314 - RNA, 1410 nt, Artificial Sequence; identical to SEQ ID NO: 137201
  derived and/or modified sequence opt3 from neuraminidase__InfluenzaA__ABG88787

SEQ ID NO: 137315 - RNA, 1410 nt, Artificial Sequence
  derived and/or modified sequence opt3 from neuraminidase__InfluenzaA__ABG88820
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaaaugccccaaguuagcugaguacaggaauuggaguaaaccucaguguaacaucacaggguucgcaccauuuagcaaggacaauuccauacggcugucugccggaggugauauuuggguaacccgcgagcccuaugugucgugcgacccugauaaguguuaccaauucgcgcuaggccaggggacgacucucaacaauguccauucaaacgacaccgugcgagaucguacaccauauagaacucugcuuaugaaugaacugggaguucccuuucacuugggcaccaaacaggugugcaucgcuuggagcaguuccucuugucaugacgguaaggccuggcuccacgucugcgugacaggggaugacaaaaacgcaaccgccagcuucauuuacaauggaaggcugguagauuccaucguuucauggaguaaggagauccugcggacgcaggaaagcgagugugugugcauuaacggcacuuguacagucgugaugaccgacggcucugcuuccgggaaagcagauacuaagauacucuuuaucgaggaaggaaagauugugcauacaucaaccuuaagcgguagugcccaacacgucgaggaaugcucuugcuauccucgcuacccaggcguuagaugugugugcagggacaacuggaaaggguccaaucggccgaucguagauauaaacauuaaggacuacagcaucgugucgucuuaugucuguuccggacuggugggcgacacgccccgcaaaaaugauucaaguagcuccucucacugccuugacccuaacaaugaggaaggugggcauggaguuaagggcugggcuuucgaugacggcaacgauguguggauggggcgaaccaucagcgagaaauugagacugggauacgagacauuuaaggucauugaagguuggucaaauccaaacaguaaacuacagacuaauaggcaagugaucguagaccggggcaaccguuccggguauagcggaauuuucucuguugagggcaagucauguauaaaucgcugcuuuuacguggaacucaucagagguaggaaggaggaaaccgagguccuguggacaaguaacagcauuguggucuucugugggacuuccggcaccuauggaacaggcucuuggcccgauggggccgacaucaaucuuaugccuaucuga

SEQ ID NO: 137316 - RNA, 1350 nt, Artificial Sequence
  derived and/or modified sequence opt3 from neuraminidase__InfluenzaA__ABI16506
augaaccccaaucagaagaucauuaccauaggcagcaucugcauggugauugggaucgucucccugaugcuccaaauuggaaacaugguuucucuuugggugucacacaguauccagacagguaaucagcaucagguagagccuauaagcaacacuaauuuccugacggaaaaagccguggcuuccgucaccuuggcaggcaacucuucguuauguccaaucagagggugggccgugcacucaaaggacaauagcauuaggaucggaaguaaaggcgauguuuuugugauucgggagccguucaucuccugcucucaucuggaaugucgcacauuuuuccuaacucaaggugcgcuccugaacgacaagcacagcaaugggaccgucaaagaucgaucaccccaucguacacuuauguccugcccugugggagaggcuccaagucccuacaacagcagauuugaaucuguagccugguccgcaucagccugucacgacggcaccagcuggcugacuauaggcauuagugggccugauaauggagcuguugcaguguugaaguauaacgguaugaucacagacaccauuaagucuuggaggaauaacauccuccggacgcaggaguccgagugcgucugugugaauggcagcugcuucacugugaugaccgaugggccaucgaacggacaggccucuuacaaaaucuuuaagauggaaaaaggcaaggucguuaaauccguggagcuggacgcucccaacuaucacuacgaagaguguucaugcuauccugaugccggugagauuacauguguaugccgcgacaauuggcaugggaguaacagaccaugggugagcuucaaucagaaccuggaauaccaaauaggauauaucugcuccggcgucuuuggcgauaauccgaggcccaacgacgggacuggaucuugugguccugugagcccaaauggcgcguacgggguuaagggauucucauuuaaguacggcaacgguguguggauugggcggaccaaaagucccuccagccgcucuggcuucgagaugaucugggauccuaauggauggacagaaaccgacucaaguuuuagcgucaagcaggacauaguggcaauuacggauugguccggcuauucugggucguucguacagcacccagagcucacuggauuagacugcauccgacccuguuucuggguugaacugaucagagguaggccgaaagagagcacaauuuggaccuccggcucaaguaucucuuuuugcggggugaacagcgauacugucuccuggucauggccugacggagccgagcuucccuucacaauugauaaguga

SEQ ID NO: 137317 - RNA, 1413 nt, Artificial Sequence; identical to SEQ ID NO: 136981
  derived and/or modified sequence opt3 from neuraminidase__InfluenzaA__ABI20840

SEQ ID NO: 137318 - RNA, 1413 nt, Artificial Sequence
  derived and/or modified sequence opt3 from neuraminidase__InfluenzaA__ABI20862
augaaccccaaucagaagaucauuaccauaggcagcaucugcaugacaauugggaucauuucccugauccuccaaauaggaaacaucauuucuaucugggugucacacaguauucagacugguagccagaaucauacgggcaucuguaaccagagaauaauuaccuacgaaaauuccacaugggucaaccaaacuuauguuaauaucaacaauaccaacgugguagccgggaaagacacaaccucugugacucuugcuggaaauucgucacugugcccuauuaggggcugggcaaucuacagcaaggauaacaguauccggauugguuccaaaggggacgucuucgugauacgcgaaccauuuaucucuuguagccacuuggagugccgaacauucuuuuuaacccagggagcccugcuaaaugauaagcauuccaacggcacgguuaaagaccguucaccguauagagcgcucaugaguugucccauuggcgaagcuccuagcccauacaauucuagguucgaguccguggccuggucagcaagcgccugccacgaugggaugggauggcugacuaucgguauaaguggccccgacgauggggcugucgcagugcuuaaguauaacggaauuaucaccgaaacaaucaagucuuggcggaaacgcauucugagaacucaggaguccgaguguguaugcguuaacggcagcuguuuuaccaucaugacagacgguccuucgaaugggccagccucuuacaggauuuucaagauagaaaaaggaaagaucaccaaauccauugaguuggaugcucccaacucacauuaugaagagugcaguuguuacccugacacgggcacugugaugugcgucugccgggauaauuggcacggcagcaaccgcccauggguguccuuuaaucagaaccucgacuaccaaacaggguauaucuguucuggaguguucggugauaauccgcgacccaaggacggcaaggggagcugcgacccugucaccguugauggagccgacggcgugaaagguuuuucauacagauaugggaacggcguauggaucggaaggacuaagaguaauuccagccggaaaggcuucgagaugauuugggauccaaacggguggacagacaccgauucuaauuuucuggugaagcaggacgucguggcgaugacggauuggucaggauacagugguagcuucguucagcaccccgaacugaccggccucgacuguaugcguccuugcuuuuggguggaguuaauacgcgggagaccaagggagaaaacaacuaucuggaccuccggaucuucgauuagcuucuguggcgucaacuccgauacagcaaauuggucauggcccgacggugccgagcugccguucacuaucgauaaguga

SEQ ID NO: 137319 - RNA, 1413 nt, Artificial Sequence
  derived and/or modified sequence opt3 from neuraminidase__InfluenzaA__ABI20873
augaaccccaaucagaagaucauuaccauaggcagcaucuccauggccauugggaucauuucucugacacuccaaaucggaaacauaaucucaauuugggcuagucacagcauccagacugguucccagaaucauacgggcauuugcaaccagagaaucauaaccuacgaaaauucuacaugggugaaccaaacuuaugucaauauuaacaauaccaacguuguggcagagaaagacaagacaucgguaacccuugccggaaauucaagccuguguccuaucagggggugggcgauuuacacuaaagauaacaguauccggaucggcuccaagggugacguguucgucauucgcgagccauuuauaucuugcagccacuuggaaugucgaacauucuuuuuaacccagggggcucugcuaaaugauaaacauuccaacggaacggugaaggaccguucaccguauagagcccucaugaguugcccccugggcgaggcaccuagcccauacaauucuagguucgaauccguugccuggucagcuacugcaugucacgauggcaucggguggcuuaccauuggaaucagcggucccgacaacggcgccguggcuguccugaaguauaacggggugauaacagagacuauuaaaaguuggaagaaacagaucuugcggacccaggagucugaaugcguauguguuaauggauccugcuuuacaaucaugaccgauggcccuagcaacggugccgcgucguaccgcauuuucaagaucgagaaagggaagauuacgaagucuauagaacucgacgcaccaaauuuucauuaugaggaguguuccugcuaccccgauacuggaacagugaugugugucugcagagacaacuggcacggcucaaauaggccuugggugaguuucaaccaaaaucuggauuaccagaucggcuauauuugcagcgggguguuuggagacaacccacggccgaaagauggugaaggcuccuguaaucccgucaccguugacggggccgacggagugaagggcuucucuuaccgcuaugguaacgggguauggaucggccgaacuaaaagcaauagacugaggaagggauuugagaucauuugggauccuaacggcuggacagacaccgauucagacuucagugugaaacaggaugucguggcuaugacggacugguccggguacagcggaucuuuuguucagcacccagaacucaccgguuuagauugcaugcggcccuguuucuggguggagcugguccguggccuuccucgcgaaaaugccacaauauggacuucagggaguagcaucuccuucugcggagugaacucugacaccgcaaauuggucguggccagauggcgcugaguugcccuuuacaauugacaaguga

SEQ ID NO: 137320 - RNA, 1410 nt, Artificial Sequence; identical to SEQ ID NO: 137116
  derived and/or modified sequence opt3 from neuraminidase__InfluenzaA__ABI20895

SEQ ID NO: 137321 - RNA, 1410 nt, Artificial Sequence; identical to SEQ ID NO: 137129
  derived and/or modified sequence opt3 from neuraminidase__InfluenzaA__ABI20906

SEQ ID NO: 137322 - RNA, 1410 nt, Artificial Sequence; identical to SEQ ID NO: 137117
  derived and/or modified sequence opt3 from neuraminidase__InfluenzaA__ABI20928

SEQ ID NO: 137323 - RNA, 1410 nt, Artificial Sequence; identical to SEQ ID NO: 137117
  derived and/or modified sequence opt3 from neuraminidase__InfluenzaA__ABI20939

SEQ ID NO: 137324 - RNA, 1410 nt, Artificial Sequence; identical to SEQ ID NO: 137117
  derived and/or modified sequence opt3 from neuraminidase__InfluenzaA__ABI20950

SEQ ID NO: 137325 - RNA, 1410 nt, Artificial Sequence; identical to SEQ ID NO: 137117
  derived and/or modified sequence opt3 from neuraminidase__InfluenzaA__ABI20961

SEQ ID NO: 137326 - RNA, 1410 nt, Artificial Sequence; identical to SEQ ID NO: 136843
  derived and/or modified sequence opt3 from neuraminidase__InfluenzaA__ABI20983

SEQ ID NO: 137327 - RNA, 1410 nt, Artificial Sequence
  derived and/or modified sequence opt3 from neuraminidase__InfluenzaA__ABI20994
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacaaucgaacaccauaucguacucuucugaugaacgaauugggcguucccuuucaucucgguaccaaacagguguguaucgccuggucaagcaguuccugccacgaugggaaggcauggcugcaugucugugugacaggagacgaugagaaugccaccgcuucuuucauuuacaacggcagacugguagacagcaucggcuccuggucaaagaaaauccucaggacgcaggaaagugagugcguuuguauuaacgggacuugcacaguggucaugaccgauggaagcgcaucugguaaggccgacacuaaaauauuauuuaucgaggaaggcaagauugugcacacauccucacugagcgggagugcucaacacguggaggaaugcucuuguuauccucgguacccaggaguccgcugcguuuguagagauaauuggaagggcuccaacaggccgaucguggacauaaauguaaaagauuacagcauugugucgucuuaugucugcuccggucuugugggggacacgccccggaagaacgacucaaguagcuccucucauuguuuggauccuaauaacgaggaaggaggccacggcguuaaagggugggccuucgacgauggaaaugacguguggaugggucgcaccaucagcgagaagcugcgaucaggcuacgagaccuuuaaagucaucgaaggguggaguaagccaaacuccaaacuacagauuaauagacaggugaucguagauaggggaaaccggagcggcuauucugguauuuucucaguugagaguaagagcugcauaaaucguuguuuuuacguggaacucauccgcgggagaaagcaggagacagaaguccuguggacuuccaacucuauuguggucuucugcggcaccucgggaacauauggcacugggagcuggcccgacggagcggauaucaaucuuaugccuaucuga

SEQ ID NO: 137328 - RNA, 1410 nt, Artificial Sequence
  derived and/or modified sequence opt3 from neuraminidase__InfluenzaA__ABI21005
augaaccccaaucagaagaucauuaccauaggcagcgugucccugacaaucgccacuauuugcuuccucaugcaaaucgcuguccuuguuacgaccgugacacugcacuuuaaacaguacgaguguaacucuccuccaaauaaccagguaauguugugcgaaccgacuauuaucgagagaaauauaaccgaaaucguguauuuaacaaacaccacuauugagaaggaaaucugucccaaacuggcagaguacaggaauuggucaaagccucagugcaacauuacaggguucgccccauuuaguaaagacaauagcauccggcuauccgcgggaggugauauaugggucacccgcgagcccuaugugucuugugacccugauaagugcuaccaauucgcucucggccaggggacgacucugaacaauggacauucgaacgacaccguucacgaucgaacaccauaucguacucuucugaugaaugaauugggcgugcccuuucaucucgguaccaagcaggucuguauugccuggucaagcaguuccugccacgacgggaaagcauggcugcauguguguguaacaggagaugacgagaacgccaccgcuucuuucaucuacaauggcagacuggcagauagcauuggcuccuggucaaagaaaauccucaggacgcaggaaagugagugcguuuguaucaacgggacuugcacaguggucaugaccgacggaagcgccucugguaaggcugauacuaaaauuuuauuuauagaggaaggcaagaucgugcacacaucccugcuuucagggagcgcccaacacguggaggaaugcaguuguuauccucgguacccaggaguccgcugcguuuguagagacaacuggaagggcucuaauaggccgauuguggauaucaacguaaaagacuacuccauagugagcucguaugucugcucugguuuggugggggacacuccccggaagaaugauuccucaaguagcucccauugucuggacccuaacaaugaggaaggaggccacggcguuaaagggugggcguucgaugacggaaacgauguguggaugggucgcacgauuucugagaagcuacgaagcggcuacgagaccuuuaaagucaucgaaggguggucaaagccaaauaguaaacuccagaucaacagacaggugauuguagacaggggaaaucgguccggcuauagcgguaucuucucuguugaggggaagucaugcauuaaccguuguuuuuacguggaacugauacgcggcagaaagcaggagacagaaguccuuuggaccaguaauagcaucguggucuucugcggaaccuccggcacauaugggacuggaucuuggcccgauggugcagacauuaaccugaugccuaucuga

SEQ ID NO: 137329 - RNA, 1410 nt, Artificial Sequence; identical to SEQ ID NO: 136170
  derived and/or modified sequence opt3 from neuraminidase__InfluenzaA__ABI21016

SEQ ID NO: 137330 - RNA, 1410 nt, Artificial Sequence
  derived and/or modified sequence opt3 from neuraminidase__InfluenzaA__ABI21027
augaaccccaaucagagaaucauuaccauaggcagcgugucccugacaaucgccacuauuugcuuccucaugcaaaucgcuauucuugucacgaccguuacacugcacuuuaagcaguacgaguguaacucuccuccaaauaaccaggugauguugugcgaaccgacuaucauagagaggaauaucaccgaaauuguauauuuaacaaacaccacuaucgagaaagaaauuugucccaagcuggcagaguaccggaauuggucaaaaccucagugcaacaucacaggguucgccccauuuaguaaggacaauagcauacgccuauccgcgggaggugauauuugggugacccgagagcccuaugucucuugugacccugauaaaugcuaccaauucgcucucggccaggggacgacucugaacaauggacauucgaacgacaccgugcacgaucguacaccauauagaacucuucugaugaaugaauugggcguucccuuucaucucgguacccgacagguguguaucgccuggucaagcaguuccugccacgacgggaaggcauggcugcaugucugugugacaggagaugacgagaacgccaccgcuucuuucauuuacaauggccggcugguagauagcaucggcuccuggucaaagaaaauccuccgcacgcaggaaagugagugcguuuguauuaacgggacuugcacaguggucaugaccgacggaagcgcaucugguaaggccgauacuaaaauauuauuuaucgaggaaggcaagauugugcacaucuccacacugucagggagcgcucaacacguggaggaaugcaguuguuauccuagauacccaggagucaggugcguuugucgggacaacuggaaaggcucuaaucgcccgauaguggauauuaacguaaaggacuacuccaucgugagcucguaugucugcucuggucuugugggggacacccccaggaagaaugauuccuucucaaguagccauuguuuggacccuaacaaugaggaaggaggccacggcguuaaagggugggccuuugaugacggaaacgauguguggauggguagaacgaucuccgagaagcugaggucuggcuacgagaccuucaaagucauugaaggguggagcaagccaaauucaaaacuacagacaaaccgucaggugaucguagagcggggaaaucgcaguggcuauuccgguauuuuuagcguugaagggaagucuugcauaaacagauguuucuacguggagcucaucaggggccggaaagaagagacugaggucugguggaccucaaauaguauuguggucuuuugcggaacacccggcacuuaugggaccggaagcuggccugacggugcggauaucaaccugaugccaaucuga

SEQ ID NO: 137331 - RNA, 1410 nt, Artificial Sequence; identical to SEQ ID NO: 136607
  derived and/or modified sequence opt3 from neuraminidase__InfluenzaA__ABI21038

SEQ ID NO: 137332 - RNA, 1410 nt, Artificial Sequence
  derived and/or modified sequence opt3 from neuraminidase__InfluenzaA__ABI21049
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacugguggaguauaggaauuggucaaagccucagugcaacaucacaggguucgcaccauuuaguaaagacaauagcauacggcuauccgccggaggugauauuugggucacccgcgagcccuacgugucuugugacccugauaagugcuaucaauucgcgcucggccaggggacgacucugaacaauggacacucgaacgacaccguucaugaucgaacaccauaccguacucuucugaugaaugaauugggcgugcccuuucaccucgguaccagacaggucuguaucgcuuggucaagcaguuccugccaugacgggaaggccuggcugcacguguguguaacaggagaugacaaaaacgcaaccgccucuuucauuuauaauggcaggcugguugauagcaucggcuccuggucaaagaaaauccuccggacgcaggagagugaaugcguguguauuaacgggacuugcacagucgugaugaccgacggaagcgcuucugguaaggcagauacuaaaauauuauuuaucgaggagggcaagauugugcacaucuccacacugucagggagcgcccaacaugucgaagagugcaguuguuacccucgcuauccaggaguuagaugcguguguagggacaacuggaagggcucuaaucggccgauaguagauauuaacgugaaagacuacuccaucgucagcgguuacgugugcucggggcuuguuggagacacgccccgcaagaaugauucuuucuccucaagucacuguuuggacccuaacaaugaagagggcggccauggggugaaaggaugggcuuuugaugacgguaacgaugucuggaugggccgaaccaucagcgaaaagcugagauccggguaugagaccuucaaagugauugagggauggucuaagccaaauagcaaacuacagaucaacaggcagguaauuguugaacggggcaaucguucagguuacagugggauauuuuccguggagggcaagagcugcaucaaccgcuguuucuaugucgaacucauuagaggaaggaaggaggaaacagaggugugguggacuucuaauucaaucgucguguuuugcggcaccagugggacauacggaacugguagcuggcccgacggcgccgauaucaaccugaugccuauuuga

SEQ ID NO: 137333 - RNA, 1410 nt, Artificial Sequence
  derived and/or modified sequence opt3 from neuraminidase__InfluenzaA__ABI21060
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaaccuguggaguauaggaauuggucaaagccacagugcaacaucacaggguucgcacccuuuaguaaagacaauagcauacggcuguccgccggaggugauauuugggucacccgcgagccuuacgugucuugugacccagauaagugcuaucaauucgcgcuaggccaggggacgacucucaacaauggacacucgaacgacaccguucaugaucgaacacccuaccguacucugcuuaugaaugaacugggcgugccuuuucacuuggguaccagacaggucuguaucgcuuggucaagcaguuccugccaugacgggaaggccuggcuccacguguguguaacaggagaugacaaaaacgcaaccgccucuuucauuuauaauggcaggcugguugauagcaucggcuccuggucaaagaaaauccugcggacgcaggagagugaaugcguguguauuaacgggacuugcacagucgugaugaccgacggaagcgcuucugguaaggcagauacuaaaauacucuuuaucgaggagggcaagauugugcacaucuccacauuaucagggagcgcccaacaugucgaagagugcaguuguuacccacgcuauccgggaguuagaugcguguguagggacaacuggaagggcucuaaucggcccauaguagauauuaacgugaaagacuacuccaucgucagcucguacgugugcucuggucugguuggggacaccccucgcaagaaugauuccuucucaaguagccacugucuugacccaaacaaugaagagggaggccauggcgugaaagggugggcuuuugaugacggaaacgaugucuggaugggucgaacgaucuccgaaaaguugagaucuggcuaugagaccuucaaagugauugagggguggagcaagcccaauucaaaacugcagaucaacaggcagguaauuguugaacggggaaaucguaguggcuacuccgguauauuuagcguggaggggaagucuugcaucaaccgcuguuucuaugucgaacuaauuagaggcaggaaggaggaaacagaggugugguggacuucaaauaguaucgucguguuuugcggaaccagcggcacauacgggacuggauccuggccugacggugccgauaucaaccucaugccaauuuga

SEQ ID NO: 137334 - RNA, 1410 nt, Artificial Sequence
  derived and/or modified sequence opt3 from neuraminidase__InfluenzaA__ABI21071
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugagcgaacugggaguucccuuucauuugggcaccaaacaggugugcauugcuuggaguuccucuagcugucacgaugguaaggccuggcuccaugucugcgugacaggggacgauaagaacgcaaccgccuccuucaucuacaauggaagacugguagacucaaucguuaguuggagcaaagagauucugaggacgcaggaaucugagugugugugcauaaacggcacuuguacagucgugaugaccgauggcuccgcuucagggaaggcagacacuaaaauccucuuuauugaggaaggaaagaucgugcacacaagcaccuuaagugguucugcccaacacgucgaggaaugcuccugcuauccucgguacccaggcguucgcugugugugcagagauaauuggaaggggagcaacaggccgauaguagacauuaacaucaaagacuacucgaucgugucuuccuaugucuguucaggacuggugggcgauacgccccggaagaaugacaguagcuccucuagccauugccuugauccuaacaaugaggaaggugggcacggaguuaaaggcugggcuuucgacgauggcaacgacguguggauggggcgcaccauuucagagaaguugcgaaguggauacgagacauuuaaagucaucgaagguugguccaauccaaacagcaagcugcagauuaauagacaggugauaguagauaggggcaaccggucuggguauucaggaaucuucaguguugagggcaaaagcuguauuaaucguugcuuuuacguggaacuaauccgcgguagaaaggaggaaacugagguccucuggaccuccaacucuaucguggucuucugugggacaucgggcacuuauggaaccggcagcuggcccgacggggccgauauuaaucugaugccuauauga

SEQ ID NO: 137335 - RNA, 1410 nt, Artificial Sequence
  derived and/or modified sequence opt3 from neuraminidase__InfluenzaA__ABI21082
augaaccccaaucagaagaucauuaccauaggcagcgugucccugacaaucucuacuauuugcuucuuuaugcaaaucgccacgcucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaaugauacagugcacgaccgaacuccauaucguacccugcuuaugaacgaacugggaguucccuuucauuugggcacaaaacaggugugcaucgcuuggagcaguuccucuugucacgaugguaaggccuggcuccaugucugcgugaccggggacgauaagaaugcaacggccagcuucauuuacaacggaagacugguagacuccaucguuucauggaguaaagagauccugaggacucaggaaagcgagugugugugcauuaauggcacauguaccgucgugaugacugauggcucugcuuccgggaaggcagacacaaaaauacucuuuaucgaggaaggaaagauugugcacaccucaacguuaagcgguagugcccaacacgucgaggaaugcucuugcuauccucgguacccaggcguucgcugugugugcagagauaacuggaagggguccaacaggccgaucguagacauaaauauuaaagacuacagcaucgugucgucuuaugucuguuccggacuggugggcgauacaccccggaagaacgacucaaguagcuccucucauugccuugauccuaauaacgaggaaggugggcacggaguuaaaggcugggcuuucgacgauggcaaugacguguggauggggcgcaccaucagcgagaaguugcgaucaggauacgagacuuuuaaagucauugaagguuggaguaacccaaauuccaagcugcagaucaacagacaggugauuguagauaggggcaaucggagcggguauucuggaauauucucaguugagggcaaaaguuguaucaaccguugcuuuuacguggaacuaauucgcgguagaaaggaggaaaccgagguccucuggacaagcaauuccaucguggucuucugugggacuucuggcaccuauggaacaggcucguggcccgacggggccgauaucaaccugaugccuauuuga

SEQ ID NO: 137336 - RNA, 1410 nt, Artificial Sequence; identical to SEQ ID NO: 136752
  derived and/or modified sequence opt3 from neuraminidase__InfluenzaA__ABI21093

SEQ ID NO: 137337 - RNA, 1410 nt, Artificial Sequence
  derived and/or modified sequence opt3 from neuraminidase__InfluenzaA__ABI21104
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuuggcuaacacaaccauugagaaggaaaucugccccaaauuagcagaguacaggaauuggaguaagccucagugugacauaacuggguucgccccauuuagcaaagauaacuccauucggcugucugcgggaggugacaucuggguaacacgcgagcccuaugugucgugcgauccugacaaguguuaccaauucgcucuaggccaggggaccacgcucaauaacguccauucaaaugauacugugcacgaccgaaccccauaucguacacugcuuaugaacgaacugggaguucccuuucauuugggcacuaaacaggugugcauugccuggagcaguuccucuugucacgaugguaaggcauggcuccaugucugcgugaccggggacgauaagaaugccacagcuagcuucaucuacaacggaagacugguagacuccaucguuucauggaguaaagagauucugaggacccaggaaagcgagugugugugcauaaauggcacguguacugucgugaugacagauggcucugcauccgggaaggccgacaccaaaauccucuuuauugaggaaggaaagaucgugcacacuucaacauuaagcgguagugcucaacacgucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacuccccggaagaacgacucaaguagcuccucucauugccuugauccuaauaacgaggaaggugggcacggaguuaaaggcugggccuucgacgauggcaaugacguguggauggggcgcacgauuagcgagaaguugcgaucaggauacgagaccuuuaaagucaucgaagguuggaguaacccaaauuccaagcugcagauuaacagacaggugauaguagauaggggcaaucggagcggguauucuggaaucuucucaguugagggcaaaaacuguauuaaucguugcuuuuacguggaacuaauccgcgguagaaaggaggaaacagagguccucuggaccaguaacagcaucguggucuucugugggaccuccggcacauauggaacuggcucuuggcccgacggggcggauauuaaucugaugccuauauga

SEQ ID NO: 137338 - RNA, 1410 nt, Artificial Sequence; identical to SEQ ID NO: 136343
  derived and/or modified sequence opt3 from neuraminidase__InfluenzaA__ABI21115

SEQ ID NO: 137339 - RNA, 1410 nt, Artificial Sequence; identical to SEQ ID NO: 136343
  derived and/or modified sequence opt3 from neuraminidase__InfluenzaA__ABI21126

SEQ ID NO: 137340 - RNA, 1410 nt, Artificial Sequence; identical to SEQ ID NO: 136752
  derived and/or modified sequence opt3 from neuraminidase__InfluenzaA__ABI21137

SEQ ID NO: 137341 - RNA, 1410 nt, Artificial Sequence; identical to SEQ ID NO: 136343
  derived and/or modified sequence opt3 from neuraminidase__InfluenzaA__ABI21148

SEQ ID NO: 137342 - RNA, 1410 nt, Artificial Sequence
  derived and/or modified sequence opt3 from neuraminidase__InfluenzaA__ABI21159
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgggauaugucuguucuggccuggugggugauacgccccggaagaacgacuccucaaguagcucccauugccuugauccuaauaacgaggaagggggacacggcguuaaaggcugggcuuucgacgaugggaaugacguguggaugggacgcaccauuucugagaaguugcgaagcgguuacgagacauuuaaagucaucgaaggcuggucaaacccaaauaguaagcugcagauuaacagacaggugauaguagauagggggaaucgguccggauauagcggcaucuucucuguugaggguaaaucauguauuaaccguugcuuuuacguggaacuaauccgcgggagaaaggaggaaacugagguccucuggaccaguaauagcaucguggucuucuguggcacauccggaacuuauggcaccgggucuuggcccgacggagccgauauuaaccugaugccuauauga

SEQ ID NO: 137343 - RNA, 1410 nt, Artificial Sequence; identical to SEQ ID NO: 136343
  derived and/or modified sequence opt3 from neuraminidase__InfluenzaA__ABI21170

SEQ ID NO: 137344 - RNA, 1410 nt, Artificial Sequence; identical to SEQ ID NO: 136343
  derived and/or modified sequence opt3 from neuraminidase__InfluenzaA__ABI21181

SEQ ID NO: 137345 - RNA, 1413 nt, Artificial Sequence
  derived and/or modified sequence opt3 from neuraminidase__InfluenzaA__ABI21192
augaaccccaaucagaagaucauuaccauaggcagcaucuccauugccaucgggauuaucucucugaugcuccaaauaggaaacaucauuucaaucugggcuagucacagcauucagacagguucccagaaucauacuggcacgugcaaccagagaaucauaaccuacgaaaauucuacaugggugaaccacacuuaugucaauauuaacaauaccaacguuguggcagggaaagacaagacaucgguaacccuugccggaaauucaagccuguguaguaucuccggcugggcgauuuacacuaaagauaacucuaucaggaucgguagcaagggggacguguucgucauucgggagccuuuuauauccugcucacauuuggagugucgcacauucuuuuuaacccaaggagcucugcuaaaugauaaacacaguaacggcacggugaaggaccgaagcccauaucgugcccucaugucuugcccgcugggcgaagcacccuccccuuacaauucaaaguucgagagcguugccuggagugcuucugcaugucaugaugggaugggauggcuuacuaucgguauuuccggcccagacaacggggccguggcuguccugaaauauaacggaaucauaaccgaaacaauuaagagcuggagaaaaaggaucuugcggacucaggagucggagugcguguguguaaauggcucuugcuuuaccaucaugacagauggucccuccaacggggccgcgucauacaagauuuucaaaaucgaaaagggaaagguuaccaaaaguauugagcucaaugcaccuaacuuucacuaugaagaguguagcugcuacccagacacgggcacugugaugugugucugccgcgauaauuggcacggcuccaacagacccugggugucuuucaaucagaaccuggacuaccagauaggguauaucugcagcggaguguuuggugauaauccuaggccaaaggacggcaaagggucauguaacccggucacaguugauggagccgacggcgugaaggguuucaguuacaaauaugggaauggcguauggauuggacggaccaaguccaaccgccugcgaaaaggcuuugagaugaucugggaccccaauggguggacugauacagacagcgauuucucugugaagcaagacgucguggcuaucaccgauuggucaggauacagugguagcuuuguucagcauccugaacucacgggcuuagacugcauuagaccauguuucuggguggagcuggucagggggcuuccccgggaaaacaccacaauauggacuuccggaucuucgaucagcuucugcggcguggauuccgacaccgccaauuggucauggccugauggugcagaguugccauuuauuaucgacaaguga

SEQ ID NO: 137346 - RNA, 1413 nt, Artificial Sequence; identical to SEQ ID NO: 136402
  derived and/or modified sequence opt3 from neuraminidase__InfluenzaA__ABI21203

SEQ ID NO: 137347 - RNA, 1413 nt, Artificial Sequence
  derived and/or modified sequence opt3 from neuraminidase__InfluenzaA__ABI21214
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacauuaccucgguaacacuugccggaaauucaagccuguguaguaucuccggcugggcgaucuacaccaaggauaacucuauuaggauagguagcaaaggggacguguucgucauccgggagccuuuuauuuccugcucacauuuggagugucgcacuuucuuuuuaacacaaggagcucugcuaaaugauaagcacaguaacggcaccgugaaagaccgaagcccauaucgugcccucaugucuugcccgcugggcgaagcacccuccccuuacaauucaaaguucgagagcguugccuggagugcuucugcaugucaugaugggaugggauggcuuacgaucgguauauccggcccagacaacggggccguggcuguccugaaguauaacggaauuaucacugaaaccaucaaaagcuggaagaaaagaauuuugaggacacaggagucggagugcguguguguaaauggcucuugcuuuacuaucaugaccgauggucccuccaacggggccgcgucauacaagauuuucaaaauagaaaagggaaagguuacaaaaaguaucgagcucaaugcaccuaacuuucacuaugaagaguguagcugcuacccagacaccggcacggugaugugugucugccgggauaauuggcacggcuccaaccgccccugggugucuuucaaucagaaccuggacuaccagauuggguauaucugcagcggaguguuuggugauaauccuagaccaaaggacggcaaagggucauguaacccggucacuguugauggagccgacggcgugaaggguuucaguuacaaauaugggaauggcguauggaucggaaggacaaaguccaaccggcugcgcaaaggcuuugagaugauuugggaccccaauggguggaccgauacugacagcgauuucucugugaagcaagacgucguggcuauaacagauuggucaggauacagugguagcuuuguucagcauccugaacucaccggcuuagacugcauccgaccauguuucuggguggagcuggucagagggcuucccagggaaaacacgaccauuuggacauccggaucuucgaucagcuucugcggcguggauuccgacacugccaauuggucauggccugauggugcagaguugccauuuaccauugacaaguga

SEQ ID NO: 137348 - RNA, 1410 nt, Artificial Sequence
  derived and/or modified sequence opt3 from neuraminidase__InfluenzaA__ABI21247
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaaaaugucccaagcuggcagaguacaggaauuggucaaaaccucagugcaagauuacaggguucgccccauuuaguaaggacaacagcauccggcuauccgcgggaggugauauaugggugacccgcgagcccuaugucucuugugacccuggcaaaugcuaccaauucgcucucgggcagggaacgacucugaauaaccgacauucgaaugauaccgugcacgaccguacaccauauagaacucuucugaugaacgaauugggcguucccuuucaucucgguaccaaacagguguguauugccuggucaagcaguuccugccacgaugggaaggcauggcugcaugucugugugacaggacacgacgagaaugccaccgcuucuuucaucuacgauggcaggcugguagacagcauuggcuccuggucaaagaacauccuccggacgcaggaaagugagugcguuuguaucaaugggacuugcacaguggucaugaccgauggaagcgcaucugagcgcgccgacacuaaaauuuuauuuauagaagaggguaagaucgugcacauuuccccucugucaggcagcgcucaacauguggaagagugcaguuguuauccaagauacccgggggucaggugcguuugucgggauaacuggaagggaucuaaccgccccaucguggacauaaauguaaaagaucacuccauugugagcucguacgucugcucuggccuugugggugacacaccucgaaagaacgacuccucaaguagcuccuauuguagaaauccaaacaaugaaaaagggucucauggaaugaagggcugggccuucgaugacggcaacgauguuuggauggggaggaccaucagcgaggaguugcggucaggauacgaaacguuuaaagugaucgguggcuggaguaagcccaauuccaaacugcagauuaaccgucaggucaucguggaccgcgggaauagaagcggauauucuggcauuuucucaguagaggguaagaguugcauaaacagguguuuuuacguugaacuaauccgggggcgaaagcaggagaccgaagugugguggacaagcaauuccauugucguguucugcggcacuucuggaaccuauggcacagggucguggccugauggagcggacaucaaccucaugccaaucuga

SEQ ID NO: 137349 - RNA, 1410 nt, Artificial Sequence; identical to SEQ ID NO: 137269
  derived and/or modified sequence opt3 from neuraminidase__InfluenzaA__ABI21258

SEQ ID NO: 137350 - RNA, 1410 nt, Artificial Sequence; identical to SEQ ID NO: 137269
  derived and/or modified sequence opt3 from neuraminidase__InfluenzaA__ABI21269

SEQ ID NO: 137351 - RNA, 1410 nt, Artificial Sequence; identical to SEQ ID NO: 137269
  derived and/or modified sequence opt3 from neuraminidase__InfluenzaA__ABI21280

SEQ ID NO: 137352 - RNA, 1410 nt, Artificial Sequence; identical to SEQ ID NO: 137201
  derived and/or modified sequence opt3 from neuraminidase__InfluenzaA__ABI21302

SEQ ID NO: 137353 - RNA, 1410 nt, Artificial Sequence; identical to SEQ ID NO: 137201
  derived and/or modified sequence opt3 from neuraminidase__InfluenzaA__ABI21313

SEQ ID NO: 137354 - RNA, 1410 nt, Artificial Sequence; identical to SEQ ID NO: 137201
  derived and/or modified sequence opt3 from neuraminidase__InfluenzaA__ABI21324

SEQ ID NO: 137355 - RNA, 1410 nt, Artificial Sequence; identical to SEQ ID NO: 137201
  derived and/or modified sequence opt3 from neuraminidase__InfluenzaA__ABI21335

SEQ ID NO: 137356 - RNA, 1410 nt, Artificial Sequence; identical to SEQ ID NO: 137269
  derived and/or modified sequence opt3 from neuraminidase__InfluenzaA__ABI21346

SEQ ID NO: 137357 - RNA, 1410 nt, Artificial Sequence
  derived and/or modified sequence opt3 from neuraminidase__InfluenzaA__ABI21357
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcguucccuuucaucucgguaccaaacagguguguaucgccuggucaagcaguuccugccacgaugggaaggcauggcugcaugucugugugacaggacacgacgagaaugccaccgcuucuuucauuuacgauggcaggcugguagacagcaucggcuccuggaguaaaaacauccuccggacgcaggaaucagagugcguuuguauuaaugggacuugcacaguggucaugaccgauggaagcgcaucugagcgcgccgacacuaagauauuauuuaucgaagaggguaaaauugugcacaucuccccucugucaggcagcgcucaacauguggaagagugcaguuguuauccaagauacccgggggucaggugcguuugucgggauaacuggaagggaucuaaccgccccauaguggacauuaauguaaagaacuacuccaucgugagcucguaugucugcucuggccuugugggugauacaccucgaaagaaugacuccucaaguagcuccuacuguagaaacccaaauaacgaaaaagggucucacggaguuaaaggcugggccuucgacgauggcaaugacguguggauggggaggaccaucagcgaggaguugcggucaggauaugaaacguuuaaggucauugguggcuggaguaaacccaacuccaagcugcagaucaaucgucaggugauuguagaucgcgggaacagaagcggauacucuggcauauucucaguugaggguaaaaguugcaucaauagguguuuuuauguggaacuaauucgggggcgaaagcaggaggcggaagucugguggaccagcaacuccaucguggucuucugcggcacaucuggaacuuacggcaccgggucguggccugacggagcagauaucaaucucaugccaauuuga

SEQ ID NO: 137358 - RNA, 1410 nt, Artificial Sequence; identical to SEQ ID NO: 137201
  derived and/or modified sequence opt3 from neuraminidase__InfluenzaA__ABI21368

SEQ ID NO: 137359 - RNA, 1410 nt, Artificial Sequence; identical to SEQ ID NO: 137201
  derived and/or modified sequence opt3 from neuraminidase__InfluenzaA__ABI21379

SEQ ID NO: 137360 - RNA, 1410 nt, Artificial Sequence; identical to SEQ ID NO: 137201
  derived and/or modified sequence opt3 from neuraminidase__InfluenzaA__ABI21390

SEQ ID NO: 137361 - RNA, 1410 nt, Artificial Sequence; identical to SEQ ID NO: 137269
  derived and/or modified sequence opt3 from neuraminidase__InfluenzaA__ABI21401

SEQ ID NO: 137362 - RNA, 1410 nt, Artificial Sequence
  derived and/or modified sequence opt3 from neuraminidase__InfluenzaA__ABI21412
augaaccccaaucagaagaucauuaccauaggcagcgugucccugacaaucgccacuauuugcuuccucaugcaaaucgcuauucuugucacgaccguuacacugcacuuuaaacaguacgaguguaacccuccaccgaauaaccaggugauguugugcgaacccacuaucauagagagaaauaucaccgaaauuguauauuuaacaaacaccacuaucgagaaggaaauuuguccuaaacuggcagaguacaggaauuggucuaagccacagugcaaaaucacaggguucgcccccuuuucaaaggacaacaguauacggcuaagcgcgggaggugauauuugggugacccgcgagccuuaugucuccugugacccaggcaagugcuaccaauucgcucucgggcagggaacgacucugaauaaccgacauucuaaugauaccgugcacgaccguacacccuauagaacucuucugaugaacgaauugggcguuccuuuucaucucgguaccaaacagguguguaucgccuggucgucaagcaguugccacgaugggaaggcauggcugcaugucugugugacaggacacgacgagaaugccaccgcuuccuucauuuacgauggcaggcugguagacucuaucggcagcugguccaaaaacauccuccggacgcaggaaucagagugcguuuguauuaaugggacuugcacaguggucaugaccgauggaagugcaagcgagcgcgccgacacuaagauauuauuuaucgaagaggguaaaauugugcacaucucuccacuguccggcucagcucaacauguggaagagugcagcuguuauccgagauaccccggggucaggugcguuugucgggauaacuggaagggaaguaaccgcccuauaguggacauuaauguaaaggauuacucuaucguguccagcuaugucugcucgggccuugugggugacacaccacgaaagaacgacucuuccucaaguagcuacuguagaaaucccaacaaugaaaaagggucccacggaguuaaaggcugggccuucgaugacggcaacgauguguggauggggaggaccaucucugaggaguugcggagcggauaugaaacguuuaaggucauugguggcuggucaaaaccuaauaguaagcugcagaucaaccgucaggugauuguagaccgcgggaauagauccggauacagcggcauauucucuguugaggguaaaucaugcaucaacagguguuuuuauguggaacuaauucgggggcgaaagcaggagaccgaagucugguggacaaguaauagcaucguggucuucugcggcacuuccggaaccuacggcacagggucuuggccagauggagcggacaucaaccucaugcccauuuga

SEQ ID NO: 137363 - RNA, 1410 nt, Artificial Sequence; identical to SEQ ID NO: 136535
  derived and/or modified sequence opt3 from neuraminidase__InfluenzaA__ABI21423

SEQ ID NO: 137364 - RNA, 1410 nt, Artificial Sequence; identical to SEQ ID NO: 137201
  derived and/or modified sequence opt3 from neuraminidase__InfluenzaA__ABI21434

SEQ ID NO: 137365 - RNA, 1410 nt, Artificial Sequence; identical to SEQ ID NO: 137269
  derived and/or modified sequence opt3 from neuraminidase__InfluenzaA__ABI21445

SEQ ID NO: 137366 - RNA, 1410 nt, Artificial Sequence; identical to SEQ ID NO: 137269
  derived and/or modified sequence opt3 from neuraminidase__InfluenzaA__ABI21456

SEQ ID NO: 137367 - RNA, 1410 nt, Artificial Sequence; identical to SEQ ID NO: 137362
  derived and/or modified sequence opt3 from neuraminidase__InfluenzaA__ABI21467

SEQ ID NO: 137368 - RNA, 1410 nt, Artificial Sequence; identical to SEQ ID NO: 137269
  derived and/or modified sequence opt3 from neuraminidase__InfluenzaA__ABI21478

SEQ ID NO: 137369 - RNA, 1410 nt, Artificial Sequence; identical to SEQ ID NO: 137269
  derived and/or modified sequence opt3 from neuraminidase__InfluenzaA__ABI21489

SEQ ID NO: 137370 - RNA, 1410 nt, Artificial Sequence; identical to SEQ ID NO: 137269
  derived and/or modified sequence opt3 from neuraminidase__InfluenzaA__ABI21500

SEQ ID NO: 137371 - RNA, 1410 nt, Artificial Sequence
  derived and/or modified sequence opt3 from neuraminidase__InfluenzaA__ABI21511
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccggcaaucauagagagaaauaucacugaaauuguauauuuaaccaacacaaccaucgagaaggaaaugugucccaaacuggccgaguacaggaauuggucaaagccucagugcaacauuacuggguucgcgccauuuaguaaagacaauagcauccggcuauccgcuggaggugauauaugggugacacgcgagcccuaugucucuugugacccugauaagugcuaccaauucgcccucggccaggggaccacgcugaacaauggacauucgaacgacacugugcacgaucgaaccccauaucguacacuucugaugaaugaauugggcguucccuuucaucucgguacuagacagguguguauugcauggucaagcaguuccugccacgacgggaaggccuggcugcaugucugugugaccggagaugacgagaacgcuacagcaucuuucaucuacgauggcaggcugguagacagcauuggcuccuggaguaaaaagauccuccggacccaggaaucagagugcguuuguaucaaugggacgugcacuguggucaugacagauggaagcgccucugguaaagcugacaccaagauuuuauuuauagaggaaggcaaaaucgugaacauuuccacucugucagggagcgcccaacacguggaggaaugcaguuguuauccucgcuacccaggagucagaugcguuuguagggauaacuggaagggcucuaaucggccgaucguggacauaaacguaaaggacuacuccauugugagcucguaugucugcucuggucuugugggggauacaccccgcaaaaaugacuccuucucaaguagccacuguuuggauccuaacaaugaggaaggaggccauggcguuaaggggugggcguuugacgauggaaacgacguguggaugggucgaaccaucuccgagaaacugagaucuggcuacgagacguucaaggucaucgaaggguggagcaaaccaaauucaaagcuacagauuaacaggcaagugaucguagagcggggaaaucguaguggcuauuccgguauuuuuagcguugaagggaaaucuugcauaaaccgcuguuucuacguggagcucaucagaggcaggaaggaagagaccgaggucugguggacaucaaauaguauuguggucuuuugcggaacuagcggcaccuaugggacaggauccuggcccgauggugcagacaucaaccugaugccuaucuga

SEQ ID NO: 137372 - RNA, 1413 nt, Artificial Sequence
  derived and/or modified sequence opt3 from neuraminidase__InfluenzaA__ABI21533
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugugaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucaugcgggagccuuuuauauccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgaucgguauuuccggcccagacaacggggccguggcuguccugaaauauaacggaaucauaacugaaaccauuaagagcuggaaaaagagaaucuugaggacacaggagucggagugcguguguguaaauggcucuugcuuuacuaucaugaccgauggucccuccaacggggccgcgucauacaaaauuuucaagaucgaaaagggaaaaguuauuaagaguauagagcucaaugcaccuaacagccacuaugaagaguguuccugcuacccagacacaggcaccgugaugugugucugccgggauaauuggcacggcucuaaccgccccugggugagcuuuaaucagaaccuggacuaccagaucggguauauuugcucaggaguguucggugauaauccuagaccaaaagacggcgaggggaguuguaacccggucacgguugauggagccgacggcgugaaggguuuuuccuacaaauaugggaauggcguauggaucggaaggacuaagagcaaccggcugcgcaaaggcuucgaaaugaucugggaccccaauggguggacagauaccgacucugauuuuucagugaagcaagacgucguggcuauuacugauuggaguggauacagcgguuccuucguucagcauccugagcucacaggcuuagacugcauacgaccauguuuuuggguggaacuggucagagggaggccccgggagaacaccacgaucuggaccucuggaucgagcauuuccuucugcggcgucaauucagauacagccaacuggaguuggccugacggugcagaacuuccauucacuaucgauaaguga

SEQ ID NO: 137373 - RNA, 1413 nt, Artificial Sequence; identical to SEQ ID NO: 137372
  derived and/or modified sequence opt3 from neuraminidase__InfluenzaA__ABI21544

SEQ ID NO: 137374 - RNA, 1413 nt, Artificial Sequence; identical to SEQ ID NO: 137372
  derived and/or modified sequence opt3 from neuraminidase__InfluenzaA__ABI21555

SEQ ID NO: 137375 - RNA, 1413 nt, Artificial Sequence; identical to SEQ ID NO: 137372
  derived and/or modified sequence opt3 from neuraminidase__InfluenzaA__ABI21566

SEQ ID NO: 137376 - RNA, 1413 nt, Artificial Sequence; identical to SEQ ID NO: 137372
  derived and/or modified sequence opt3 from neuraminidase__InfluenzaA__ABI21577

SEQ ID NO: 137377 - RNA, 1413 nt, Artificial Sequence
  derived and/or modified sequence opt3 from neuraminidase__InfluenzaA__ABI22112
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgagaauagcaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggaaccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacgaaauaauuacugagaccaucaagagcuggaaaaagagaaucuugaggacacaggagucggaaugcguguguguaaauggaucuugcuuuacuauuaugaccgauggccccuccaacggugccgcgucauacaaaaucuucaagauugagaaggggaaaguuacaaagaguauagaacucaaugcaccuaacuuucacuaugaggaguguagcugcuacccagacaccggaacggugaugugugucugccgggauaauuggcacggcuccaaccgccccugggugucuuucaaucagaaccuggacuaccagaucggcuauauuugcagcgggguguuuggagauaauccuagaccaaaagacgguaagggcucauguaacccggucacuguugauggggccgacggagugaaaggcuucaguuacaaguaugguaaugggguauggaucggcaggacaaaauccaaccggcugcgcaagggauuugaaaugaucugggaccccaauggcuggaccgauacugacagcgauuucucugugaagcaagacgucguggcuauuacagauuggucaggguacaguggaucuuuuguucagcauccugagcucaccgguuuagacugcauacgaccauguuucuggguggaacuggucagaggccuucccagggagaacacgaccaucuggacauccgggucuucgauuagcuucugcggaguggauuccgacacugccaauuggucauggccugauggcgcagaauugccauuuaccaucgacaaauga

SEQ ID NO: 137378 - RNA, 1410 nt, Artificial Sequence
  derived and/or modified sequence opt3 from neuraminidase__InfluenzaA__ABI22162
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagacuaauagacaggugauuguagacaggggcaaccggagcggguauucuggaauauucucaguugagggcaaaaguuguaucaaucguugcuuuuacguggaacuaauucgcgguagaaaggaggaaaccgagguccucuggacaagcaacuccaucguggucuucugugggacuucuggcaccuauggaacaggcucguggcccgauggggccgacaucgaucugaugccuauuuga

SEQ ID NO: 137379 - RNA, 1350 nt, Artificial Sequence
  derived and/or modified sequence opt3 from neuraminidase__InfluenzaA__ABI23981
augaaccccaaucagaagaucauuaccauaggcagcaucugcauggugauugggaucgucucccugaugcuccaaauuggaaacaugaucucuauauggguuucacacaguauccagacagguaaucagagacaggccgagagcauuuccaacacuaaauuccuuacggaaaaggcuguggcaucuguaacccuggccggcaauucgucauuguguccuaucagcgggugggcgguguacaguaaagacaacuccauuaggaucggaucucggggcgaugucuuugugauacgcgagccauucauuagcugcucccauuuagaaugucgaacauuuuuccugacucaaggugcucuacucaaugacaagcacucaaacgggaccguuaaagaucguaguccguauagaacacugaugagcucucccgugggagaggccccuuccccauacaauucaagguuugaaagcgucgcauggagugccucugcuugccaugacggcaccuccuggcuuacuaucggcauuagcgggcccgauaacggagcaguggccguacugaaguauaaugguaucaucacagacaccauuaagucguggcggaacaauauauugcgcacgcaggagucugagugugcuugcguuaacggcuccuguuucacugugaugaccgaugggccuucaaauggacaggccaguuacaaaaucuuuaagauggaaaaaggcaaggucgugaaaagcguggagcucgacgcgccaaacuaucacuacgaagagugcuccuguuaucccgaugccggugagauuacaugcgucuguagagacaacuggcaugggucuaauaggccuuggguuagcuucaaccagaaucuggaauaccaaaucggauacauaugcucaggcguguuuggcgauaacccacggccgaaugacgggacuggaaguugcggucccguaucccugaacggcgcauauggggugaagggauucagcuuuaaguacggcaauggugucuggauugggcgcaccaaaucuacaaacucacgaaguggcuucgagaugaucugggauccuaauggauggaccggcacggacagcuccuuuucugugaagcaggacaucguugcuauuacugauuggucgggguauagcggauccuucgugcagcacccagaacucacagguuuagacuguaucagacccugcuucugggucgagcugauuaggggccggccuaaagaaucaaccauauggacaagugggucuagcaucuccuuuuguggagugaacucagauacuguaagcuggucuuggccagacggcgccgagcuucccuucaccauugauaaguga

SEQ ID NO: 137380 - RNA, 1410 nt, Artificial Sequence; identical to SEQ ID NO: 136343
  derived and/or modified sequence opt3 from neuraminidase__InfluenzaA__ABI26649

SEQ ID NO: 137381 - RNA, 1413 nt, Artificial Sequence; identical to SEQ ID NO: 137066
  derived and/or modified sequence opt3 from neuraminidase__InfluenzaA__ABI30370

SEQ ID NO: 137382 - RNA, 1410 nt, Artificial Sequence; identical to SEQ ID NO: 137117
  derived and/or modified sequence opt3 from neuraminidase__InfluenzaA__ABI30392

SEQ ID NO: 137383 - RNA, 1410 nt, Artificial Sequence; identical to SEQ ID NO: 136746
  derived and/or modified sequence opt3 from neuraminidase__InfluenzaA__ABI30403

SEQ ID NO: 137384 - RNA, 1410 nt, Artificial Sequence; identical to SEQ ID NO: 136746
  derived and/or modified sequence opt3 from neuraminidase__InfluenzaA__ABI30414

SEQ ID NO: 137385 - RNA, 1410 nt, Artificial Sequence; identical to SEQ ID NO: 136343
  derived and/or modified sequence opt3 from neuraminidase__InfluenzaA__ABI30425

SEQ ID NO: 137386 - RNA, 1410 nt, Artificial Sequence; identical to SEQ ID NO: 136343
  derived and/or modified sequence opt3 from neuraminidase__InfluenzaA__ABI30436

SEQ ID NO: 137387 - RNA, 1410 nt, Artificial Sequence; identical to SEQ ID NO: 136343
  derived and/or modified sequence opt3 from neuraminidase__InfluenzaA__ABI30447

SEQ ID NO: 137388 - RNA, 1410 nt, Artificial Sequence; identical to SEQ ID NO: 136343
  derived and/or modified sequence opt3 from neuraminidase__InfluenzaA__ABI30458

SEQ ID NO: 137389 - RNA, 1410 nt, Artificial Sequence; identical to SEQ ID NO: 136343
  derived and/or modified sequence opt3 from neuraminidase__InfluenzaA__ABI30469

SEQ ID NO: 137390 - RNA, 1410 nt, Artificial Sequence; identical to SEQ ID NO: 136343
  derived and/or modified sequence opt3 from neuraminidase__InfluenzaA__ABI30480

SEQ ID NO: 137391 - RNA, 1410 nt, Artificial Sequence
  derived and/or modified sequence opt3 from neuraminidase__InfluenzaA__ABI30491
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccaagaucguguauuugacaaacaccacuauugaaaaagagaucugccccaaguuagcugaauacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgagcugggaguucccuuucauuugggcaccaaacaggugugcauugcuuggagcaguuccucuugucacgaugguaaggccuggcuccaugucugcgugacaggggacgauaaaaaugcaaccgccagcuucaucuacaacggaagacugguagacuccaucguuucauggaguaaggaaauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgacucaaguagcuccucucauugccuugauccuaauaacgaagagggugggcacggaguuaagggcugggcuuucgacgauggcaaugacguguggauggggcgcaccauuagcgaaaaauugcgaucaggauacgagacauuuaaggucaucgaggguuggaguaacccaaauuccaaacugcagauuaacagacaggugauaguagauaggggcaaucggagcggguauucuggaaucuucucaguugaaggcaagaguuguauuaaccguugcuuuuacguggagcuaauccgcgguagaaaggaagagacugaaguccucuggaccagcaauuccaucguggucuucugugggacaucuggcacuuauggaaccggcucguggcccgacggggccgauauuaaccugaugccuauauga

SEQ ID NO: 137392 - RNA, 1410 nt, Artificial Sequence; identical to SEQ ID NO: 136343
  derived and/or modified sequence opt3 from neuraminidase__InfluenzaA__ABI30502

SEQ ID NO: 137393 - RNA, 1410 nt, Artificial Sequence
  derived and/or modified sequence opt3 from neuraminidase__InfluenzaA__ABI30513
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuugauccuaauaacgaggaaggugggcacggaguuaaaggcugggcuuucgacgauggcaaugacguguggauggggcgcaccauuagcgagaaguugcgaucaggauacgagacauuuaaagucaucgaagguuggaguaacccaaauuccaagcugcagacuaacagacaggugauuguagauaggggcaaucggagcggguauucuggaauauucucaguugagggcaaaaguuguaucaaccguugcuuuuacguggaacuaauucgcgguagaaaggaggaaaccgagguccucuggacaagcaauuccaucguggucuucugugggacuucuggcaccuauggaacaggcucguggcccgacggggccgauaucaaccugaugccuauuuga

SEQ ID NO: 137394 - RNA, 1410 nt, Artificial Sequence; identical to SEQ ID NO: 136343
  derived and/or modified sequence opt3 from neuraminidase__InfluenzaA__ABI30524

SEQ ID NO: 137395 - RNA, 1410 nt, Artificial Sequence; identical to SEQ ID NO: 136343
  derived and/or modified sequence opt3 from neuraminidase__InfluenzaA__ABI30535

SEQ ID NO: 137396 - RNA, 1410 nt, Artificial Sequence
  derived and/or modified sequence opt3 from neuraminidase__InfluenzaA__ABI30546
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaaccugcauucaaaugauaccguccacgaccgaacaccauaucguacucuucugaugagcgaauugggagugcccuuucaucucggcaccaagcagguuugcauugcuuggaguuccucuagcugucacgaugguaaagccuggaugcaugugugcgucacaggggacgauaagaacgcaaccgccuccuucaucuacaauggaagacugguggacucaaucguaaguuggagcaaagagauucugaggacgcaggaaucugaguguguuugcauaaacggcacuuguacaguggucaugaccgauggcuccgcuucagggaaggcagacacuaaaauccucuuuauugaggaaggaaagaucgugcacacaagcaccuuaagugguucugcccaacacguggaggaaugcuccugcuauccucgguacccaggcguccgcuguguuugcagagauaauuggaaggggagcaacaggccgauaguggacauuaacaucaaagacuacucgaucguaucuuccuauguguguucaggacuggucggcgauacgccccggaagaaugacaguagcuccucuagccauugccuugauccuaacaaugaggaaggugggcacggagugaaaggcugggcuuucgacgauggcaacgacguuuggauggggcgcaccauuucagagaaguugcgaaguggauacgagacauuuaaagugaucgaagguugguccaauccaaacagcaagcugcagauuaauagacaggucauaguggauaggggcaaccggucuggguauucaggaaucuucaguguagagggcaaaaauuguauuaaccguugcuuuuacguugaacuaauccgcgguagaaaggaggaaacugaggugcucuggaccagcaauuccaucgucguguucugugggacaucuggcacuuauggaaccggcucguggcccgacggggccgauauuaaccugaugccuauauga

SEQ ID NO: 137397 - RNA, 1410 nt, Artificial Sequence; identical to SEQ ID NO: 136343
  derived and/or modified sequence opt3 from neuraminidase__InfluenzaA__ABI30557

SEQ ID NO: 137398 - RNA, 1410 nt, Artificial Sequence; identical to SEQ ID NO: 136730
  derived and/or modified sequence opt3 from neuraminidase__InfluenzaA__ABI30579

SEQ ID NO: 137399 - RNA, 1410 nt, Artificial Sequence
  derived and/or modified sequence opt3 from neuraminidase__InfluenzaA__ABI30590
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgacucaaguagcuccucucauugccuugauccuaauaacgaagagggugggcacggaguuaagggcugggcuuucgacgauggcaaugacguguggauggggcgcaccauuagcgaaaaauugcgaucaggauacgagacauuuaaggucaucgaggguuggaguaacccaaauuccaaacugcagauuaacagacaggugauaguagauaggggcaaucggagcggguauucuggaaucuucucaguugaaggcaaggguuguauuaaccguugcuuuuacguggagcuaauccgcgggagaaaggaagagacugaaguccucuggaccaguaauagcaucguggucuucuguggcacauccggaacuuauggcaccgggucuuggcccgacggagccgauauuaaccugaugccuauauga

SEQ ID NO: 137400 - RNA, 1410 nt, Artificial Sequence; identical to SEQ ID NO: 136823
  derived and/or modified sequence opt3 from neuraminidase__InfluenzaA__ABI30601

SEQ ID NO: 137401 - RNA, 1410 nt, Artificial Sequence
  derived and/or modified sequence opt3 from neuraminidase__InfluenzaA__ABI30612
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucauacacacaucaaccuuaagcgguagugcccaacacguggaggaaugcucuugcuauccucgguacccaggcguccgcuguguuugcagagacaacuggaagggguccaauaggccgauuguggauaucaacaucaaagacuacagcauuguaucgucuuauguguguuccggacuggucggcgacacgccccggaagaaugauucaaguagcuccucucauugccuugacccuaacaaugaggaaggugggcacggagugaaaggcugggcuuucgaugacggcaacgauguuuggauggggcgcaccaucagcgagaaguugcgaucaggauacgagacauuuaaagugauugaagguuggaguaauccaaacuccaagcugcagauaaauagacaggucaucguggacaggggcaaccggagcggguauucuggaauuuucucaguagagggcaaaaguuguaucaaucguugcuuuuacguugaacuaauccgcgguagaaaggaggaaacugaggugcucuggaccagcaacuccauugucguguucugugggacaucuggcacuuauggaaccggcucguggcccgauggggccgacauaaaucugaugccuaucuga

SEQ ID NO: 137402 - RNA, 1410 nt, Artificial Sequence; identical to SEQ ID NO: 136823
  derived and/or modified sequence opt3 from neuraminidase__InfluenzaA__ABI30623

SEQ ID NO: 137403 - RNA, 1410 nt, Artificial Sequence
  derived and/or modified sequence opt3 from neuraminidase__InfluenzaA__ABI30736
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcguggucucgucuuauguguguuccggacugguuggcgauacgccccggaaaaacgacucaaguagcuccucucauugccuugauccuaauaacgaagagggugggcacggagugaagggcugggcuuucgacgauggcaaugacgucuggauggggcgcaccaucagcgaaaaauugcgaucaggauacgagacauuuaaggugauugaggguuggaguaacccaaauuccaaacugcagaucaacagacagguaauuguugauaggggcaaucggagcggguauucuggaauauucucaguggaaggcaagaguuguaucaaccguugcuuuuacgucgagcuaauucgcgguagaaaggaagagacugaagugcucuggaccagcaauuccaucgucguguucugugggacaucuggcacuuauggaaccggcucguggcccgacggggccgauaucaaccugaugccuauuuga

SEQ ID NO: 137404 - RNA, 1410 nt, Artificial Sequence
  derived and/or modified sequence opt3 from neuraminidase__InfluenzaA__ABI30758
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcuguaugaaccgacuauaaucgagagaaauauuaccgaaaucguguacuugacaaacaccacuauugagaaggaaaucugucccaaauuagcugaguauaggaauuggaguaagccucagugcgacauaacaggguucgcaccauuuagcaaagauaacuccauucggcugucugccggaggugacaucuggguaacccgcgagcccuacgugucgugugauccugacaagugcuaucaauucgcgcuaggccaggggacgacucucaauaacguccauucaaaugauaccgugcacgaccgaacaccauaccguacucugcuuaugaacgaacugggaguucccuuucauuugggcaccaaacagguguguauugcuuggagcaguuccucuugccacgaugguaaggccuggcuccaugucugugugacaggggacgauaagaaugcaaccgccagcuucaucuauaacggaagacugguagacuccaucguuucauggaguaaaaagauucugaggacgcaggagagcgaaugcguguguauaaauggcacuugcacagucgugaugaccgauggcucugcuuccgggaaagcagacacuaagauccucuuuauugaggagggaaagaucgugcacacaucaaccuuaagcgguagugcccaacacgucgaagaguguucuugcuacccucgguacccaggcguucgcugcguguguagagauaacuggaaaggguccaacaggccgauaguagacauuaauaucaaggacuauagcaucgugucgucuuacgucugcuccggacuggugggcgauacgccccggaaaaacgacucaaguagcuccucucauugucuugauccuaauaacgaagagggugggcacggaguuaagggcugggcuuucgacgauggcaaugacguguggauggggcgcaccauuagcgaaaaauugcgaucaggauaugagacauuuaaggucaucgaggguuggaguaacccaaauuccaaacugcagauuaacagacaggugauaguagauaggggcaaucggagcggguacucuggaaucuucucaguugaaggcaagaguugcauuaaccguuguuuuuauguggagcuaauccgcgguagaaaggaagagacugaaguccucuggaccagcaauuccaucguggucuucugcgggacaucuggcacuuacggaaccggcucguggcccgacggggccgauauuaaccugaugccuauauga

SEQ ID NO: 137405 - RNA, 1410 nt, Artificial Sequence; identical to SEQ ID NO: 136730
  derived and/or modified sequence opt3 from neuraminidase__InfluenzaA__ABI30769

SEQ ID NO: 137406 - RNA, 1410 nt, Artificial Sequence; identical to SEQ ID NO: 136730
  derived and/or modified sequence opt3 from neuraminidase__InfluenzaA__ABI30780

SEQ ID NO: 137407 - RNA, 1410 nt, Artificial Sequence; identical to SEQ ID NO: 136730
  derived and/or modified sequence opt3 from neuraminidase__InfluenzaA__ABI30791

SEQ ID NO: 137408 - RNA, 1410 nt, Artificial Sequence; identical to SEQ ID NO: 136730
  derived and/or modified sequence opt3 from neuraminidase__InfluenzaA__ABI30802

SEQ ID NO: 137409 - RNA, 1410 nt, Artificial Sequence; identical to SEQ ID NO: 136730
  derived and/or modified sequence opt3 from neuraminidase__InfluenzaA__ABI30813

SEQ ID NO: 137410 - RNA, 1410 nt, Artificial Sequence; identical to SEQ ID NO: 136730
  derived and/or modified sequence opt3 from neuraminidase__InfluenzaA__ABI30824

SEQ ID NO: 137411 - RNA, 1410 nt, Artificial Sequence; identical to SEQ ID NO: 136730
  derived and/or modified sequence opt3 from neuraminidase__InfluenzaA__ABI30835

SEQ ID NO: 137412 - RNA, 1410 nt, Artificial Sequence; identical to SEQ ID NO: 136730
  derived and/or modified sequence opt3 from neuraminidase__InfluenzaA__ABI30846

SEQ ID NO: 137413 - RNA, 1410 nt, Artificial Sequence; identical to SEQ ID NO: 137201
  derived and/or modified sequence opt3 from neuraminidase__InfluenzaA__ABI30857

SEQ ID NO: 137414 - RNA, 1410 nt, Artificial Sequence; identical to SEQ ID NO: 137201
  derived and/or modified sequence opt3 from neuraminidase__InfluenzaA__ABI30868

SEQ ID NO: 137415 - RNA, 1350 nt, Artificial Sequence
  derived and/or modified sequence opt3 from neuraminidase__InfluenzaA__ABI36157
augaaccccaaucagaagaucauuaccauaggcagcaucugcauggccauugggacagugucccugaugcuccaaaucggaaacaugauuucuaucugggucucacacaguauacagacugguaaucagcaucaggcugagagcaucuccaacacgaauccucuuaccgaaaaagcaguugccucugugacacuggcgggcaacucgucauuguguccaauuagagggugggcuguacacagcaaggacaauaguaucaggauuggauccaaaggcgauguguucgucauccgggagccguuuauaucuugcagccauuccgaaugucgcacuuucuuuuuaacccaaggugcccugcuaaacgacaagcacucaaaugagacagugaaagaucgaaguccccaucguacccucaugagcugcccuguuggggaagcaccaucucccuacaacuccagauucgagucaguggccuggagcgcuagugcaugucacgacggaacuucuuggcugacaauuggcaucuccggcccugauaauggggccgucgcugugcuuaaguauaacggaauuaucaccgacacgaucaagagcuggaggaauaacauucugcggacucaggagucggaaugcgccuguguaaaugguucuugcuuuaccguuaugacagauggcccauccaacgggcaggcgucauacaaaauauucaagauggagaaaggaaagguggucaaaaguguggaauuggacgcacccaacuaucacuacgaggaguguagcugcuauccugaugccggcgaaaucacuugugugugccgcgacaauuggcaugguuccaacagaccaugggucucuuuuaaucagaaccucgaguaccaaauuggguauaucugcagcggaguuuucggcgauaauccgaggcccaacgacggcaccgggucauguggaccuaugaguuccaauggugcuuacggcgugaagggguuuagcuucaaguacggaaacggcguauggauaggucggacaaaaucuaccaauucacgcaguggguuugaaaugauuugggauccaaacggcuggacgggaacugacagcuccuucucugugaagcaggacaucgucgccaucacagauuggucgggcuauagcggguccuuugugcagcaccccgagcugaccggacuggacugcauucgaccuuguuucuggguugaacucaucagagguaggccaaaagagucaacuauuuggacaaguggcucuagcauauccuucugcggggucaauucagauaccgugagcuggucuuggcccgacggagcagaguuaccguuuacgaucgauaaguga

SEQ ID NO: 137416 - RNA, 1350 nt, Artificial Sequence; identical to SEQ ID NO: 137415
  derived and/or modified sequence opt3 from neuraminidase__InfluenzaA__ABI36168

SEQ ID NO: 137417 - RNA, 1350 nt, Artificial Sequence; identical to SEQ ID NO: 137415
  derived and/or modified sequence opt3 from neuraminidase__InfluenzaA__ABI36179

SEQ ID NO: 137418 - RNA, 1350 nt, Artificial Sequence; identical to SEQ ID NO: 137415
  derived and/or modified sequence opt3 from neuraminidase__InfluenzaA__ABI36189

SEQ ID NO: 137419 - RNA, 1350 nt, Artificial Sequence
  derived and/or modified sequence opt3 from neuraminidase__InfluenzaA__ABI36278
augaaccccaaucagaagaucauuaccauaggcagcaucugcauggugauugggaucgucucccugaugcuccaaauuggaaacaugaucucuauauggguuucacacaguauccagaaagguaaucagcaucaggccgagagcauuuccaacacaaauccucuuacugaaaaggcuguggcaucuguaacgcuggccggcaacucgucauuguguccaaucagagggugggcggugcacagcaaagacaauaacauuaggaucggaaguaagggcgaugucuucgugauacgggagccguuuauuuccugcucucauuuagaaugucgcaccuucuuucugacacaaggugcucuacucaaugacaaacacagcaacgggacuguuaaggaucgaucaccccaucguacccugauguccugcccugugggagaggccccaagucccuacaauagcagauucgaaucugucgcaugguccgccucagcuugucacgacggcacaagcuggcuuaccaucggcauuagugggccugauaacgaggcaguggccguacugaaguauaauggaaucaucacugacacaauuaaaucuuggaggaacaauauauugcggacccaggaguccgaaugcgcuuguguuaacgguagcugcuuuacggugaugacugauggcccaucgaacgggcaggccucuuacaagaucuucaaaauggagaagggaaaagucgugaaguccguggaacucgacgcgcccaauuaucacuacgaggaguguucaugcuauccugaugcaggcgaaauuaccugugucugccgcgacaacuggcaugguaguaauagaccauggguuagcuuuaaccagaaucuggaguaccaaaucggguauauaugcuccggaguguucggcgauaacccgaggcccaaugacggcacagggucuuguggaccuaugagcccaaacggugccuacggcguaaagggguuuucauucaaauacggaaauggcguguggauuggucggacuaagaguaccaacucccgcagcggguuugaaaugaucugggaucccaauggcuggacaggaaccgacucuucauucagugucaaacaggacaucguggcuauuacggauuggagcggcuauuccgggucuuuuguucagcacccugagcugacuggacucgacugcauccgaccauguuucuggguggaauuaauuagagguaggcccaaggagucgacaauauggaccagcggcuccucaaucaguuucugcggggucaacucugauacugugagcugguccuggccggacggagccgagcugccuuuuacaauugauaaauga

SEQ ID NO: 137420 - RNA, 1350 nt, Artificial Sequence; identical to SEQ ID NO: 137419
  derived and/or modified sequence opt3 from neuraminidase__InfluenzaA__ABI36287

SEQ ID NO: 137421 - RNA, 1350 nt, Artificial Sequence; identical to SEQ ID NO: 137419
  derived and/or modified sequence opt3 from neuraminidase__InfluenzaA__ABI36298

SEQ ID NO: 137422 - RNA, 1350 nt, Artificial Sequence
  derived and/or modified sequence opt3 from neuraminidase__InfluenzaA__ABI36314
augaaccccaaucagaagaucauuaccauaggcagcaucugcauggugauugggaucgucucccugaugcuccaaauuggaaacaugaucucuauauggguuucacacaguauccagacagguaaucagcaucaggccgagagcauuuccaacacuaauccucuuacggaaaaagcuguggcaucuguaacccuggccggcaacucgucauuguguccaaucagagggugggcggugcacagcaaggacaauaacauuaggaucggaaguaaaggcgaugucuucgugauacgggagccguuuauuuccugcucucauuuagaaugucgcacauucuuucugacucaaggugcucuacucaaugacaagcacagcaacgggaccguuaaagaucgaucaccccaucguacacugauguccugcccugugggagaggccccaagucccuacaauagcagauucgaaucugucgcaugguccgccucagcuugucacgacggcaacagcuggcuuaccaucggcauuagugggccugauaaugaggcaguggccguacugaaguauaacggaaucaucacugacacaauuaagucuuggaggaauaacauauugcggacccaggaguccgaaugcgcuuguguuaacgguagcugcuuuacggugaugacugauggcccaucgaaugggcaggccucuuacaaaaucuucaagauggagaaaggaaaggucgugaaauccguggaacucgacgcgcccaacuaucacuacgaggaguguucaugcuauccugaugcaggcgaaauuaccugugucugccgcgacaauuggcaugguaguaacagaccauggguuagcuuuaaucagaaccuggaguaccaaaucggguauauaugcuccggaguguucggcgauaauccgaggcccaacgacggcacagggucuuguggaccuaugagcccaaauggugccuacggcguaaagggguuuucauucaaguacggaaacggcguguggauuggucggacuaaaaguaccaauucccgcagcggguuugaaaugaucugggaucccaacggcuggacaggaaccgacucuucauucagugucaagcaggacaucguggcuauuacggauuggagcggcuauuccgggucuuuuguucagcacccugagcugacuggacucgacugcauccgaccauguuucuggguggaauuaauuagagguaggcccaaagagucgacaauauggaccagcggcuccucaaucaguuucugcggggucaauucugauacugugagcugguccuggccggacggagccgagcugccuuuuacaauugauaaguga

SEQ ID NO: 137423 - RNA, 1350 nt, Artificial Sequence
  derived and/or modified sequence opt3 from neuraminidase__InfluenzaA__ABI36336
augaaccccaaucagaagaucauuaccauaggcagcaucugcauggugauugggaucgucucccugaugcuccaaauuggaaacaugaucucuauauggguuucacacagugugcagacagguaaucagcaucaggccgagagcaucuccaacacuaauccucuuacggaaaaagcuguagcaucugugacccuggccggcaacucgucauuguguccaauuagagggugggcgguccacagcaaggacaauaacaucaggauuggaaguaaaggcgauguguucguuauccgggagccguuuauauccugcucucauuuagaaugucgcacauucuuucugacucaaggugcucuacucaaugacaagcacagcaacgggaccgugaaagaucgaucaccccaucguacacugauguccugcccucuuggagaggccccaagucccuacaauagcagauucgaaucugucuccuggucagcaagcgccugucacgacggcaccaguuggcugacuauuggcaucucugggccugauaacgaggcuguggcaguauugaaguauaauggaauuaucacagacaccaucaaguccuggaggaacaauauucuccggacgcaggagagcgaaugcgccuguguuaacgguucgugcuuuacugugaugaccgauggcccaucuaacgggcaggcuuccuacaaaauauucaagauggagaaaggaaaggucgugaaaucaguggaacuggacgcccccaauuaucacuacgaggaguguaguugcuauccugaugcgggcgaaaucacaugugucugccgcgacaacuggcaugguagcaauagaccauggguuuccuuuaaccagaaucuggaguaccaaauuggguauaucugcucuggaguguucggcgauaacccgaggcccaaugacggcacugggagcuguggaccuaugucaccaaacggugcauacggcguaaagggguuuaguuucaaguacggaaauggcguguggauaggucggaccaaauccacaaacagccgcucuggguuugaaaugauuugggaucccaauggcuggaccggaacggacucaaguuucagcgucaagcaggacaucguggccaucacugauugguccggcuauucugggucguuuguucagcacccugagcucacaggauuagacugcauucgaccauguuucuggguggaacugaucagagguaggcccaaagagagcaccauuuggacuuccggcucaauaaucaguuucugcggggucaacucugauacagugagcugguccuggccggacggagcugagcuuccuuuuaccauugauaaguga

SEQ ID NO: 137424 - RNA, 1350 nt, Artificial Sequence
  derived and/or modified sequence opt3 from neuraminidase__InfluenzaA__ABI36358
augaaccccaaucagaagaucauuaccauaggcagcaucugcauggugauugggaucgucucccugaugcuccaaauuggaaacaugaucucuauauggguuucacacagugugcagacagguaaucagcaucaggccgagagcaucuccaacacuaauccucuuacggaaaaagcuguagcaucugugacccuggccggcaacucgucauuguguccaauuagagggugggcgguccacagcaaggacaauaacaucaggauuggaaguaaaggcgauguguucguuauccgggagccguuuauauccugcucucauuuagaaugucgcacauucuuucugacucaaggugcucuacucaaugacaagcacagcaacgggaccgugaaagaucgaucaccccaucguacacugauguccugcccugucggagaggccccaagucccuacaauagcagauucgaaucuguggcaugguccgccucagcuugucacgacggcaccagcuggcuuacuauuggcaucagugggccugauaacgaggcaguagccguucugaaguauaauggaauuaucacagacaccaucaagucuuggaggaacaauauuuugcggacgcaggaguccgaaugcgcuugugugaacgguagcugcuuuacugucaugaccgauggcccaucgaacgggcaggccucuuacaaaauauucaagauggagaaaggaaagguggugaaauccgucgaacucgacgcgcccaauuaucacuacgaggaguguucaugcuauccugaugcaggcgaaaucacauguguuugccgcgacaacuggcaugguaguaauagaccaugggugagcuuuaaccagaaucuggaguaccaaauuggguauaucugcuccggaguauucggcgauaacccgaggcccaaugacggcacugggucuuguggaccuaugagcccaaacggugccuacggcgugaagggguuuucauucaaguacggaaauggcgucuggauaggucggaccaaaaguacaaacucccgcagcggguuugaaaugauuugggaucccaauggcuggaccggaacggacucuucauucagugugaagcaggacaucguugcuaucacugauuggagcggcuauuccgggucuuuugugcagcacccugagcugacaggacucgacugcauucgaccauguuucugggucgaauuaaucagagguaggcccaaagagucgaccauuuggacuagcggcuccucaauaaguuucugcggggugaacucugauacaguaagcugguccuggccggacggagccgagcugccuuuuaccaucgauaaguga

SEQ ID NO: 137425 - RNA, 1350 nt, Artificial Sequence; identical to SEQ ID NO: 137415
  derived and/or modified sequence opt3 from neuraminidase__InfluenzaA__ABI36369

SEQ ID NO: 137426 - RNA, 1350 nt, Artificial Sequence
  derived and/or modified sequence opt3 from neuraminidase__InfluenzaA__ABI36391
augaaccccaaucagaagaucauuaccauaggcagcaucugcauggugauugggaucgucucccugaugcuccaaauuggaaacaugaucucuauauggguuucacacaguacacagaaagguaaucagcaucaggccgagagcaucuccaacacuaauccucuuacggaaaaggcuguggcaucuguaacccuggccggcaacucgucauuguguccaauuagagggugggcggugcacagcaaagacaauaacaucaggauuggaaguaagggcgaugucuucgugauccgggagccguuuauauccugcucucauuuagaaugucgcacauucuuucugacucaaggugcucuacucaaugacaaacacagcaacgggaccguuaaggaucgaucaccccaucguacacugauguccugcccugugggagaggccccaagucccuacaauagcagauucgaaucugucgcaugguccgccucagcuugucacgacggcaccagcuggcuuacuauuggcaucagugggccugauaacgaggcaguggccguacugaaguauaauggaauuaucacagacaccaucaaaucuuggaggaacaauauuuugcggacgcaggaguccgaaugcgcuuguguuaacgguagcugcuuuacugugaugaccgauggcccaucgaacgggcaggccucuuacaagauauucaaaauggagaagggaaaagucgugaaguccguggaacucgacgcgcccaauuaucacuacgaggaguguucaugcuauccugaugcaggcgaaaucacaugugucugccgcgacaacuggcaugguaguaauagaccauggguuagcuuuaaccagaaucuggaguaccaaauuggguauaucugcuccggaauauucggcgauaacccgaggcccaaugacggcacugggucuuguggaccuauguuuccaaacggugccuacggcgugaagggguucagcuuuaaauacggaaauggcguauggauuggucggaccaagucaacaaacagucgcuccggguucgaaaugaucugggaucccaauggcuggaccggaacggacagcucuuuuucagugaaacaggacaucgucgcuauuacugauuggaguggcuauagcggguccuucgugcagcacccugagcugacaggacucgacugcauccgaccauguuucuggguugaauuaauuagagguaggcccaaggagucuaccauauggacuucgggcagcuccaucucauuuugcggggugaacagugauacagucucuuggagcuggccggacggagccgagcugccuuucaccauugauaaauga

SEQ ID NO: 137427 - RNA, 1350 nt, Artificial Sequence; identical to SEQ ID NO: 137426
  derived and/or modified sequence opt3 from neuraminidase__InfluenzaA__ABI36402

SEQ ID NO: 137428 - RNA, 1350 nt, Artificial Sequence; identical to SEQ ID NO: 137415
  derived and/or modified sequence opt3 from neuraminidase__InfluenzaA__ABI36413

SEQ ID NO: 137429 - RNA, 1350 nt, Artificial Sequence
  derived and/or modified sequence opt3 from neuraminidase__InfluenzaA__ABI36446
augaaccccaaucagaagaucauuaccauaggcagcaucugcauggugauugggaucgucucccugaugcuccaaauuggaaacaugaucucuauauggguuucacacaguauccagacagguaaucagcaucaggccgagagcauuuccaacacuaauccucuuacggaaaaagcuguggcaucuguaacccuggccggcaacucgucauuguguccaaucagagggugggcggugcacagcaaggacaauaacauuaggaucggaaguaaaggcgaugucuucgugauacgggagccguuuauuuccugcucucauuuagaaugucgcacauucuuucugacucaaggugcucuacucaaugacaagcacagcaacgggaccguuaaagaucgaucaccccaucguacacugauguccugcccugugggagaggccccaagucccuacaauagcagauucgaaucugucgcaugguccgccucagcuugucacgacggcaccagcuggcuuacuaucggcauuagugggccugauaacgaggcaguggccguacugaaguauaauggaaucaucacagacaccauuaagucuuggaggaacaauauauugcggacgcaggaguccgaaugcgcuuguguuaacgguagcugcuuuacugugaugaccgauggcccaucgaacgggcaggccucuuacaaaaucuucaagauggagaaaggaaaggucgugaaauccguggaacucgacgcgcccaauuaucacuacgaggaguguucaugcuauccugaugcaggcgaaauuacaugugucugccgcgacaacuggcaugguaguaauagaccauggaucagcuuuaaccagaaucuggaguaccaaauaggguauauuugcuccggaguuuucggcgauaacccgaggcccaaugacggcacugggucuuguggaccuaugagcccaaacggugccuacggcgugaagggguuuucauucaaguacggaaauggcguauggaucggucggaccaaaaguacaaacucccgcagcggguuugaaaugaucugggaucccaauggcuggaccggaacggacucuucauucagugugaagcaggacauugucgcuaucacugauuggagcggcuauuccgggucuuuugugcagcacccugagcugacaggacucgacugcauucgaccauguuucuggguugaauuaauaagagguaggcccaaagagucgaccaucuggacuagcggcuccucaauuaguuucugcggggugaacucugauacagucagcugguccuggccggacggagccgagcugccuuuuaccaucgauaaguga

SEQ ID NO: 137430 - RNA, 1350 nt, Artificial Sequence; identical to SEQ ID NO: 137419
  derived and/or modified sequence opt3 from neuraminidase__InfluenzaA__ABI36457

SEQ ID NO: 137431 - RNA, 1350 nt, Artificial Sequence
  derived and/or modified sequence opt3 from neuraminidase__InfluenzaA__ABI36476
augaaccccaaucagaagaucauuaccauaggcagcaucugcauggugauugggaucgucucccugaugcuccaaauuggaaacaugaucucuauauggguuucacacaguacacagaaagguaaucagcaucaggccgagagcaucuccaacacuaauccucuuacggaaaaggcuguggcaucuguaacccuggccggcaacucgucauuguguccaauuagagggugggcggugcacagcaaagacaauaacaucaggauuggaaguaagggcgaugucuucgugauccgggagccguuuauauccugcucucauuuagaaugucgcacauucuuucugacucaaggugcucuacucaaugacaaacacagcaacgggaccguuaaggaucgaucaccccaucguacacugauguccugcccugugggagaggccccaagucccuacaauagcagauucgaaucugucgcaugguccgccucagcuugucacgacggcaccagcuggcuuacuauuggcaucagugggccugauaacgaggcaguggccguacugaaguauaauggaauuaucacagacaccaucaaaucuuggaggaacaauauuuugcggacgcaggaguccgaaugcgcuuguguuaacgguagcugcuuuacugugaugaccgauggcccaucgaacgggcaggccucuuacaagauauucaaaauggagaagggaaaagucgugaaguccguggaacucgacgcgcccaauuaucacuacgaggaguguucaugcuauccugaugcaggcgaaaucacaugugucugccgcgacaacuggcaugguaguaauagaccauggguuagcuuuaaccagaaucuggaguaccaaauuggguauaucugcuccggaguguucggcgauaacccgaggcccaaugacggcacugggucuuguggaccuaugagcccaaacggugccuacggcguaaagggguuuucauucaaauacggaaauggcguguggauaggucggaccaagaguacaaacucccgcagcggguuugaaaugauuugggaucccaauggcuggaccggaacggacucuucauucagugucaaacaggacaucguggcuaucacugauuggagcggcuauuccgggucuuuuguucagcacccugagcugacaggacucgacugcauucgaccauguuucuggguggaauuaaucagagguaggcccaaggagucgaccauuuggacuagcggcuccucaauaaguuucugcggggucaacucugauacagugagcugguccuggccggacggagccgagcugccuuuuaccaucgauaaauga

SEQ ID NO: 137432 - RNA, 1350 nt, Artificial Sequence
  derived and/or modified sequence opt3 from neuraminidase__InfluenzaA__ABI49409
augaaccccaauagaaagaucauuaccauaggcagcaucugcauggugauugggauggucucccugaugcuccagaucggaaacaugauuucuaucuggguuucacacaguauacaaacagguaaucagcaucaggccgagagcaucuccaacacuaauccucuuacggaaaaagcuguggcaucuguaacccuggccggcaacucgucauuguguccaauuagggggugggcggugcacagcaaggacaauaacauccggauuggaaguaaaggcgaugucuucgugauccgcgagccguuuauauccugcucucauuuagaaugucgaacauucuuucugacucagggugcucuacucaaugacaagcacagcaacgggaccguuaaagaucguucaccccauagaacacugauguccugcccugugggagaggccccaagucccuacaauagcagguucgaaucugucgcaugguccgccucagcuugucacgacggcaccagcuggcuuacuauuggcaucagugggccugauaacgaggcaguggccguacugaaguauaauggaauuaucacagacaccaucaagucuuggcggaacaauauuuugcgcacgcaagaguccgaaugcgcuuguguuaacgguagcugcuuuacugugaugaccgauggcccaucgaacgggcaggccucuuacaaaauauucaagauggagaaaggaaaggucgugaaauccguggaacucgucgcgcccaauuaucacuacgaggaguguucaugcuauccugacgcaggcgaaaucacauguguuugcagagauaacuggcaugguaguaauaggccaugggugagcuuuaaccagaaucuggaguaccagauuggguauaucugcuccggaguauucggcgacaacccgcggcccaaugauggcacugggucuuguggaccuaugagcccaaacggugccuacggcgugaagggguuuucauucaaguacggaaauggcgucuggauaggucgcaccaaaaguacaaacucccgaagcggguuugaaaugauuugggaccccaauggcuggaccggaacggauucuucauucagugugaagcaagacaucguugcuaucacugacuggagcggcuauuccgggucuuuugugcagcacccugagcugacaggacucgauugcauuagaccauguuucugggucgaauuaaucaggggucggcccaaagagucgaccauuuggacuagcggcuccucaauaaguuucugcggggugaacucugacacagccagcugguccuggccggauggagcagagcugccuuuuaccaucgacaaguga

SEQ ID NO: 137433 - RNA, 1350 nt, Artificial Sequence
  derived and/or modified sequence opt3 from neuraminidase__InfluenzaA__ABI49417
augaaccccaaucagaagaucauuaccauaggcagcaucugcauggugauugggaucgucucccugaugcuccaaauuggaaacaugaucucuauauggguuucacacaguauccagacagguaaucagcaucaggccgagagcauuuccaacacuaauccucuuacggaaaaagcuguggcaucuguaacccuggccggcaacucgucauuguguccaaucagagggugggcggugcacagcaaggacaauaacauuaggaucggaaguaaaggcgaugucuucgugauacgggagccguuuauuuccugcucucauuuagaaugucgcacauucuuucugacucgaggugcucuacucaaugacaagcacagcaacgggaccguuaaagaucguucaccccauagaacacugauguccugcccugugggagaggccccaagucccuacaauagcagguucgaaucugucgcaugguccgccucagcuugucacgacggcaccagcuggcuuacuaucggcauuagugggccugauaacgaggcaguggccguacugaaguauaauggaaucaucacagacaccauuaagucuuggcggaacaauauauugcgcacgcaagaguccgaaugcgcuuguguuaacgguagcugcuuuacugugaugaccgauggcccaucgaacgggcaggccucuuacaaaaucuucaagauggagaaaggaaaggucgugaaauccguggaacucgacgcgcccaauuaucacuacgaggaguguucaugcuauccugaugcaggcgaaauuacaugugucugcagagacaacuggcaugguaguaauaggccauggguuagcuuuaaccagaaucuggaguaccagaucggguauauaugcuccggaguguucggcgauaacccgcggcccaaugacggcacugggucuuguggaccuaugagcccaaacggugccuacggcguaaagggguuuucauucaaguacggaaauggcguguggauuggucgcaccaaaaguacaaacucccgaagcggguuugaaaugaucugggaucccaauggcuggaccggaacggacucuucauucagugucaagcaagacaucguggcuauuacugauuggagcggcuauuccgggucuuuuguucagcacccugagcugacaggacucgacugcaucagaccauguuucuggguggaauuaauuaggggucagcccaaagagucgaccauauggacuagcggcuccucaaucaguuucugcggggucaacucugauacagugagcugguccuggccggacggagccgagcugccuuuuaccauugauaaguga

SEQ ID NO: 137434 - RNA, 1410 nt, Artificial Sequence
  derived and/or modified sequence opt3 from neuraminidase__InfluenzaA__ABI84962
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuggcaaaugcuaucaguucgcccuggggcagggaacaacccuagacaacaagcacucaaauggcacgauccaugaucguauuccacaccgaacucuccugaugaacgagcuuggugugcccuuucaucuggggaccaagcaggucuguguggcauggagcaguuccucuugccacgacggaaaagccugguugcacguauguguuacaggcgaugacagaaaugcuacugccagcuucaucuacgauggcaggcucguggacuccaucgggucauggagucaaaacauucugcggacccaggaaagcgagugcgucuguauaaauggaacaugcaccguggugaugacggaugguucugcauccggccgcgcugacacuagaauccuguuuauuaaggaggggaaaaucguccauauaucaccucucagcggaagugcccagcacauugaagagugcucuuguuauccaagguacccggauguucggugcaucugucgcgacaacuggaagggcuccaaucgacccgugaucgacauuaacauggaagauuauagcaucgacucgucuuacguaugcuccgguuuagugggggauacaccuagaaacgacgauucaaguagcaauuccaacuguagggacccaaauaacgagcggggaaaucccggcgucaaaggcugggcguucgauaacggggacgauguguggaugggacguaccauuucuaaggacagccgcucagguuacgaaacuuuuaagguuauaggcggguggaguacaccuaauuccaaaagccaggugaacagacaagucaucguggauaauaacaauuggucuggauauucaggcauuuucaguguagaggguaagagcugcaucaacagguguuuuuacguugagcugauccgggggcgaccacaggaaacccgcgugugguggacguccaauucuauugucguguucugcggcaccucgggaacauauggcacugggagcuggcccgacggagcaaacauaaauuuuaugccgaucuga

SEQ ID NO: 137435 - RNA, 1410 nt, Artificial Sequence
  derived and/or modified sequence opt3 from neuraminidase__InfluenzaA__ABI85003
augaaccccaaucagaagaucauuaccauaggcguggucaacacaacucugagcacgaucgcccuccuuauugggguuggaaaucugguguucaacaccguaauccacgagaaaauuggugaccaucaaaucgugacacacccuacuauaaugaccccagaagucccgaauugcuccgauacaaucauuaccuacaacaauacugugaucaacaauauuacaaccacgaucauaacugaggcugaaagacccuuuaagucuccuuugccauuaugucccuucaggggcuuuuucccuuuucauaaagacaacgcaauucggcugggggagaauaaggauguuaucgugacccgcgaaccauaugucucaugcgacaacgauaauuguuggaguuucgcccuagcgcagggagcucuccugggcacaaaacacagcaacgguacuauuaaggaccgaacccccuaccguucccuuaucagauuuccuaucgggacagccccagugcugggaaauuauaaggagauuugcauagcauggucuucgucaagcuguuucgauggcaaagaguggaugcauguaugcaugaccggcaacgacaacgaugccagugcucagaucauuuacgggggaaggaugacggacuccaucaagucuuggcggaaagauauauugcgcacucaggaaagcgagugucaaugcauugacgguacauguguuguggcagucaccgauggcccggccgcuaauuccgccgaccacagaguguauuggaucagggaagggcggaucauuaaguacgagaacgugcccaaaacuaagauccagcaccucgaggaaugcucauguuaugucgacauugauguuuacugcauaugccgcgacaauuggaagggaaguaaccgaccuuggaugagaaucaauaacgagacaauucuggaaaccggcuacguguguagcaaauuucauucugauacgccaaggcccgcggacccuuccaucaugucaugcgauagcccaaguaauguaaacggugggcccggagugaagggcuucggcuuuaaagcagggaaugacgucuggcugggacggaccgugucuacauccggucguagcggcuucgagaucauuaagguuacugaaggguggauaaacucgccgaaucacgugaaaucuaucacccagacacucgucuccaacaaugauuggucaggauauaguggcagcuuuauugugaaggccaaagacuguuuccagccuugcuucuacguagaguuaauccgcgguagacccaacaagaaugaugacguuuccuggacuucuaacagcauugugaccuuuugugggcuggauaacgagccaggcucaggaaauuggccugacggcaguaacaucggguucaugcccaaguga

SEQ ID NO: 137436 - RNA, 1410 nt, Artificial Sequence; identical to SEQ ID NO: 137106
  derived and/or modified sequence opt3 from neuraminidase__InfluenzaA__ABI92294

SEQ ID NO: 137437 - RNA, 1413 nt, Artificial Sequence
  derived and/or modified sequence opt3 from neuraminidase__InfluenzaA__ABI92305
augaaccccaaucagaagaucauuaccauaggcagcaucugcauggccauugggaucauuucccugauccuccaaauaggaaacaucauuucuaucugggugucacaccuuauucagacagguagucagaaucauacuggcaucuguaaccagagaauaauuacguacgagaauagcaccugggucaaccaaacauauguuaauaucaacaauacuaacgugguagcugggaaagacaccacauccgugacccuggcaggaaauucuucguugugcccugucaggggcugggccauuuacucaaaggauaacagcauccggaucgguaguaaaggggacguguucguuauucgcgaaccauuuauauccuguucucacuuagagugccgaacuuucuuucugacacagggagcgcuacucaaugauaagcauagcaacggcaccgugaaagaccguuccccguauagagcucugaugucaugucccaucggcgaagccccuaguccauacaauagcagguucgagucugucgcaugguccgccucagcuugccacgaugggaugggauggcuuacgauugguaucagcggccccgacgauggggcaguggccguacugaaguauaacggaauaauuacugaaaccaucaagaguuggcggaaacgcaucuugagaacacaggagucugaguguguuugcauuaacggcuccuguuuuacuaucaugaccgacgguccuagcaaugggccagcuucguacaggauuuucaagauagaaaaaggaaagaucacaaaaucuauugagcucgaugcccccaacucccauuaugaagagugcucauguuacccugacaccggcacggugaugugcgucugccgggauaauuggcacggcaguaaccgcccaugggugagcuuuaaucagaaccuggacuaccaaaucggguauaucuguuccggaguguucggugauaauccgcgacccaaggacggcaaggggucuugcggaccugucacuguugacggcgcggauggugugaaaggguuuagcuacagauauggcaacggaguauggauuggcaggacaaagucaaauaguucccggaaaggguucgagaugauaugggacccaaacggauggaccgauacugacagcaauuuucuggugaagcaggaugucguggcaaugacagacuggucugguuacucaggcaguuucguucagcaccccgaacucaccggguuagauuguaugcguccuugcuuuuggguggagcugauccgcggaagaccaagggagaaaacgaccauuuggacaagcggcuccucuaucucguucuguggugucaacagcgacacugugaauugguccuggcccgauggggccgaacuuccguucaccauugacaaguga

SEQ ID NO: 137438 - RNA, 1413 nt, Artificial Sequence
  derived and/or modified sequence opt3 from neuraminidase__InfluenzaA__ABI92316
augaaccccaaucagaagaucauuaccauaggcagcaucuccauugccaucggggugauuucucugauccuccaaauaggaaacaucauuucaaucugggcuagucacagcauucagacagguucccagaaucauacuggcaucugcaaccagagaauaauuacguacgaaaauucuaccugggucaaccaaacauauguuaauaucaacaauacuaacgugguagcagggaaagacaagaccucgaugacacuugccggaaauucaagccuguguccuauuaggggcugggcgaucuacaccaaagauaacaguauccggauugguuccaagggggacguguucgucauacgcgagccauuuaucucuugcagccacuuggagugucgaacuuucuuuuuaacacagggagcucugcuaaaugauaaacauuccaacggcaccgugaaggaccguucaccguauagagcccucaugaguugcccccugggcgaagcaccuagcccauacaauucuagguucgaguccguugccuggucagcuagcgcaugucacgaugggcuuggauggcugacgauugguaucaguggccccgacaacggggccguggcugucuugaaguauaacggaauaauuacugaaaccaucaaaucuuggaagaaacggauccuccgcacacaggaguccgagugcguguguguaaauggcagcugcuuuacuauuaugaccgaugguccuucgaacggggccgcgucuuacagaaucuucaagauugaaaaaggaaggguuacaaaguccauagagcuggacgcaccaaauuaucauuacgaagaguguucaugcuaccccgauaccggcacggugaugugugucugccgggacaacuggcacggcaguaaucgcccuugggugagcuuuaaccagaaucuggauuaucaaaucggguacauuugcuccggaguguucggugacaacccacgaccgaaggauggcgaggggucuuguaaucccgucacuguugacggagccgacggcgugaaagguuuuagcuauagauacgggaacggcguauggaucggaaggacaaagucaaaucggcuccguaaaggcuucgaaaugaucugggauccuaacggguggaccgacacugauagugacuuuuccaugaagcaggauauuguggcuaugacagacuggagcggauauucugguucauucguccagcacccagaguuaaccggccuggauugcaugcgccccuguuuuuggguggaacuuguuagaggguugccuagggagaauacgaccauauggacaaguggaagcuccaucucuuucugcggcgugaacucggacacugccaauuggagcuggccagauggugcagaacugcccuucaccauugacaaauga

SEQ ID NO: 137439 - RNA, 1410 nt, Artificial Sequence; identical to SEQ ID NO: 137117
  derived and/or modified sequence opt3 from neuraminidase__InfluenzaA__ABI92327

SEQ ID NO: 137440 - RNA, 1410 nt, Artificial Sequence
  derived and/or modified sequence opt3 from neuraminidase__InfluenzaA__ABI92338
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccggcaaucauagagagaaauaucacugaaauuguauauuuaaccaacacaaccaucgagaaggaaauuugucccaaacuggccgaguacaggaauuggucaaagccucagugcaacaucacuggguucgcgccauuuaguaaagacaauagcauacggcuauccgcuggaggugauauuugggugacacgcgagcccuaugucucuugugacccugauaagugcuaccaauucgcccucggccaggggaccacgcugaacaauggacauucgaacgacacugugcacgaucgaaccccauaucguacacuucugaugaaugaauugggcguucccuuucaucucgguacuagacagguguguaucgcauggucaagcaguuccugccacgacgggaaggccuggcugcaugucugugugaccggagaugacgagaacgcuacagcaucuuucauuuacaauggcaggcugguagauagcaucggcuccuggaguaaaaagauccuccggacccaggaaucagagugcguuuguauuaacgggacgugcacuguggucaugacagacggaagcgccucugguaaagcugauaccaagauauuauuuaucgaggaaggcaaaauugugaacaucuccacucugucagggagcgcccaacacguggaggaaugcaguuguuauccucgcuacccaggagucagaugcguuuguagggacaauuggaagggcucuaaccggccgauaauugauaucaaugugaaggacuacuccaucguaagcucguaugugugcucuggucuugucggggacacaccccgcaaaaacgauuccuucucaaguagccacuguuuggacccuaauaacgaggaaggaggccauggcgugaaggggugggcguuugaugacggaaaugauguuuggaugggucgaaccauuuccgagaaacugagaucuggcuacgagacguucaaggugaucgaaggguggagcaaaccaaacucaaagcuacagauuaauaggcaggucauaguggagcggggaaaccguaguggcuauuccgguaucuuuagcguagaagggaaaucuugcauuaaucgcuguuucuacguugagcucaucagaggcaggaaggaagagaccgaggugugguggacaucaaacaguaucgucguguuuugcggaacuagcggcaccuaugggacaggauccuggcccgacggugcagauauuaaucugaugccuauauga

SEQ ID NO: 137441 - RNA, 1410 nt, Artificial Sequence
  derived and/or modified sequence opt3 from neuraminidase__InfluenzaA__ABI92349
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcaaaguacaggaauuggucaaaaccucagugcaacaucacaggguucgccccauuuaguaaggacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaguugggcguucccuuucaucucgguaccagacagguguguaucgccuggucaagcaguuccugccacgacgggaaagcauggcugcaugucugugugacaggagaugacgaaaacgccaccgcuucuuucauuuacaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauugugcacaucuccacacugucagggagcgcucaacacguggaagagugcaguuguuauccucgcuacccaggagucagaugcguuuguagggacaacuggaagggcucuaaucggccgauaguggauauuaacguaaaagacuacuccaucgugagcucguaugucugcucuggucuugugggggacacccccaggaagaaugauuccuucucaaguagccauuguuuggacccuaacaaugaagagggaggccacggcguuaaagggugggccuuugaugacggaaacgauguguggaucggucgaacgauuuccgaaaagcugagaucuggcuacgagaccuucaaagucaucgagggguggagcaagccaaauucaaaacuacagacaaaccgccaggugauuguagaacggggaaaucguaguggcuauuccgguauauuuagcguugaggggaagucuugcaucaaccgcuguuucuacguggaacucauuagaggcaggaaggaggaaacugaggucugguggaccucaaauaguaucguggucuuuugcggaacaagcggcacuuaugggaccggauccuggcccgacggugcggauaucaaccugaugccuauuuga

SEQ ID NO: 137442 - RNA, 1410 nt, Artificial Sequence; identical to SEQ ID NO: 136343
  derived and/or modified sequence opt3 from neuraminidase__InfluenzaA__ABI92360

SEQ ID NO: 137443 - RNA, 1410 nt, Artificial Sequence; identical to SEQ ID NO: 136343
  derived and/or modified sequence opt3 from neuraminidase__InfluenzaA__ABI92371

SEQ ID NO: 137444 - RNA, 1413 nt, Artificial Sequence; identical to SEQ ID NO: 136402
  derived and/or modified sequence opt3 from neuraminidase__InfluenzaA__ABI92382

SEQ ID NO: 137445 - RNA, 1410 nt, Artificial Sequence; identical to SEQ ID NO: 136730
  derived and/or modified sequence opt3 from neuraminidase__InfluenzaA__ABI92393

SEQ ID NO: 137446 - RNA, 1410 nt, Artificial Sequence; identical to SEQ ID NO: 136343
  derived and/or modified sequence opt3 from neuraminidase__InfluenzaA__ABI92404

SEQ ID NO: 137447 - RNA, 1410 nt, Artificial Sequence
  derived and/or modified sequence opt3 from neuraminidase__InfluenzaA__ABI92415
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgacucaaguagcuccucucauugccuugauccuaauaacgaagagggugggcacggaguuaagggcugggcuuucgacgauggcaaugacguguggauggggcgcaccauuagcgaaaaauugcgaucaggauacgagacauuuaaggucaucgaggguuggaguaacccaaauuccaaacugcagauuaacagacaggugauaguagauaggggcaaucggagcggguauucuggaaucuucucaguugaaggcaagaguuguauuaaccguugcuuuuacguggagcuaauccgcgguagaaaggaagagacugaaguccucuggaccagcaauuccaucguggucuucugugggacaucuggcacuuauggaaccggcucguggcccgacggggccgauauuaacuucaugccuauauga

SEQ ID NO: 137448 - RNA, 1410 nt, Artificial Sequence; identical to SEQ ID NO: 136730
  derived and/or modified sequence opt3 from neuraminidase__InfluenzaA__ABI92426

SEQ ID NO: 137449 - RNA, 1410 nt, Artificial Sequence; identical to SEQ ID NO: 136730
  derived and/or modified sequence opt3 from neuraminidase__InfluenzaA__ABI92437

SEQ ID NO: 137450 - RNA, 1410 nt, Artificial Sequence; identical to SEQ ID NO: 136730
  derived and/or modified sequence opt3 from neuraminidase__InfluenzaA__ABI92448

SEQ ID NO: 137451 - RNA, 1410 nt, Artificial Sequence; identical to SEQ ID NO: 136730
  derived and/or modified sequence opt3 from neuraminidase__InfluenzaA__ABI92459

SEQ ID NO: 137452 - RNA, 1410 nt, Artificial Sequence
  derived and/or modified sequence opt3 from neuraminidase__InfluenzaA__ABI92470
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugagaaggccgauacuaaaauauuauuuaucgaagaggguaagauugugcacacauccucacugagcggcagugcucaacacguggaagagugcucuuguuauccucgguacccagggguccgcugcguuuguagagacaacuggaagggauccaauaggccgaucguggauauaaacguaaaagacuacagcauugugucgucuuaugucugcuccggccuugugggugacacgccccggaagaaugauucaaguagcuccucucauuguuuggacccuaacaaugaagaagggggacacggcguuaaaggcugggccuucgaugacgggaacgauguguggaugggacgcaccaucagcgagaagcugcgaucagguuacgagaccuuuaaagucaucgagggcuggaguaagccaaauuccaaacuacagauuaacagacaggugaucguagacagggggaaucggagcggauauucuggcauuuucucaguugaaaguaagagcugcauaaaccguuguuuuuacguggagcucauccgcgguagaaagcaggaaacagagguccuguggacuuccaauucuauuguggucuucugcgggaccucgggcacauauggaacuggcagcuggcccgauggggcggacaucaaccuuaugccuaucuga

SEQ ID NO: 137453 - RNA, 1410 nt, Artificial Sequence; identical to SEQ ID NO: 136746
  derived and/or modified sequence opt3 from neuraminidase__InfluenzaA__ABI92481

SEQ ID NO: 137454 - RNA, 1410 nt, Artificial Sequence; identical to SEQ ID NO: 136746
  derived and/or modified sequence opt3 from neuraminidase__InfluenzaA__ABI92492

SEQ ID NO: 137455 - RNA, 1410 nt, Artificial Sequence
  derived and/or modified sequence opt3 from neuraminidase__InfluenzaA__ABI92503
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggaggaguacaggaauuggucaaagccucagugcaacaucacaggguucgcaccauuuaguaaagacaauagcauacggcuauccgccggaggugauauuugggugacccgcgaacccuaugucucuugugacccugauaagugcuaccaauucgcgcucggccaggggacgacucugaacaauggacauucgaacgacaccgugcacgaucgaacaccauaucguacucuucugaugaaugaguugggcguucccuuucaucucgguaccaaacagguguguaucgcuuggucaagcaguuccugccacgacgggaaggccuggcugcaugucugugugacaggagaugacgaaaacgcaaccgccucuuucauuuacaauggcagacugguagauagcaucggcuccuggucaaagaaaauccucaggacgcaggagagugagugcguuuguauuaacgggacuugcacaguggucaugaccgacggaagcgcuucugguaaggcagauacuaaaauauuauuuaucgaagagggcaagauugugcacacauccucacugagcgggagugcccaacacguggaagagugcucuuguuauccucgguacccaggaguccgcugcguuuguagagacaacuggaagggcuccaauaggccgaucguggauauaaacguaaaagacuacagcauugugucgucuuaugucugcuccggucuugugggggacacgccccggaagaaugauucaaguagcuccucucauuguuuggacccuaacaaugaagagggaggccacggcguuaaagggugggcuuucgaugacggaaacgauguguggaugggucgcaccaucagcgagaagcugcgaucaggcuacgaaaccuuuaaagucaucgagggguggaguaagccaaauuccaaacuacagauuaacagacaggugaucguagacaggggaaaucggagcggcuauucugguauuuucucaguugaaaguaagagcugcauaaaccguuguuuuuacguggagcucauccgcgggagaaagcaggaaacagagguccuguggacuuccaauucuauuguggucuucugcggcaccucgggaacauauggcacugggagcuggcccgauggagccgacaucaaccuuaugccuaucuga

SEQ ID NO: 137456 - RNA, 1410 nt, Artificial Sequence
  derived and/or modified sequence opt3 from neuraminidase__InfluenzaA__ABI92514
augaaccccaaucagaagaucauuaccauaggcagcgugucccugacaaucgccacuauuugcuuccucguccaaaucgcuauucuuguuacgaccgugacacugcacuuuaaacaguacgaguguaacucuccuccaaauaaccagguaauguugugcgaaccgacuaucauagagagaaauaucaccgaaauuguguauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggucacccgcgagcccuaugugucuugugacccugauaagugcuaccaauucgcucucggccaggggacgacucugaauaaccgacauucgaaugacaccguucacgaucguacaccauauagaacucuucugaugaacgaauugggagugcccuuucaucucggcaccaaacaggucuguaucgccuggucaagcaguuccugccacgacgguaaggcauggcugcauguguguguaacaggggaugacgagaaugccaccgcuucuuucauuuacgauggaaggcugguugacagcaucggcuccuggaguaaaaagauccuccggacgcaggaaucagagugcguguguauuaacggcacuugcacagucgugaugaccgaugggagcgcaucuggacgcgccgacacuaaaauauuauuuaucgaggaagguaagauugugcacacauccaagcugucaggcagcgcucaacacgucgaggaaugcaguuguuauccuagauacccagggguuaggugcgugugucgggauaauuggaaaggaucuaaccgcccgaucguagacauaaacgugaaggacuacuccauugucagcucguaugugugcucuggccuuguuggugauacccccagaaagaaugacuccucaaguagcucccauuguuuggauccuaacaaugaggaagggggacacggcgugaaaggcugggccuucgacgauggggacgaugucuggaugggacgaacgaucucugagaaaagcaggucagguuacgagaccuuuaaggugaucgaaggcuggaguaaaccaaacuccaagcugcagauuaaucggcagguaaucguugagcgugggaacaugagcggauauucuggcauuuucucaguggaagguaagaguugcauaaaucgcuguuuuuacgucgagcuaaucagagggaggaaacaggaaacagaggugugguggacuagcaacuccauugucguguucugcggcaccucuggaacauauggcacugggucguggcccgacggagcggauaucaaucucaugccuaucuga

SEQ ID NO: 137457 - RNA, 1410 nt, Artificial Sequence
  derived and/or modified sequence opt3 from neuraminidase__InfluenzaA__ABI92525
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacaucuccacacugucagggagcgcucaacacguggaggaaugcaguuguuauccucgguacccaggaguccgcugcguuuguagagacaacuggaagggcucuaauaggccgauaguggauauuaacguaaaagacuacuccaucgugagcucguaugucugcucuggucuugugggggacacgccccggaagaaugauuccuucucaaguagccauuguuuggacccuaacaaugaggaaggaggccacggcguuaaagggugggccuuugaugacggaaacgauguguggaugggucgcaccaucuccgagaagcugcgaucuggcuacgagaccuucaaagucauugaaggguggagcaagccaaauucaaaacuacagaucaacagacaggugauuguagagaggggaaaucggaguggcuauuccgguauauuuagcguugaagggaagucuugcaucaaccguuguuucuacguggagcucauucgcggcagaaaggaagagacagaggucugguggacuucaaauaguaucguggucuuuugcggaaccagcggcacauaugggacuggauccuggcccgacggugcggauaucaaccugaugccuauuuga

SEQ ID NO: 137458 - RNA, 1410 nt, Artificial Sequence
  derived and/or modified sequence opt3 from neuraminidase__InfluenzaA__ABI92536
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaaaaugucccaagcuggcagaguacaggaauuggucaaaaccucagugcaacauuacaggguucgccccauuuaguaaggacaauagcauccggcuauccgcgggaggugauauaugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguauugccuggucaagcaguuccugccacgacgggaaagcauggcugcaugucugugugacaggagaugacgagaacgccaccgcuucuuucaucuacaauggcaggcugguagauagcauuggcuccuggucaaagaaaauccuccggacgcaggaaagugagugcguuuguaucaacgggacuugcacaguggucaugaccgacggaagcgcaucugguaaggccgauacuaaaauuuuauuuauagaggaaggcaagaucgugcacauuuccacacugucagggagcgcucaacacguggaggaaugcaguuguuauccucgcuacccaggagucagaugcguuuguagggacaacuggaagggcucuaaucggccgaucguggauauaaacguaaaagacuacuccauugugagcucguaugucugcucuggucuugugggggacacccccaggaagaaugauuccuucucaaguagccauuguuuggacccuaacaaugaggaaggaggccacggcguuaaagggugggccuuugaugacggaaacgauguguggaugggucgaacgaucuccgagaagcugagaucuggcuacgagaccuucaaagucaucgaaggguggagcaagccaaauucaaaacuacagauuaaccgccaggugaucguagagcggggaaaucguaguggcuauuccgguauuuuuagcguugaagggaagucuugcauaaaccgcuguuucuacguggagcucaucagaggcaggaaggaagagacagaggucugguggacuucaaauaguauuguggucuuuugcggaaccagcggcacauauggggcgggauccuggcccgacggugcagauaucaaccugaugccuaucuga

SEQ ID NO: 137459 - RNA, 1410 nt, Artificial Sequence
  derived and/or modified sequence opt3 from neuraminidase__InfluenzaA__ABI92547
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaaugugucccaaacuggcagaguacaggaauuggucaaagccucagugcaacauuacaggguucgccccauuuaguaaagacaauagcauccggcuauccgcgggaggugauauaugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguauugccuggucaagcaguuccugccacgacgggaaggcauggcugcaugucugugugacaggagaugacgagaacgccaccgcuucuuucaucuacaauggcaggcugguagauagcauuggcuccuggaguaaaaagauccuccggacgcaggaaucagagugcguuuguaucaacgggacuugcacaguggucaugaccgacggaagcgcaucugguaaagccgauacuaagauuuuauuuauagaggaaggcaaaaucgugcacauuuccacacugucagggagcgcucaacacguggaggaaugcaguuguuauccucgcuacccaggagucagaugcguuuguagggacaacuggaagggcucuaaucggccgaucguggauauaaacguaaaggacuacuccauugugagcucguaugucugcucuggucuugugggggacacccccaggaaaaaugauuccuucucaaguagccauuguuuggacccuaacaaugaggaaggaggccacggcguuaaggggugggccuuugaugacggaaacgauguguggaugggucgaacgaucuccgagaaacugagaucuggcuacgagaccuucaaggucaucgaaggguggagcaaaccaaauucaaagcuacagauuaaccgccaggugaucguagagcggggaaaucguaguggcuauuccgguauuuuuagcguugaagggaaaucuugcauaaaccgcuguuucuacguggagcucaucagaggcaggaaggaagagacagaggucugguggacuucaaauaguauuguggucuuuugcggaaccagcggcacauauggggcgggauccuggcccgacggugcagauaucaaccugaugccuaucuga

SEQ ID NO: 137460 - RNA, 1410 nt, Artificial Sequence
  derived and/or modified sequence opt3 from neuraminidase__InfluenzaA__ABI92558
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucacggccucagugcaacaucacaggguucgccccauuuaguaaggacaauagcauacgccuauccgcgggaggugauauuugggugacccgagagcccuaugucucuugugacccugauaaaugcuaccaauucgcucucggccaggggacgacucugaacaauggacauucgaacgacaccgugcacgaucguacaccauauagaacucuucugaugaaugaauugggcguucccuuucaucucgguacccgacagguguguaucgccuggucaagcaguuccugccacgacgggaaggcauggcugcaugucugugugacaggagaugacgagaacgccaccgcuucuuucauuuacaauggccggcugguagauagcaucggcuccuggucaaagaaaauccuccgcacgcaggaaagugagugcguuuguauuaacgggacuugcacaguggucaugaccgacggaagcgcaucugguaaggccgauacuaaaauauuauuuaucgaggaaggcaagauugugcacaucuccacacugucagggagcgcucaacacguggaggaaugcaguuguuauccuagauacccaggagucaggugcguuugucgggacaacuggaaaggcucuaaucgcccgauaguggauauuaacguaaaggacuacuccaucgugagcucguaugucugcucuggucuugugggggacacccccaggaagaaugauuccuucucaaguagccauuguuuggacccuaacaaugaggaaggaggccacggcguuaaagggugggccuuugaugacggaaacgauguguggauggguagaacgaucuccgagaagcugaggucuggcuacgagaccuucaaagucauugaaggguggagcaagccaaauucaaaacuacagaucaaccgucaggugauuguagagcggggaaaucgcaguggcuauuccgguauauuuagcguugaagggaagucuugcaucaacagauguuucuacguggagcucauuaggggccggaaagaagagacagaggucugguggacuucaaauaguaucguggucuuuugcggaaccagcggcacauaugggacuggauccuggcccgacggugcggauaucaaccugaugccuauuuga

SEQ ID NO: 137461 - RNA, 1410 nt, Artificial Sequence
  derived and/or modified sequence opt3 from neuraminidase__InfluenzaA__ABI92569
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaaacugguagauagcaucggcuccuggucaaagaaaauccucaggacgcaggaaagugagugcguuuguauuaacgggacuugcgcaguggucaugacagacggaagcgccucugguaaggcugauaccaaaauauuauuuaucgaggaaggcaagauugugcacaucuccacucugucagggagcgcccaacacguggaggaaugcaguuguuauccucgguacccaggaguccgcugcguuuguagagacaacuggaagggcucuaauaggccgauaguggauauuaacguaaaagacuacuccaucgugagcucguaugucugcucuggucuugugggggacacaccccggaagaaugauuccuucucaaguagccauuguuuggacccuaacaaugaggaaggaggccacggcguuaaagggugggcguuugaugacggaaacgauguguggaugggucgcaccaucuccgagaagcugcgaucuggcuacgagacguucaaagucauugaaggguggagcaagccaaauucaaaacuacagaccaacagacaggugaucguagagaggggaaaucggaguggcuauuccgguauuuuuagcguugaagggaagucuugcauaaaccguuguuucuacguggagcucauccgcggcagaaaggaagagacagaggucugguggacuucaaauaguauuguggucuuuugcggaaccagcggcacauaugggacuggauccuggcccgacggugcagauaucaaccugaugccuaucuga

SEQ ID NO: 137462 - RNA, 1410 nt, Artificial Sequence
  derived and/or modified sequence opt3 from neuraminidase__InfluenzaA__ABI92580
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaacaaggugauguugugcgaaccgacuaucauagagagaaauaucaccgaaauuguauauuuaacaaacaccacuaucgagaaagaaauuugucccaagcuggcagaguacaggaauuggucaaaaccucagugcaacaucacaggguucgccccauuuaguaaggacaauagcauacggcuauccgcgggaggugauauuugggugacccgcgagcccuaugucucuugugacccugauaagugcuaccaguucgcucucggccaagggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaagcauggcugcaugucugugugacaggagaugacgagaacgccaccgcuucuuucauuuacaauggcaggcugguagauagcaucggcuccuggucaaagaaaauccuccggacgcaggaaagugagugcguuuguauuaacgggacuugcacaguggucaugaccgacggaagcgcaucugguaaggccgauacuaaaauauuauuuaucgaggaaggcaagauugugcacaucuccacacugucagggagcgcucagcacguggaggaaugcaguuguuauccucgcuacccaggagucagaugcguuuguagggacaacuggaagggcucuaaucggccgauaguggauauuaacguaaaagacuacuccaucgugagcucguaugucugcucuggucuugugggggacacccccaggaagaaugauuccuucucaaguagccauuguuuggacccuaacaaugaggaaggaggccacggcguuaaagggugggccuuugaugacggaaacgauguguggaugggucgaacgaucuccgagaagcugagaucuggcuacgagaccuucaaagucauugaaggguggagcaagccaaauucaaaacuacaaaucaaccgccaggugauuguagagcggggaaaucguaguggcuauuccgguauauuuagcguugaagggaagggcugcaucaaccgcuguuucuacguggagcucauuagaggaaggaaggaagagacagaggucugguggacuucuaauucaaucguggucuuuugcggcaccagugggacauauggaacugguagcuggcccgacggcgcggauaucaaccugaugccuauuuga

SEQ ID NO: 137463 - RNA, 1410 nt, Artificial Sequence
  derived and/or modified sequence opt3 from neuraminidase__InfluenzaA__ABI92591
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucagaacccgacagguguguaucgccuggucaagcaguuccugccacgacgguaaggcauggcugcaugucugugugacaggggaugacgagaacgccaccgcuucuuucauuuacaauggacggcugguagauagcaucggcuccuggaguaaaaagauccuccgcacgcaggaaucagagugcguuuguauuaacggcacuugcacaguggucaugaccgacgggagcgcaucuggaaaagccgauacuaagauauuauuuaucgaggaagguaaaauugugcacaucuccacacugucaggcagcgcucaacacguggaggaaugcaguuguuauccuagauacccaggggucaggugcguuugucgggacaacuggaagggaucuaaucgcccgauaguggauauuaacguaaaggacuacuccaucgugagcucguaugucugcucuggccuugugggugacacccccaggaaaaaugauuccuugucaaguagccauugucuggacccuaacaaugaggaagggggacacggcguuaagggcugggccuucgaugacgggaacgauguguggaugggaagaacgaucuccgagaaacuaaggucugguuacgagaccuuuaaggucauugaaggcuggagcaaaccaaauucaaagcuccagaucaaccgucaggugauuguagagcgggggaaucgcaguggauauuccggcauauucagcguugaagguaaagggugcaucaacagauguuuuuacguggagcugauuaggggccggaaggaagagacagaggucugguggacuucuaauucaaucguggucuucugcggaaccaguggcacauaugggacuggaagcuggcccgacggugcggauaucaaccuuaugccuauuuga

SEQ ID NO: 137464 - RNA, 1410 nt, Artificial Sequence
  derived and/or modified sequence opt3 from neuraminidase__InfluenzaA__ABI92602
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucucugauuuacaauggcaggcucguagauagcaucggcuccuggaguaaaaagaucuuacggacgcaggaaucagagugcguuuguauuaacgggacuugcacaguggucaugaccgacggaagcgcaucugguaaagccgauacuaagauacuguucaucgaggaaggcaaaauugugcacaucuccacacuuucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucugguuuggugggggacacgccccgcaaaaaugauuccuuuucaaguagccauugucuggacccuaacaaugaggaaggaggccacggcguuaaggggugggccuucgaugacggaaacgauguguggaugggucgaaccaucuccgagaaacuaagaucuggcuacgagaccuuuaaggucauugaaggguggagcaaaccaaauucaaagcuccaggugaacaggcagguaaucguugagcggggaaaucguaguggcuauuccgguauuuucagcguggaagggaaaucuugcauaaaccgcuguuuuuacgucgagcugaucagaggcaggaaggaagagacagaggugugguggacuucaaauaguauugucguguucugcggaaccagcggcacauaugggacuggauccuggcccgacggugcggauaucaaccuuaugccuaucuga

SEQ ID NO: 137465 - RNA, 1410 nt, Artificial Sequence
  derived and/or modified sequence opt3 from neuraminidase__InfluenzaA__ABI92613
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagauaacgagaaugccaccgcuucuuucauuuacaacggcaaacugguagacagcaucggcuccuggucaaagaaaauccucaggacgcaggaaagugagugcguuuguauuaacgggacuugcgcaguggucaugacagauggaagcgccucugguaaggcugacaccaaaauauuauuuaucgaggaaggcaagauugugcacaucuccacucugucagggagcgcccaacacguggaggaaugcaguuguuauccucgguacccaggaguccgcugcguuuguagagauaauuggaagggcucuaacaggccgauaguggacauuaauguaaaagauuacuccaucgugagcucguaugucugcucuggucuugugggggacacaccccggaagaacgacuccuucucaaguagccauuguuuggauccuaauaacgaggaaggaggccacggcguuaaagggugggcguuugacgauggaaaugacguguggaugggucgcaccaucuccgagaagcugcgaucuggcuacgagacguucaaagucauugaaggguggagcaagccaaacucaaaacuacagaccaauagacaggugaucguagagaggggaaaccggaguggcuauuccgguauuuuuagcguugaagggaagucuugcauaaaucguuguuucuacguggagcucauccgcggcagaaaggaagagacagaggucugguggacuucaaacaguauuguggucuuuugcggaaccagcggcacauaugggacuggauccuggcccgauggugcagacaucaaucugaugccuaucuga

SEQ ID NO: 137466 - RNA, 1410 nt, Artificial Sequence
  derived and/or modified sequence opt3 from neuraminidase__InfluenzaA__ABI92624
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugauccgcgagcccuaugucucuugugacccugauaagugcuaccaauucgcucucggccaggggaccacgcugaacaauggacauucgaacgacacugugcacgaucgaaccccauaucguacacuucugaugaaugaauugggcguucccuuucaucucgguacuagacagguguguauugccuggucaagcaguuccugccacgacgggaaggcauggcugcaugucugugugaccggagaugacgagaacgccacagcuucuuucaucuacaauggcaggcugguagauagcaucggcuccuggaguaaaaagauucuccggacccaggaaucagagugcguuuguauaaacgggacgugcacuguggucaugacagacggaagcgcaucugguaaagccgauaccaagaucuuauuuauugaggaaggcaaaaucgugcacauauccacucugucagggagcgcucaacacguggaggaaugcaguuguuauccucgcuacccaggagucagaugcguuuguagggacaacuggaagggcucuaaucggccgauuguggauaucaacguaaaggaccauuccaucgugagcucguacgucugcucuggucuugugggggacacaccccgcaaaaaugauuccuucucaaguagccacuguuuggacccuaacaaugaggaaggaggccauggcguuaaggggugggccuuugaugacggaaacgauguguggaugggucgaaccauuuccgagaaacugagaucuggcuaugagacguucaaggucaucgaaggguggagcaaaccaaauucaaagcuacagauuaacaggcaagugauaguagagcggggaaaucguaguggcuacuccgguaucuuuagcguugaagggaaaucuugcauuaaccgcuguuucuauguggagcucaucagaggcaggaaggaagagaccgaggucugguggacaucaaauaguaucguggucuuuugcggaacuagcggcaccuacgggacaggauccuggcccgacggugcggauauuaaccugaugccuauauga

SEQ ID NO: 137467 - RNA, 1410 nt, Artificial Sequence
  derived and/or modified sequence opt3 from neuraminidase__InfluenzaA__ABI92635
augaaccccaaucagaagaucauuaccauaggcagcgugucccugacaaucgccacuauuugcuuccucaugcagaucgcuauucuugucacgaccguuacacugcacuuuaaacaguacgaguguaacccuccaccgaauaaccaggugauguugugcgaacccacuaucauagagagaaauaucaccgaaauuguauauuuaacaaacaccacuaucgagaaggaaauuuguccuaaacuggcagaguacaggaauuggucuaagccacagugcaaccuaacaggguucgcccccuuuucaaaagacaauaguauccggcucagcgcgggaggugauauaugggugacccgcgagccuuaugucuccugugacccagauaagugcuaccaauucgcucugggccaggggacgacucuuaacaauggacauucuaacgacaccgugcacgaucgaacacccuaucguacucuguugaugaaugaacucggcguuccuuuucaucuggguaccagacagguguguauugccuggucgucaagcaguugccacgacgggaaggcauggcugcaugucugugugacaggagaugacgagaacgccaccgcuuccuucaucuacaauggcaggcucguagauucuauuggcagcugguccaaaaagaucuuacggacgcaggaaucagagugcguuuguaucaacgggacuugcacaguggucaugaccgacggaagugcaagcgguaaagccgauacuaagauuauauuuaucgaggaaggcaaaauugugcacacaucuacccuguccgggucagcucaacacguggaggaaugcagcuguuauccacgcuacccgggagucagaugcguuuguagggacaacuggaagggcaguaaucggcccaucguggauauaaacguaaaggacuacucuauuguguccagcuaugucugcucgggucuugugggggacacgccucgcaaaaaugauucuuucuccucaagucauuguuuggacccaaacaaugaggaaggaggccacggcguuaaggggugggccuuugaugacggaaacgauguguggaugggucgaaccaucagcgagaaacugagauccggcuacgagacauucaaggucaucgaaggguggucuaaacccaauagcaagcuacagacuaacaggcaagugauuguagagcggggaaaucguucaggcuauagugguaucuuuuccguugaagggaaaagcugcauuaaccgcuguuucuacguggagcucauaagaggcaggaaggaagagaccgaggucugguggacaucuaauucaaucguggucuuuugcggaaccaguggcacuuaugggacaggaagcuggccugacggugcggauauuaaccugaugccaaucuga

SEQ ID NO: 137468 - RNA, 1410 nt, Artificial Sequence; identical to SEQ ID NO: 136161
  derived and/or modified sequence opt3 from neuraminidase__InfluenzaA__ABI92646

SEQ ID NO: 137469 - RNA, 1410 nt, Artificial Sequence; identical to SEQ ID NO: 136161
  derived and/or modified sequence opt3 from neuraminidase__InfluenzaA__ABI92657

SEQ ID NO: 137470 - RNA, 1410 nt, Artificial Sequence
  derived and/or modified sequence opt3 from neuraminidase__InfluenzaA__ABI92668
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuuguggcccugacaagugcuaucaauucgcucucgggcagggaacgacucugaacaauggccacucgaacgauaccgugcaugaccgaacaccauaccguacucuucugaugaaugaauuggguguucccuuucaccucgggaccagacagguguguaucgccuggucaagcaguuccugccaugauggaaaggcauggcugcacgucugugugacaggcgacgauaaaaacgccaccgcuucuuucauuuauaauggcaggcugguagacagcaucggguccuggucaaagaaaauccuccggacgcaggagagugaaugcguuuguauuaacggaacuugcacaguggucaugaccgaugguagcgcaucuggcaaggccgacacuaaaauauuauuuaucgaggaggggaagauugugcacaucuccacacugucaggaagcgcucaacauguggaagagugcaguuguuacccucgcuauccaggcgucagaugcguuuguagggauaacuggaaggguucuaaucggccgauaguggacauuaacguaaaagauuacuccaucgugagcucguacgucugcucugggcuugugggagacacccccaggaagaaugacuccuucucaaguagccacuguuuggauccuaacaaugaagagggcggccaugggguuaaaggaugggccuuugacgaugguaacgacguguggaugggccgaacgaucuccgaaaagcugagaucuggguaugagaccuucaaagucauugagggauggagcaagccaaauucaaaacuacagaucaaccgccaggugauuguagaacggggcaaucguagugguuacuccgggauauuuagcguugagggcaagucuugcaucaaccgcuguuucuauguggaacucauuagaggaaggaaggaggaaacagaggucugguggacuucaaauaguaucguggucuuuugcggcaccagcgggacauacggaacugguuccuggcccgauggcgcggacaucaaccugaugccuauuuga

SEQ ID NO: 137471 - RNA, 1410 nt, Artificial Sequence; identical to SEQ ID NO: 136607
  derived and/or modified sequence opt3 from neuraminidase__InfluenzaA__ABI92679

SEQ ID NO: 137472 - RNA, 1410 nt, Artificial Sequence; identical to SEQ ID NO: 136161
  derived and/or modified sequence opt3 from neuraminidase__InfluenzaA__ABI92701

SEQ ID NO: 137473 - RNA, 1410 nt, Artificial Sequence
  derived and/or modified sequence opt3 from neuraminidase__InfluenzaA__ABI92712
augaaccccaaucagaagaucauuaccauaggcagcgugucccugacaaucgccacuauuugcuuccucaugcagaucgcuauucuugucacgaccguuacacugcacuuuaaacagcaugaguguaacucuccuccaaauaaccaggcaauguugugcgaaccgacuaccacagagagaaauaccacugaaaucguguacuuaacaaacaccacgauagagaaggaaaucugucccaaacugguagaguauaggaauuggucaaagccucagugcaacauuacuggguucgccccauuuaguaaagacaauagcauccggcuauccgcgggaggugauauuugggugacccgcgagcccuacgucucuugugacccugauaagugcuaucaauucgcucucggccaggggacaacucugaacaauggacacucgaacgacaccgugcaugaucgaacaccauaccguacccuucugaugaaugaauugggcguucccuuucaccucgguacgagacagguguguaucgccuggucaagcaguuccugccaugacgggaaggcauggcugcacgucugugugacuggagaugacaaaaacgccacagcuucuuucauauauaauggcaggcugguagauagcauuggcuccuggucaaagaaaauccuccggacccaggagagugaaugcguuuguauuaacgggacuugcacaguggucaugaccgacggaagcgcaucugguaaggccgauacgaaaaucuuauuuaucgaggagggcaagauugugcacauauccacccugucagggagcgcucaacauguggaagagugcaguuguuacccucgcuauccaggagucagaugcguuuguagggacaacuggaagggcucuaaucggccgaucguggauauuaacguaaaagacuacuccaucgugagcucguacgucugcucuggucuugugggggacacaccccgcaagaaugauuccuucucaaguagccacuguuuggacccuaacaaugaagagggaggccauggcguuaaagggugggccuuugaugacggaaacgauguguggaugggucgaacuauauccgaaaagcugagaucuggcuaugagaccuucaaagucauugagggguggagcaagccaaauucaaaacuacagaucaacaggcaagugaucguagaacggggaaaucguaguggcuacuccgguauuuuuagcguugaggggaagucuugcaucaaccgcuguuucuauguggaacucauuagaggcaggaaggaggaaacagaggucugguggacuucaaauaguauaguggucuuuugcggaaccagcggcacauacgggaccggauccuggcccgacggugcggauaucaaccugaugccuauuuga

SEQ ID NO: 137474 - RNA, 1410 nt, Artificial Sequence
  derived and/or modified sequence opt3 from neuraminidase__InfluenzaA__ABI92723
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacugguggaguauaggaauuggucaaagccucagugcaacaucacaggguucgcaccauuuaguaaagacaauagcauacggcuauccgccggaggugauauuugggucacccgcgagcccuacgugucuugugacccugauaagugcuaucaauucgcgcucggccaggggacgacucugaacaauggacacucgaacgacaccguucaugaucgaacaccauaccguacucuucugaugaaugaauugggcgugcccuuucaccucgguaccaagcaggucuguaucgcuuggucaagcaguuccugccaugacgggaaagccuggcugcacguguguguaacaggagaugacaagaacgcaaccgccucuuucauuuauaauggcagacugguugauagcaucggcuccuggaguaaaaagauccucaggacgcaggagucagaaugcguguguauuaacgggacuugcacagucgugaugaccgacggaagcgcuucugguaaagcagauacuaagauauuauuuaucgaggagggcaagauugugcacaucuccacacugucagggagcgcccaacaugucgaagagugcaguuguuacccucgguauccaggaguucgcugcguguguagagacaacuggaaaggcucuaauaggccgauaguagauauuaacgugaaggacuacuccaucgucagcucguacgugugcucuggucuuguuggggacacgccccggaaaaaugauuccuucucaaguagccacuguuuggacccuaacaaugaagagggaggccauggcgugaaggggugggcuuuugaugacggaaacgaugucuggaugggucgcaccaucuccgaaaaacugcgaucuggcuaugagaccuucaaggugauugagggguggagcaaaccaaauucaaagcuacagaucaacagacagguaauuguugaaaggggaaaucggaguggcuacuccgguauauuuagcguggaggggaagucuugcaucaaccguuguuucuaugucgaacucauucgcggcagaaaagaggaaacagaggugugguggacuucaaauaguaucgucguguuuugcggaaccagcggcacauacgggacuggauccuggcccgacggugccgauaucaaccugaugccuauuuga

SEQ ID NO: 137475 - RNA, 1410 nt, Artificial Sequence; identical to SEQ ID NO: 136161
  derived and/or modified sequence opt3 from neuraminidase__InfluenzaA__ABI92734

SEQ ID NO: 137476 - RNA, 1410 nt, Artificial Sequence; identical to SEQ ID NO: 136607
  derived and/or modified sequence opt3 from neuraminidase__InfluenzaA__ABI92745

SEQ ID NO: 137477 - RNA, 1410 nt, Artificial Sequence
  derived and/or modified sequence opt3 from neuraminidase__InfluenzaA__ABI92756
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugaucuugugcgaaccgacuauaaucgagagaaauauuaccgaaaucguauacuuaacaaacaccacuauugagaaggaaaucugucccaaacuggcagaguauaggaauuggucaaagccucagugcaacauaacaggguucgccccauuuaguaaagacaauagcauucggcuauccgcgggaggugauaucugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguauugccuggucaagcaguuccugccaugacgggaaggcauggcugcacgucugugugacaggagaugacaaaaacgccaccgcuucuuucaucuauaauggcaggcugguagauagcaucggcuccuggucaaagaaaauucuccggacgcaggagagugaaugcguuuguauaaacgggacuugcacaguggucaugaccgacggaagcgcaucugguaaggccgauacuaaaaucuuauuuauugaggagggcaagaucgugcacauauccacacugucagggagcgcucaacauguggaagagugcaguuguuacccucgcuauccaggagucagaugcguuuguagggacaacuggaagggcucuaaucggccgauuguggauaucaacguaaaagacuacuccaucgugagcucguacgucugcucuggucuugugggggacacccccaggaagaaugauuccuucucaaguagccacuguuuggacccuaacaaugaagagggaggccauggcguuaaagggugggccuuugaugacggaaacgauguguggaugggucgaacgauuuccgaaaagcugagaucuggcuaugagaccuucaaagucaucgagggguggagcaagccaaauucaaaacuacagauuaaccgccaggugauaguagaacggggaaaucguaguggcuacuccgguaucuuuagcguugaggggaagucuugcauuaaccgcuguuucuauguggaacucaucagaggcaggaaggaggaaacagaggucugguggacuucaaauaguaucguggucuuuugcggaaccagcggcacauacgggacuggauccuggcccgacggugcggauauuaaccugaugccuauauga

SEQ ID NO: 137478 - RNA, 1410 nt, Artificial Sequence
  derived and/or modified sequence opt3 from neuraminidase__InfluenzaA__ABI92767
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacaaaaacgccaccgcuucuuucauuuauaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauugugcacaucuccacacugucagggagcgcucaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacccccaggaagaaugauuccuucucaaguagccacuguuuggacccuaacaaugaagagggaggccauggcguuaaagggugggccuuugaugacggaaacgauguguggaugggucgaacgaucuccgaaaagcugagaucuggcuaugagaccuucaaagucauugagggguggagcaagccaaauucaaaacuacagaucaaccgccaggugauuguagaacggggaaaucguaguggcuacuccgguauauuuagcguugaggggaagucuugcaucaaccgcuguuucuauguggaacucauuagaggcaggaaggagaaaacagaagucugguggacuucaaauaguaucguggucuuuugcggaaccagcggcacauacgggacuggauccuggcccgacggugcggauaucaaccugaugccuauuuga

SEQ ID NO: 137479 - RNA, 1410 nt, Artificial Sequence; identical to SEQ ID NO: 136161
  derived and/or modified sequence opt3 from neuraminidase__InfluenzaA__ABI92778

SEQ ID NO: 137480 - RNA, 1410 nt, Artificial Sequence; identical to SEQ ID NO: 136343
  derived and/or modified sequence opt3 from neuraminidase__InfluenzaA__ABI92789

SEQ ID NO: 137481 - RNA, 1410 nt, Artificial Sequence; identical to SEQ ID NO: 136343
  derived and/or modified sequence opt3 from neuraminidase__InfluenzaA__ABI92800

SEQ ID NO: 137482 - RNA, 1410 nt, Artificial Sequence; identical to SEQ ID NO: 136343
  derived and/or modified sequence opt3 from neuraminidase__InfluenzaA__ABI92811

SEQ ID NO: 137483 - RNA, 1410 nt, Artificial Sequence; identical to SEQ ID NO: 136343
  derived and/or modified sequence opt3 from neuraminidase__InfluenzaA__ABI92822

SEQ ID NO: 137484 - RNA, 1410 nt, Artificial Sequence; identical to SEQ ID NO: 136343
  derived and/or modified sequence opt3 from neuraminidase__InfluenzaA__ABI92844

SEQ ID NO: 137485 - RNA, 1410 nt, Artificial Sequence; identical to SEQ ID NO: 136343
  derived and/or modified sequence opt3 from neuraminidase__InfluenzaA__ABI92855

SEQ ID NO: 137486 - RNA, 1410 nt, Artificial Sequence
  derived and/or modified sequence opt3 from neuraminidase__InfluenzaA__ABI92866
augaaccccaaucagaagaucauuaccauaggcagcgccucccugacaaucgcuacuauuugcuuccucauccagauugcaauccuugugacgaccgucacacugcacuuuaaacagcaugaguguaacucuuugccuaauaaccagguuauguuaugcgaaccaacuauaaucgagagaaauauuaccgaaaucguguaccugacaaacaccacuauugagaaggaaaucuguccgaaacuagccgaguauaggaauuggucaaagccccagugcaacauaacaggguucgcgccuuuuaguaaagacaauagcauucggcucuccgcuggaggugauaucuggguaacccgcgagccauacgugucuugugaccccgauaagugcuaucaauucgcccugggccaggggacgacucuuaacaauggacacucgaacgacaccguccaugaucgaacaccuuaccguacucuguugaugaaugaacucggcgugccauuucaccuggguaccagacagguuuguauugcauggucaagcaguuccugccaugacgggaaggccuggcugcacgugugugucacaggagaugacaaaaacgcuaccgcaucuuucaucuauaauggcaggcucguggauagcaucuccucauggaguaagaaaauuuuacggacgcaggagagcgaaugcguauguauaaacggcacuugcacaguugugaugaccgacgggucugccuccggaaaggcugauacuaaaauccuguuuauugaggaggguaagaucauacacauuucaacacuuagcggcagugcccaacaugucgaagagugcucuuguuacccccgcuauccuggggugagaugcguguguagggacaacuggaagggauccaaucggccaaucgucgauaucaacguuaaagacuacagcauugugucgucuuacguaugcuccggcuuggugggugacaccccgcgcaagaaugauucauucaguagcucccacugucuggaccccaacaaugaagaagggggacauggcgucaaaggcugggcguuugaugacgggaacgauguguggaugggacgaacgaucucugagaagcuaagaagcgguuaugagaccuucaaaguuauugagggcuggucaaauccuaacaguaagcuccagauaaauaggcaagugaucgucgaacgggggaaccguuccggauacagcggcauuuuuaguguggaggguaaaucaugcaucaaucgcuguuucuauguagaacugaucagagggaggaaggaggaaacagagguuugguggacuucuaacagcauuguggucuuuugcggcaccuccggaacauacggcacugggucuuggccagacggagcagauauaaaucuuaugcccaucuga

SEQ ID NO: 137487 - RNA, 1410 nt, Artificial Sequence; identical to SEQ ID NO: 136343
  derived and/or modified sequence opt3 from neuraminidase__InfluenzaA__ABI92877

SEQ ID NO: 137488 - RNA, 1410 nt, Artificial Sequence; identical to SEQ ID NO: 136343
  derived and/or modified sequence opt3 from neuraminidase__InfluenzaA__ABI92888

SEQ ID NO: 137489 - RNA, 1410 nt, Artificial Sequence; identical to SEQ ID NO: 136343
  derived and/or modified sequence opt3 from neuraminidase__InfluenzaA__ABI92899

SEQ ID NO: 137490 - RNA, 1410 nt, Artificial Sequence; identical to SEQ ID NO: 136343
  derived and/or modified sequence opt3 from neuraminidase__InfluenzaA__ABI92910

SEQ ID NO: 137491 - RNA, 1410 nt, Artificial Sequence; identical to SEQ ID NO: 136343
  derived and/or modified sequence opt3 from neuraminidase__InfluenzaA__ABI92921

SEQ ID NO: 137492 - RNA, 1410 nt, Artificial Sequence; identical to SEQ ID NO: 136343
  derived and/or modified sequence opt3 from neuraminidase__InfluenzaA__ABI92932

SEQ ID NO: 137493 - RNA, 1410 nt, Artificial Sequence; identical to SEQ ID NO: 136730
  derived and/or modified sequence opt3 from neuraminidase__InfluenzaA__ABI92943

SEQ ID NO: 137494 - RNA, 1410 nt, Artificial Sequence; identical to SEQ ID NO: 136730
  derived and/or modified sequence opt3 from neuraminidase__InfluenzaA__ABI92954

SEQ ID NO: 137495 - RNA, 1410 nt, Artificial Sequence
  derived and/or modified sequence opt3 from neuraminidase__InfluenzaA__ABI92965
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuggugggcgauacgccccggaaaaacgaccgcucaaguagcucccauugccuugauccuaauaacgaagagggugggcacggaguuaagggcugggcuuucgacgauggcaaugacguguggauggggcgaaccauuucugaaaaauugagaagcggauacgagacauuuaaggucaucgaggguuggucaaacccaaauaguaaacugcagauuaacaggcaagugauaguagaucggggcaaucguuccggguauagcggaaucuucucuguugaaggcaagucauguauuaaccgcugcuuuuacguggagcuaaucagagguaggaaggaagagacugaaguccucuggaccaguaauagcaucguggucuucugugggacauccggcacuuauggaaccggcucuuggcccgacggggccgauauuaaccugaugccuauauga

SEQ ID NO: 137496 - RNA, 1410 nt, Artificial Sequence; identical to SEQ ID NO: 136730
  derived and/or modified sequence opt3 from neuraminidase__InfluenzaA__ABI92976

SEQ ID NO: 137497 - RNA, 1410 nt, Artificial Sequence; identical to SEQ ID NO: 136730
  derived and/or modified sequence opt3 from neuraminidase__InfluenzaA__ABI92987

SEQ ID NO: 137498 - RNA, 1410 nt, Artificial Sequence; identical to SEQ ID NO: 136730
  derived and/or modified sequence opt3 from neuraminidase__InfluenzaA__ABI92998

SEQ ID NO: 137499 - RNA, 1410 nt, Artificial Sequence; identical to SEQ ID NO: 136934
  derived and/or modified sequence opt3 from neuraminidase__InfluenzaA__ABI93009

SEQ ID NO: 137500 - RNA, 1410 nt, Artificial Sequence; identical to SEQ ID NO: 136730
  derived and/or modified sequence opt3 from neuraminidase__InfluenzaA__ABI93020

SEQ ID NO: 137501 - RNA, 1413 nt, Artificial Sequence; identical to SEQ ID NO: 137372
  derived and/or modified sequence opt3 from neuraminidase__InfluenzaA__ABI93031

SEQ ID NO: 137502 - RNA, 1410 nt, Artificial Sequence; identical to SEQ ID NO: 137127
  derived and/or modified sequence opt3 from neuraminidase__InfluenzaA__ABI93042

SEQ ID NO: 137503 - RNA, 1410 nt, Artificial Sequence; identical to SEQ ID NO: 136300
  derived and/or modified sequence opt3 from neuraminidase__InfluenzaA__ABI93053

SEQ ID NO: 137504 - RNA, 1410 nt, Artificial Sequence
  derived and/or modified sequence opt3 from neuraminidase__InfluenzaA__ABI93064
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauugugcacacauccaagcugucaggcagcgcucaacauguggaggaaugcaguuguuauccuagauacccaggggucaggugcguuugucgggacaauuggaaaggaucuaaccgcccgaucguggauauaaacguaaaggacuacuccauugugagcucguaugucugcucuggccuugugggugacacgccccggaaaaaugauuccucaaguagcucccacuguuuggacccuaacaaugaggaagggggacauggcguuaagggcugggccuucgaugacgggaacgauguguggaugggaagaaccaucucugagaaaagcaggucagguuacgagaccuuuaaggucaucgaaggcuggaguaaaccaaauuccaagcugcagauuaaccgacaggugaucguagagcgugggaaucgcagcggauauucuggcauuuucucaguugaagguaagaguugcauaaacagauguuuuuacguggagcuaaucagggggcggaaacaggaaacagaggucugguggacuagcaauuccauuguggucuucugcggcaccucuggaacauauggcacugggucguggcccgacggagcggauaucaaccucaugccuaucuga

SEQ ID NO: 137505 - RNA, 1410 nt, Artificial Sequence; identical to SEQ ID NO: 136746
  derived and/or modified sequence opt3 from neuraminidase__InfluenzaA__ABI93075

SEQ ID NO: 137506 - RNA, 1410 nt, Artificial Sequence; identical to SEQ ID NO: 136746
  derived and/or modified sequence opt3 from neuraminidase__InfluenzaA__ABI93086

SEQ ID NO: 137507 - RNA, 1410 nt, Artificial Sequence; identical to SEQ ID NO: 136746
  derived and/or modified sequence opt3 from neuraminidase__InfluenzaA__ABI93097

SEQ ID NO: 137508 - RNA, 1410 nt, Artificial Sequence
  derived and/or modified sequence opt3 from neuraminidase__InfluenzaA__ABI93108
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacguaaaugacuacagcauugugucgucuuaugucugcuccggucuugugggggacacgccccggaaaaacgauucaaguagcuccucucauuguuuggacccuaauaacgaggaaggaggccacggcguuaaggggugggccuucgaugacggaaaugauguguggaugggucgcaccaucagcgagaaacugcgaucaggcuacgagaccuuuaaggucaucgaaggguggaguaaaccaaacuccaagcuacagauuaauagacaggugaucguagacaggggaaaccggagcggcuauucugguauuuucucaguugagaguaaaagcugcauaaaucguuguuuuuacguggaacucauccgcgggagaaagcaggagacagaaguccuguggacuuccaacucuauuguggucuucugcggcaccucgggaacauauggcacugggagcuggcccgauggagcggacaucaaucuuaugccuaucuga

SEQ ID NO: 137509 - RNA, 1410 nt, Artificial Sequence
  derived and/or modified sequence opt3 from neuraminidase__InfluenzaA__ABI93119
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacguaaaagacuacagcauugugucgucuuaugucugcuccggucuugugggggacacgccccggaagaaugauaacucaaguagcucccauuguuuggacccuaauaacgaggaaggaggccacggcguuaaagggugggccuucgaugacggaaaugauguguggaugggucgcaccaucucugagaagcugcgaagcggcuacgagaccuuuaaagucaucgaaggguggucaaagccaaacaguaaacuacagauuaauagacaggugaucguagacagguccaaccggagcggauauucuggcauuuucucaguugagaguaagagcugcauaaaucguuguuuuuacguggaacucauccgcgguagaaagcaggagacagaaguccuguggacuuccaacucuauuguggucuucugcgggaccucgggcacauauggaacuggcagcuggcccgauggggcggacaucaaucuuaugccuaucuga

SEQ ID NO: 137510 - RNA, 1416 nt, Artificial Sequence
  derived and/or modified sequence opt3 from neuraminidase__InfluenzaA__ABI94584
augaaccccaaucagaagcuguucgcccucagcggcguggcuaucgcacuuuccguccugaacuuguuaauugggauaucuaauguuggacugaacgugucacuacaccucaaagagaaggguccuaaacaagaagagaaucugaccugcacaacuaucaaccagaauaacacgaccguaguggaaaauacauacgucaacaauacuaccauuaucacaaagggcaccgaccuuaaaacuccaaguuaucuguugcucaacaagagccuguguaauguggagggguggguugugauugccaaggauaacgcggucagauuuggagaauccgagcagaucauagugacaagggagccguacguaucuugcgaccccaccggcuguaaaauguaugcucugcaucaggguacgacuauccggaauaagcacucgaacgggaccauucaugaucgcacagccuuccgaggacucaucucaacuccuuuaggcaccccacccacaguuagcaacagugacuuuaugugcgugggcugguccucuaccacgugucacgaugggauugcacguaugacuaucugcauacaaggaaauaacgacaaugccacagcuaccgucuacuauaacagaaggcugacuacaaccauuaaaacgugggcacggaauauccuucgcacccaggaaagcgagugugugugccauaacgguacaugugccguggucaugacugauggcuccgcuucaagucaggccuacaccaagguuauguauuuccacaaaggguuggugguaaaggaagaggagcugagaggaagcgcgaggcacauugaagagugcucuuguuacggccauaaucagaaggugacaugcgucugccgggacaacuggcaaggugcaaaucgcccuaucaucgaaauugauauguccacucuagagcacaccucacgauacguguguacagggauacucaccgacacuagcagaccaggagauaaaaguucuggcgacugcuccaaccccaucacgggcagcccugggguuccaggagugaaggguuuuggcuuccugaauggggauaacacauggcuuggaaggaccauuucgccgcggucucguuccggcuuugaaaugcugaaaauccccaaugccgguacugacccuaacucacgcauagcugagagacaggagauugucgacaauaacaacuggaguggguauagcggcuccuucaucgauuacuggaaugacaacucugaauguuauaauccaugcuuuuacguggaguugaucaggggacggcccgaagaggccaaguauguauggugggcaagcaacucacucauugcucuguguggcaguccuuucccaguuggguccgguagcuuucccgauggagcccagauccaguacuucucuuga

SEQ ID NO: 137511 - RNA, 1413 nt, Artificial Sequence; identical to SEQ ID NO: 136844
  derived and/or modified sequence opt3 from neuraminidase__InfluenzaA__ABI95220

SEQ ID NO: 137512 - RNA, 1410 nt, Artificial Sequence
  derived and/or modified sequence opt3 from neuraminidase__InfluenzaA__ABI95242
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacggacgaacaccauaucguacucugcuuaugaacgaacugggcguucccuuucauuuggguaccaaacaggugugcauugcuuggagcaguuccucuugucacgacgggaaggccuggcuccaugucugcgugacaggagaugacaagaaugcaaccgccagcuucaucuacaacggcagacugguagauuccaucguuucauggaguaaagagauucugaggacgcaggaaagcgagugugugugcauaaauggcacuuguacagucgugaugaccgacgggucugcuuccggagaggcagauacuaagauccucuuuauugaagaggguaaaaucgugcacacaucaaccuuaagcggcagugcccaacacgucgaagagugcucuugcuauccucgguacccagggguucgcugugugugcagagacaacuggaagggauccaacaggccgauaguagauauuaauaucaaggacuacagcaucgugucgucuuaugucuguuccggccuggugggugacacgccccggaaaaacgauucaaguagcuccucucauugccuugacccuaauaacgaagaagggggacacggcguuaagggcugggcuuucgaugacgggaaugauguguggaugggacgcaccauuagcgagaaauugcgaucagguuacgagacauuuaaggucaucgagggcuggaguaacccaaauuccaaacugcagauuaacagacaggugauaguagacagggggaaucggagcggauauucuggcaucuucucaguugaagguaagaguuguauuaaccguugcuuuuacguggagcuaauccgcgggagaaaagaagagacugagguccucuggaccagcaauuccaucguggucuucuguggcacaucuggaacuuauggcaccgggucguggcccgauggagccgacauuaaccugaugccuauauga

SEQ ID NO: 137513 - RNA, 1413 nt, Artificial Sequence
  derived and/or modified sequence opt3 from neuraminidase__InfluenzaA__ABI95253
augaaccccaaucagaagaucauuaccauaggcagcaucuccauugccaucgggauuaucucuauaaugcugcaaaucggaaacauuaucucaauuugggcuagucacagcauccagacagguucccagaaucauacuggcauaugcaaccagagaauuaucacguacgaaaauucuaccugggugaaccacacauaugucaauauuaacaauacuaacguuguggcagggaaagacaagaccucgguaacacucgccggaaauucaagccuuuguaguaucuccggcugggcgaucuacaccaaagauaacucuauuaggauagguagcaagggggacguguucgucauccgggagccuuuuauuuccugcucacaucuggagugucgcacuuucuuuuugacacaaggagcuuuacugaaugauaaacacaguaacggcaccgugaaggaccgaagcccauaucgugcccuaaugucuugcccgcucggcgaagcacccuccccuuacaauucaaaguucgagagcguugccuggagugcuucugcaugucaugaugggaugggauggcugacgaucgguauauccggcccagacaacggggccguggcuguccuuaaauauaacggaauuaucacugaaaccaucaagagcuggaaaaagaggauucugagaacacaggagucggagugcguguguguaaauggcucuugcuuuacuaucaugaccgauggucccuccgacggggccgcgucauacaaaauuuucaagauagaaaagggaaaaguuacaaagaguaucgaguugaacgcaccuaauagccacuaugaagaguguuccugcuacccagauaccggcacggugaugugugucugccgggacaacuggcacggcucuaaucgccccugggugagcuuuaaccagaaucucgauuaccagauuggguauaucugcucaggaguguucggugacaacccuagaccaaaagauggcgaggggaguuguaauccggucacuguugacggagccgacggcgugaaggguuuuuccuacaaauaugggaacggcguauggaucggaaggacaaagagcaaucggcugcgcaaaggcuucgaaaugauuugggaucccaacggguggaccgacacugauucugacuuuucagugaagcaagaugucguggcuauaacagacuggaguggauacagcgguuccuucguucagcauccugagcugaccggccucgauugcauccgaccauguuuuuggguggaauuagucagagggaggccccgggagaauacgaccauuuggacaucuggaucgagcaucuccuucugcggcgugaacucagacacugccaauuggaguuggccugauggugcagaacugccauucaccauugacaaguga

SEQ ID NO: 137514 - RNA, 1413 nt, Artificial Sequence; identical to SEQ ID NO: 137372
  derived and/or modified sequence opt3 from neuraminidase__InfluenzaA__ABI95264

SEQ ID NO: 137515 - RNA, 1413 nt, Artificial Sequence; identical to SEQ ID NO: 137372
  derived and/or modified sequence opt3 from neuraminidase__InfluenzaA__ABI95275

SEQ ID NO: 137516 - RNA, 1413 nt, Artificial Sequence; identical to SEQ ID NO: 137372
  derived and/or modified sequence opt3 from neuraminidase__InfluenzaA__ABI95286

SEQ ID NO: 137517 - RNA, 1413 nt, Artificial Sequence
  derived and/or modified sequence opt3 from neuraminidase__InfluenzaA__ABI95297
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaagaaucgaagcccauaucgugcccucaugucuugcccgcugggcgaagcacccuccccuuacaacucaaaguucgagagcguugccuggagugcuucugcaugucaugacgggaugggauggcuuacgauugguaucuccggcccagauaacggggccguggcuguccugaaauauaauggaauaauuacugaaaccaucaagagcuggaaaaagcagaucuugagaacacaggagucggagugcguguguguaaacggcucuugcuuuacuauuaugaccgacggucccuccaauggggccgcgucauacaaaaucuucaagauugaaaagggaaaaguuacaaagaguauagagcucaacgcaccuaauuuucacuaugaagaguguagcugcuacccagauaccggcacggugaugugugucugcagggacaacuggcacggcuccaaucggcccugggugucuuucaaccagaaucuggauuaccaaaucggguauauuugcagcggaguguuuggugacaacccucgcccaaaagauggcgaggggucauguaauccggucacuguugacggagccaacggcgugaaggguuucaguuacaaauaugggaauggcguauggaucggaagaacaaaguccaacaggcugcggaaaggcuuugaaaugaucugggaucccaauggguggaccgacacugacagcgauuucucugugaagcaggacgucguggcuauuacagauuggucaggauacagugguagcuuuguucagcauccugagcucaccggcuuagacugcauacgcccauguuucuggguggaacugguccgagggcuucccaaggagaacacgaccaucuggacauccggaucuucgauuagcuucugcggcgugaacuccgauacugccaauuggucauggccugacggugcagaauugccauuuaccaucgauaaauga

SEQ ID NO: 137518 - RNA, 1410 nt, Artificial Sequence; identical to SEQ ID NO: 136746
  derived and/or modified sequence opt3 from neuraminidase__InfluenzaA__ABI95308

SEQ ID NO: 137519 - RNA, 1413 nt, Artificial Sequence; identical to SEQ ID NO: 136402
  derived and/or modified sequence opt3 from neuraminidase__InfluenzaA__ABI96131

SEQ ID NO: 137520 - RNA, 1413 nt, Artificial Sequence; identical to SEQ ID NO: 136402
  derived and/or modified sequence opt3 from neuraminidase__InfluenzaA__ABI96133

SEQ ID NO: 137521 - RNA, 1413 nt, Artificial Sequence; identical to SEQ ID NO: 136402
  derived and/or modified sequence opt3 from neuraminidase__InfluenzaA__ABI96136

SEQ ID NO: 137522 - RNA, 1410 nt, Artificial Sequence
  derived and/or modified sequence opt3 from neuraminidase__InfluenzaA__ABJ09110
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauuauccacacauccucacugagcgggagugcucaacacguggaggaaugcucuuguuauccucgguacccaggagugcgcugcgucuguagagacaacuggaagggcuccaauaggccgauaguugauauuaacgugaaagacuacagcaucguaucgucuuaugugugcuccggucuugucggggacacgccccggaagaaugauucaaguagcuccucucauuguuuggacccuaacaaugaggaaggaggccacggcgugaaagggugggccuucgaugacggaaacgauguuuggaugggucgcaccaucagcgagaagcugcgaucaggcuacgagaccuuuaaagugauugaaggguggaguaagccaaauuccaaacuacagaucaacagacaggucauuguggacaggggaaaucggagcggcuauucugguauauucucaguagagaguaagagcugcaucaaccguuguuuuuacguugaacucauucgcgggagaaagcaggagacagaagugcuguggacuuccaauucuaucgucguguucugcggcaccucgggaacauauggcacugggagcuggcccgauggagcggacaucaaccuuaugccuauuuga

SEQ ID NO: 137523 - RNA, 1410 nt, Artificial Sequence; identical to SEQ ID NO: 137117
  derived and/or modified sequence opt3 from neuraminidase__InfluenzaA__ABJ09143

SEQ ID NO: 137524 - RNA, 1413 nt, Artificial Sequence; identical to SEQ ID NO: 136941
  derived and/or modified sequence opt3 from neuraminidase__InfluenzaA__ABJ09154

SEQ ID NO: 137525 - RNA, 1410 nt, Artificial Sequence; identical to SEQ ID NO: 136343
  derived and/or modified sequence opt3 from neuraminidase__InfluenzaA__ABJ09165

SEQ ID NO: 137526 - RNA, 1410 nt, Artificial Sequence; identical to SEQ ID NO: 136343
  derived and/or modified sequence opt3 from neuraminidase__InfluenzaA__ABJ09176

SEQ ID NO: 137527 - RNA, 1410 nt, Artificial Sequence; identical to SEQ ID NO: 136730
  derived and/or modified sequence opt3 from neuraminidase__InfluenzaA__ABJ09198

SEQ ID NO: 137528 - RNA, 1410 nt, Artificial Sequence; identical to SEQ ID NO: 136730
  derived and/or modified sequence opt3 from neuraminidase__InfluenzaA__ABJ09209

SEQ ID NO: 137529 - RNA, 1410 nt, Artificial Sequence
  derived and/or modified sequence opt3 from neuraminidase__InfluenzaA__ABJ09220
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcaaaguacaggaauuggucaaaaccucagugcaagaucacaggguucgccccauuuaguaaggacaacagcauacggcuauccgcgggaggugauauuugggugacccgcgagcccuaugucucuugugacccuggcaaaugcuaccaauucgcucucgggcgaggaacgacucugaauaaccgucauucgaaugauaccgugcacgacagaacaccauauaggacucuucugaugaacgaguugggcguucccuuucaucucgguaccaaacagguguguaucgccuggucaagcaguuccugccacgaugggaaggcauggcugcaugucugugugacaggacacgacgaaaaugccaccgcuucuuucauuuacgauggccggcugguagacagcaucggcuccuggucaaagaacauccuccgcacgcaggagagugaaugcguuuguauuaaugggacuugcacaguggucaugaccgauggaagcgcaucugagagagccgacacuaaaauauuauuuaucgaggaagguaagauugugcacaucuccccucugucaggcagcgcucagcauguggaggaaugcaguuguuauccaagguacccggggguccggugcguuugucgcgauaacuggaagggaucuaaccgacccauaguggacauuaauguaaaagauuacuccaucgugagcucguaugucugcucuggccuugugggugacacaccuagaaagaacgacuccucaaguagcuccuacuguaggaauccaaacaaugagaaagggucucacggaguuaagggcugggccuucgaugacggcaacgauguguggauggggcggaccaucagcgaagaguugcguucaggauaugagacguuuaaagucauugguggcuggaguaagcccaauuccaaacugcaaaucaaccgccaggugauuguagacagagggaauaggagcggauacucuggcauauucucaguugaagguaagaguugcaucaaccgguguuuuuauguggagcuaauucgagggcgcaagcaggaaaccgaggucugguggacaagcaauuccaucguggucuucugcggcacuucuggaaccuacggcacagggucguggccugauggagcggacaucaaccucaugccaauuuga

SEQ ID NO: 137530 - RNA, 1410 nt, Artificial Sequence; identical to SEQ ID NO: 136746
  derived and/or modified sequence opt3 from neuraminidase__InfluenzaA__ABJ09231

SEQ ID NO: 137531 - RNA, 1410 nt, Artificial Sequence; identical to SEQ ID NO: 136746
  derived and/or modified sequence opt3 from neuraminidase__InfluenzaA__ABJ09242

SEQ ID NO: 137532 - RNA, 1410 nt, Artificial Sequence; identical to SEQ ID NO: 136300
  derived and/or modified sequence opt3 from neuraminidase__InfluenzaA__ABJ09253

SEQ ID NO: 137533 - RNA, 1410 nt, Artificial Sequence
  derived and/or modified sequence opt3 from neuraminidase__InfluenzaA__ABJ09264
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaucauagagagaaauaucaccgaaauuguauauaugacaaacaccacuaucgagaaggaaauuugucccaaauuagcagaguacaggaauuggucaaagccucagugcaacaucacaggguucgccccauuuaguaaagacaauagcauacggcuguccgcgggaggugauauuugggugacccgcgagcccuaugucucuugugacccugauaagugcuaccaauucgcucuaggccaggggacgacucucaacaaucgacauucgaacgacaccgugcacgaucguacaccauauagaacucugcuuaugaaugaacugggaguucccuuucauuugggcaccaaacagguguguaucgccuggucaagcaguuccugccacgacgguaaggcauggcuccaugucugugugacagggcacgaugagaacgccaccgcuucuuucauuuacaauggaaggcugguagacagcaucggcuccuggucaaagaaaauccugcggacgcaggaaagugagugcguuuguauuaacggcacuugcacaguggucaugaccgaugggagcgcaucuggaaaggccgacacuaaaauacucuuuaucgaggaagguaagauugugcacaucuccccuuuaucaggcagcgcucaacauguggaggaaugcaguuguuauccacgcuacccgggggucagaugcguuuguagggauaacuggaagggaucuaaucggcccauaguggacauuaacguaaaagauuacuccaucgugagcucguaugucugcucuggccuggugggugacacaccucgcaagaaugacuccucaaguagcucccacugucuuaacccaaauaacgaggaagggggacauggcguuaaaggcugggccuucgaugacgggaaugauguguggaugggacgaaccaucucugagaaguugagaagcgguuacgagacguuuaaagucauugaaggcuggucaaagcccaacaguaaacugcagaucaauaggcaagugauuguagaccgggggaacuccagcggauauucuggcauauucucaguugaggguaagaguugcaucaaucguuguuuuuacguggaacuaauucgcgggagaaagcaggagaccgaagucugguggacaagcaacuccaucgugguccucugcggcacuucuggaaccuauggcacagggucguggccugauggagcggacaucaaucugaugccaauuuga

SEQ ID NO: 137534 - RNA, 1410 nt, Artificial Sequence
  derived and/or modified sequence opt3 from neuraminidase__InfluenzaA__ABJ09286
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccccucugucagggagcgcucaacacguggaggaaugcaguuguuauccacgguacccgggaguccgcugcguuuguagagacaacuggaagggcucuaauaggcccaucguggauauaaacguaaaagacuacuccauugugagcucguaugucugcucuggucuugugggggacaccccucggaagaaugauuccucaaguagcucccauuguuuggacccaaacaaugaggaaggaggccacggcguuaaagggugggccuucgaugacggaaacgauguguggaugggucgcacgaucucugagaagcugcgaagcggcuacgagaccuuuaaagucaucgaaggguggucaaagcccaauaguaaacuacagauuaacaaacaggugaucguagacagaggaaauagguccggcuauagcgguauuuucucuguugaggggaagucaugcauaaaccgguguuuuuacguggaacucauccguggccgcaagcaggagacagaaguccuguggaccaguaauagcauuguggucuucugcggaacuuccggcacauaugggacuggaucuuggccugauggugcggacaucaaccuuaugccaaucuga

SEQ ID NO: 137535 - RNA, 1410 nt, Artificial Sequence; identical to SEQ ID NO: 136300
  derived and/or modified sequence opt3 from neuraminidase__InfluenzaA__ABJ09308

SEQ ID NO: 137536 - RNA, 1410 nt, Artificial Sequence; identical to SEQ ID NO: 137504
  derived and/or modified sequence opt3 from neuraminidase__InfluenzaA__ABJ09319

SEQ ID NO: 137537 - RNA, 1413 nt, Artificial Sequence; identical to SEQ ID NO: 136969
  derived and/or modified sequence opt3 from neuraminidase__InfluenzaA__ABJ09330

SEQ ID NO: 137538 - RNA, 1410 nt, Artificial Sequence
  derived and/or modified sequence opt3 from neuraminidase__InfluenzaA__ABJ09341
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugcuugggagcgcucaacacguggaggaaugcaguuguuauccucgguacccaggaguccgcugcguuuguagagacaacuggaagggcucuaauaggccgaucguggauauaaacguaaaagacuacuccauugugagcucguaugucugcucugguuuggugggggacacgccccggaagaaugauuccucaaguagcucccauugucuggacccuaacaaugaggaaggaggccacggcguuaaagggugggccuucgaugacggaaacgauguguggaugggucgcaccaucucugagaagcuacgaagcggcuacgagaccuuuaaagucaucgaaggguggucaaagccaaauaguaaacuccagauuaacagacaggugaucguagacaggggaaaucgguccggcuauagcgguauuuucucuguugagucaaagaguugcauaaaccguuguuuuuacguggaacugauccgcgggagaaagcaggagacagaaguccuuuggacuagcaauuccauuguggucuucugcggcaccucuggaacauauggcacugggucguggcccgauggagcggacaucaaccugaugccuaucuga

SEQ ID NO: 137539 - RNA, 1410 nt, Artificial Sequence
  derived and/or modified sequence opt3 from neuraminidase__InfluenzaA__ABJ09352
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacggccgaacaccauaucguacucuucugaugaaugaauuggguguucccuuucaucucgggaccaaacagguguguaucgccuggucaagcaguuccugccacgauggaaaggcauggcugcaugucugugugacaggcgacgaugagaacgccaccgcuucuuucauuuacaauggcagacugguagacagcaucggguccuggucaaagaaaauccucaggacgcaggaaagugagugcguuuguauuaacggaacuugcacaguggucaugaccgaugguagcgcaucuggcaaggccgacacuaaaauauuauuuaucgaggaagggaagauugugcacacauccucacugagcggaagugcucaacacguggaggaaugcucuuguuauccucgguacccaggcguccgcugcguuuguagagauaacuggaaggguuccaauaggccgaucguggacauaaacguaaaagauuacagcauugugucgucuuaugucugcuccgggcuugugggagacacgccccggaagaaugacucaaguagcuccucucauuguuuggauccuaacaaugaggaaggcggccacgggguuaaaggaugggccuucgacgaugguaacgacguguggaugggccgcaccaucagcgagaagcugcgaucaggguacgagaccuuuaaagucaucgaaggauggaguaagccaaauuccaaacuacagauuaacagacaggugaucguagauaggggcaaucggagcgguuauucugggauuuucucaguugagaguaagagcugcauaaaccguuguuuuuacguggaacucauccgcggcagaaagcaggagacagaaguccuguggacuuccaauucuauuguggucuucugcggaaccucgggcacauaugggacuggaagcuggcccgacggugcggauaucaaccuuaugccuaucuga

SEQ ID NO: 137540 - RNA, 1407 nt, Artificial Sequence
  derived and/or modified sequence opt3 from neuraminidase__InfluenzaA__ABJ09374
augauccagagcaagauuauaaccaucggcuccgugucucugacaauuucaacuaucugcuucuuuaugcaaauugccauccucauaacgaccgucacacuucacuucaaacaguacgaguuuaacagucccccuaauaaccagguuaugcugugugaaccaacuaucauugagagaaauaucaccgaaauuguguauuugacaaacaccacuaucgagaaggaaauaugcccgaaauuagcugaguacaggaauuggagcaagccccagugugacauuacaggguucgcaccuuuuuccaaagauaacucuauccggcugucggccggaggugacauuuggguaacccgcgagccauaugugucaugcgaucccgacaaguguuaccaauucgcgcuaggccaggggacgacucucaauaacguccauagcaaugauaccgugcacgaccgaacaccuuaucguacucugcuuaugaacgaacugggaguuccauuucauuugggcaccaaacaggugugcaucgcuuggaguuccucuagcugucacgaugguaaggccuggcuccaugucugcgugacaggggacgauaagaaugcaaccgccuccuucaucuacaacggaagacugguagacucaauuguuaguuggagcaaaaagauacugaggacgcaggagucugaaugugugugcaucaauggcacuuguacagucgugaugaccgauggcuccgcuucagggaaagcagacacuaagauucucuuuaucgaggagggaaagauagugcacacaagcaccuuaagugguucugcccaacacgucgaagagugcuccugcuauccccgguacccuggcguucgcugugugugcagagauaacuggaaagggagcaauaggccaauuguagacaucaacaucaaggacuacucgauugugucuuccuaugucuguucaggacuggugggcgauacgccgcggaaaaacgacaguagcuccucuagccauugccuugaucccaauaacgaagagggugggcacggaguuaagggcugggcuuucgacgauggcaaugacguguggauggggcgcaccaucucagaaaaauugcgaaguggauacgagacauuuaaggucauugaggguugguccaacccuaauagcaaacugcagauaaacagacaggugaucguagauaggggcaaucggucuggguauucaggaauuuucaguguugaaggcaagagcuguaucaaccguugcuuuuacguggagcuaauccgcgguaagaaagaagagacugaaguccucuggaccuccaauucuauuguggucuucugugggacaucgggcacuuauggaaccggcagcuggccagacggggccgauauaaaccugaugcccaucuga

SEQ ID NO: 137541 - RNA, 1410 nt, Artificial Sequence; identical to SEQ ID NO: 136730
  derived and/or modified sequence opt3 from neuraminidase__InfluenzaA__ABJ09385

SEQ ID NO: 137542 - RNA, 1410 nt, Artificial Sequence; identical to SEQ ID NO: 136269
  derived and/or modified sequence opt3 from neuraminidase__InfluenzaA__ABJ16590

SEQ ID NO: 137543 - RNA, 1410 nt, Artificial Sequence; identical to SEQ ID NO: 137534
  derived and/or modified sequence opt3 from neuraminidase__InfluenzaA__ABJ16601

SEQ ID NO: 137544 - RNA, 1413 nt, Artificial Sequence
  derived and/or modified sequence opt3 from neuraminidase__InfluenzaA__ABJ16612
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgagaauagcaccugggucaaccacacauauguuaauauuaacaauacuaacgugguagcagggaaagacaagaccucggugacacuugccggaaauucaagccuguguaguaucuccggcugggcgauuuacaccaaagauaacucuaucaggaucgguagcaagggggacgucuucgugauucgggaaccuuuuauauccugcucacauuuggagugucgcacuuucuuuuuaacacaaggagcucugcuaaaugauaaacacaguaacggcaccguuaaggaccgaagcccauaucgugcccucaugucuugcccgcugggcgaagcacccuccccuuacaauucaaaguucgagagcguggccuggagugcuucugcaugucaugaugggaugggauggcuuacggucgguaucuccggcccagacaacggggccguggcuguacugaaauauaacggaauuaucacugaaaccauaaagagcuggaaaaagagaauuuugaggacacaggagucggagugcguuugugugaauggcucuugcuuuacuaucaugaccgauggucccuccaacggggccgcgucauacaaaaucuucaagauugaaaagggaaaagucacaaagaguaucgagcucaaugcaccuaacuuucacuaugaagaguguagcugcuacccagacaccggcacggugaugugugugugccgggauaauuggcacggcuccaaccgccccugggucucuuucaaucagaaccuggacuaccagauuggguauauaugcagcggaguuuuuggugauaauccuagaccaaaagacggcgaggggucauguaacccggugacuguagauggagccgacggcgugaaggguuucaguuacaaauaugggaauggcgucuggaucggaaggacaaaguccaaccggcugcgcaaaggcuuugaaaugauuugggaccccaauggguggaccgauacugacagcgauuucucugugaagcaagacguuguggcuaucacagauuggucaggauacagugguagcuuuguccagcauccugagcucaccggcuuagacugcauccgaccauguuucuggguggaacugguaagagggcuucccagggagaacacgaccauuuggacauccggaucuucgauaucuuucugcggcguuaauuccgauacugccaacuggucauggccugacggugcagaauugccauuuaccaucgauaaguga

SEQ ID NO: 137545 - RNA, 1410 nt, Artificial Sequence; identical to SEQ ID NO: 137534
  derived and/or modified sequence opt3 from neuraminidase__InfluenzaA__ABJ16623

SEQ ID NO: 137546 - RNA, 1410 nt, Artificial Sequence
  derived and/or modified sequence opt3 from neuraminidase__InfluenzaA__ABJ16634
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacauuaccaucgagaaggaaauaugccccaaauuagcugaguacaggaauuggaguaagccucagugugacauuacuggguucgcaccauuuagcaaagauaacuccauccggcugucugccggaggugacauuuggguaacacgcgagcccuaugugucgugcgauccugacaaguguuaccaauucgcgcuaggccaggggaccacgcucaauaacguccauucaaaugauacugugcacgaccgaaccccauaucguacacugcuuaugaacgaacugggaguucccuuucauuugggcacuaaacaggugugcaucgcuuggagcaguuccucuugucacgaugguaaggccuggcuccaugucugcgugaccggggacgauaagaaugcaacagccagcuucaucuacaacggaagacugguagacuccauuguuucauggaguaaaaagauacugaggacccaggagagcgaaugugugugcaucaauggcacguguacugucgugaugacagauggcucugcuuccgggaaagcagacaccaagauucucuuuaucgaggagggaaagauagugcacacuucaacauuaagcgguagugcccaacacgucgaagagugcucuugcuauccucgguacccaggcguucgcugugugugcagagauaacuggaaaggguccaacaggccgauuguagacaucaauaucaaggacuacagcauugugucgucuuaugucuguuccggacuggugggcgauacgccccggaaaaacgacucaaguagcuccucucauugccuugauccuaauaacgaagagggugggcacggaguuaagggcugggcuuucgacgauggcaaugacguguggauggggcgcaccaucagcgaaaaauugcgaucaggauacgagaccuuuaaggucauugaggguuggaguaacccaaauuccaaacugcagauaaacagacaggugaucguagauaggggcaaucggagcggguauucuggaauuuucucaguugaaggcaagaguuguaucaaccguugcuuuuacguggagcuaauccgcgguagaaaggaagagacagaaguccucuggacuagcaauuccauuguggucuucugugggaccucuggcacauauggaacuggcucguggcccgacggggccgauauaaaccugaugccuaucuga

SEQ ID NO: 137547 - RNA, 1413 nt, Artificial Sequence; identical to SEQ ID NO: 136402
  derived and/or modified sequence opt3 from neuraminidase__InfluenzaA__ABJ16656

SEQ ID NO: 137548 - RNA, 1413 nt, Artificial Sequence; identical to SEQ ID NO: 136402
  derived and/or modified sequence opt3 from neuraminidase__InfluenzaA__ABJ16667

SEQ ID NO: 137549 - RNA, 1413 nt, Artificial Sequence
  derived and/or modified sequence opt3 from neuraminidase__InfluenzaA__ABJ16678
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcaaggggucauguaacccggucacuguugauggagccgacggcgugaaagguuucaguuacaaguaugggaauggcguauggaucggaaggacaaaauccaaccggcugcgcaagggcuuugagaugaucugggaccccaauggguggaccgauacugacagcgauuuccucgugaagcaagacgucguggcuauuacagauuggucuggauacucagguaguuuuguucagcauccugaauuaaccggccuggacugcauacgaccauguuucuggguggagcuugucagaggguugcccagggaaaacacgaccaucuggacaagcggauccucuauuucguucugcggcguggauagcgacacugccaauugguccuggccugauggugcagagcugccauuuaccaucgacaaauga

SEQ ID NO: 137550 - RNA, 1413 nt, Artificial Sequence; identical to SEQ ID NO: 136402
  derived and/or modified sequence opt3 from neuraminidase__InfluenzaA__ABJ16689

SEQ ID NO: 137551 - RNA, 1410 nt, Artificial Sequence
  derived and/or modified sequence opt3 from neuraminidase__InfluenzaA__ABJ16700
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacguaaaagacuacagcauugugucgucuuaugucugcuccggucuugugggggacacgccccggaagaaugauucaaguagcuccucucauuguuuggacccuaacaaugaggaaggaggccacggcguuaaagggugggccuucgaugacggaaacgauguguggaugggucgcaccaucagcgagaagcugcgaucaggcuacgagaccuuuaaagucaucgaaggguggaguaagccaaauuccaaacuacagauuaacagacaggugaucguagacaggggaaaucggagcggcuauucugguauuuucucaguugagaguaagagcugcauaaaccguuguuuuuacguggaacucauccgcgggaagaaacaggagacagaaguccuguggacuuccaauucuauuguggucuucugcggcaccucgggaacauauggcacugggagcuggcccgauggagcggacaucaaccuuaugccuaucuga

SEQ ID NO: 137552 - RNA, 1410 nt, Artificial Sequence
  derived and/or modified sequence opt3 from neuraminidase__InfluenzaA__ABJ16711
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacauuaaagacuacagcaucguaucgucuuaugugugcuccggucuugucggggacacgccccggaagaaugauucaaguagcuccucucauuguuuggacccuaacaaugaggaaggaggccacggcgugaaagggugggccuucgaugacggaaacgaugcguggaugggucgcaccaucagcgagaagcugcgaucaggcuacgagaccuuuaaaguuauugaaggguggaguaaguccaauagcaaacuacagaucaacagacaggugauugucgacaggggaaaucggucuggcuauucagguauauucaguguggagggcaagagcugcaucaaccguuguuuuuacguagaacucauucgcgggagaaagcaggagacagaaguucuguggacuuccaauucuaucguggucuucugcggaaccucgggcacauaugggacuggaagcuggccagauggugcagacaucaaccuuaugcccauuuga

SEQ ID NO: 137553 - RNA, 1413 nt, Artificial Sequence
  derived and/or modified sequence opt3 from neuraminidase__InfluenzaA__ABJ16733
augaaccccaaucagaagaucauuaccauaggcagcaucuccguggccauugggaucauuaaccugauccuccaaauaggaaauaucauuucuaucugggcuucacacaguauucagacagguagccagaacuacacuggcaucugcaaucagagaauaauuacguaugagaacaggaccugggucaaucaaacauacguuaacaucaauaacacuaaugugguagcagggaaagacaagaccuccaugacacuugccggaaacucuucgcuguguccuauucggggcugggcgaucuauaccaaagauaauucaauccgcauugguagcaagggggacauauucgugauccgagaaccauuuauuaguugcucccauuuggagugucguacuuucuuuuuaacacagggagcucugcuaaacgauaaacacucuaauggcaccaucaaggacagaagcccguucagggcccucauguccugcccccugggcgaagcaccuucaccauacaacagucgguuugagagcgucgccuggucugcuuccgcaugucaugaugggcuuggauggcugacgauagguauuucaggccccgacaacggggccguggcuguuuugaaguauaauggaaucaucacugaaaccauuaaaagcuggaagaaacagauccuccgcacacaggagagugagugcgugugugucaacggcucuugcuucacuauuaugaccgaugguccuuccaauagagccgcgagcuacaggauauuuaagaucgaaaaagggcgggugacaaagucgauugagcuggacgcaccaaacuaucacuacgaagaguguucuugcuaccccgauaccggaacgguaauguguguuugccgcgacaauuggcauggcuccaaccgaccuugggugucauucaaucaaaaccuggauuaucagaucggcuacaucugcaguggggucuuuggagacaauccaagaccgaaggauggugagggcagcuguaaccccgugacuguggacggggccgacggagucaaaggcuucuccuauagguacgguaaugggguuuggauuggccggacaaagucuaaccgucuccgcaaaggauuugaaaugauaugggauccuaauggcuggaccgacacugauagcgacuucucaaugaagcaggaugugguagcuaugacagacuggaguggguauuccgguagcuuugugcagcacccagaguuaaccggacuggauugcaugagacccuguuucugggucgaacuugugaggggcuugccucgggagaacacgaccaucuggacaucugggucaaguauuagcuucugcggaguuaauuccgaaacugccaacuggucuuggccagacggcgcagagcugcccuuuaccaucgauaaauga

SEQ ID NO: 137554 - RNA, 1410 nt, Artificial Sequence; identical to SEQ ID NO: 136746
  derived and/or modified sequence opt3 from neuraminidase__InfluenzaA__ABJ16744

SEQ ID NO: 137555 - RNA, 1410 nt, Artificial Sequence; identical to SEQ ID NO: 136746
  derived and/or modified sequence opt3 from neuraminidase__InfluenzaA__ABJ16755

SEQ ID NO: 137556 - RNA, 1410 nt, Artificial Sequence; identical to SEQ ID NO: 136746
  derived and/or modified sequence opt3 from neuraminidase__InfluenzaA__ABJ16766

SEQ ID NO: 137557 - RNA, 1410 nt, Artificial Sequence
  derived and/or modified sequence opt3 from neuraminidase__InfluenzaA__ABJ16777
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacauuaaagacuacagcaucguaucgucuuaugugugcuccggucuugucggggacacgccccggaagaaugauucaaguagcuccucucauuguuuggacccuaacaaugaggaaggaggccacggcgugaaagggugggccuucgaugacggaaacgauguuuggaugggucgcaccaucagcgagaagcugcgaucaggcuacgagaccuuuaaagugauugaaggguggaguaagccaaauuccaaacuacagaucaacagacaggucauuguggacaggggaaaucggagcggcuauucugguauauucucaguagaggggaagaguugcaucaaccguuguuuuuacguugaacucauucgcggcagaaagcaggagacagaagugcuguggacuagcaauuccaucgucguguucugcggaaccucuggcacauaugggacuggaucguggcccgauggugcggacaucaaccuuaugccuauuuga

SEQ ID NO: 137558 - RNA, 1410 nt, Artificial Sequence; identical to SEQ ID NO: 136746
  derived and/or modified sequence opt3 from neuraminidase__InfluenzaA__ABJ16788

SEQ ID NO: 137559 - RNA, 1413 nt, Artificial Sequence; identical to SEQ ID NO: 136984
  derived and/or modified sequence opt3 from neuraminidase__InfluenzaA__ABJ53441

SEQ ID NO: 137560 - RNA, 1413 nt, Artificial Sequence
  derived and/or modified sequence opt3 from neuraminidase__InfluenzaA__ABJ53452
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuauugcagggaaagacaagaccucggugacacuugccggaaauucaagccuguguaguaucuccggcugggcgaucuacaccaaagauaacucuauuaggauagguagcaagggggacguauucgugauccgggagccuuuuauuuccugcucacauuuggagugucgcacuuucuuuuuaacacaaggagcucugcuaaaugauaaacacaguaacggcaccgucaaggaccgaagcccauaucgugcccucaugucuugcccgcugggcgaagcacccuccccuuacaauucaaaguucgagagcguggccuggagugcuucugcaugucaugaugggaugggauggcuuacgaucgguauauccggcccagacaacggggccguugcugugcugaaauauaacggaauuaucacugaaaccaucaagagcuggaaaaagagaauuuugaggacacaggagucggagugcgucugugugaauggcucuugcuuuacuaucaugaccgauggucccuccaacggggccgcgucauacaaaauuuucaagauagaaaagggaaaaguaacaaagaguaucgagcucaaugcaccuaacuuucacuaugaagaguguagcugcuacccagacaccggcacgguuaugugugugugccgggauaauuggcacggcuccaaccgccccugggucucuuucaaucagaaccuggacuaccagauuggguauaucugcagcggaguguuuggugauaauccuagaccaaaagacggcgaggggucauguaacccggugacugucgauggagccgacggcguuaaggguuucaguuacaaauaugggaauggcguguggaucggaaggacaaaguccaaccggcugcgcaaaggcuuugaaaugauuugggaccccaauggguggaccgauacugacagcaacuucucuguaaagcaagauguggucgcuauaacagacuggucaggauacagugguagcuuugugcagcauccugagcucaccggcuuagauugcauccgaccauguuucuggguugaacuggugagagggcuucccagggagaauacgaccauuuggacauccggaucuucgaucagcuucugcggcgucaacuccgacacugccaacuggucauggccugauggugcagaauugccauuuaccauugacaaguga

SEQ ID NO: 137561 - RNA, 1410 nt, Artificial Sequence; identical to SEQ ID NO: 136728
  derived and/or modified sequence opt3 from neuraminidase__InfluenzaA__ABJ53463

SEQ ID NO: 137562 - RNA, 1410 nt, Artificial Sequence; identical to SEQ ID NO: 136728
  derived and/or modified sequence opt3 from neuraminidase__InfluenzaA__ABJ53474

SEQ ID NO: 137563 - RNA, 1410 nt, Artificial Sequence
  derived and/or modified sequence opt3 from neuraminidase__InfluenzaA__ABJ53485
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgacugggauacgagacauuuaaagucaucgaagguuggucaaauaguaacuccaagcuacagacuaauagacaggugauuguagacaggggcaaccggagcggguauucuggaauauucucaguugagggcaaaaguuguaucaaucguugcuuuuacguggaacucauucgcgguagaaaggaggaaaccgagguccuguggacaagcaacuccaucguggucuucugugggacuucuggcaccuauggaacaggcucguggccagauggggccgacaucaaucuuaugcccauuuga

SEQ ID NO: 137564 - RNA, 1413 nt, Artificial Sequence; identical to SEQ ID NO: 137372
  derived and/or modified sequence opt3 from neuraminidase__InfluenzaA__ABJ53496

SEQ ID NO: 137565 - RNA, 1413 nt, Artificial Sequence; identical to SEQ ID NO: 137372
  derived and/or modified sequence opt3 from neuraminidase__InfluenzaA__ABJ53507

SEQ ID NO: 137566 - RNA, 1413 nt, Artificial Sequence
  derived and/or modified sequence opt3 from neuraminidase__InfluenzaA__ABJ53518
augaaccccaaucagaagaucauuaccauaggcagcaucuccguggccauugggaucauuaaccugauccuccaaauaggaaauaucauuucuaucugggcuucacacaguauucagacagguagccagaacuacacuggcaucugcaaucagagaauaauuacguaugagaacaggaccugggucaaucaaacauacguuaacaucaauaacacuaaugugguagcagggaaagacaagaccuccaugacacuugccggaaaccugucuuuguguccuauucggggcugggcgaucuauaccaaagauaauucgauccgcauugguucaaagggggacguguucgucauacgagaaccauuuaucagcugcagucauuuagagugucguacuuucuuucugacacagggagcucuacucaacgauaaacacuccaauggcaccauuaaggacagaucuccguucagggcccugaugagcugcccccuuggcgaagcaccuuccccauacaacucacgguuugagaguguggccuggagcgcuucugcaugucaugaugggcugggaugguugacgaucgguauauccggccccgacaacggggccguugcugugcucaaguauaauggaauuaucacugaaaccaucaaaucauggaagaaacagauucugcgcacacaggagagcgagugcgucugugugaacggcaguugcuucacuaucaugaccgaugguccuucuaauagagccgcguccuacaggauuuuuaagauagaaaaagggcggguaacaaagagcaucgagcuggacgcaccaaacuaucacuacgaagaguguucgugcuaccccgauaccggaacgguuaugugugugugccgcgacaauuggcauggcucuaaccgaccuugggucuccuucaaucaaaaccucgauuaucagauuggcuacaucugcucagggguguuuggagacaauccaagaccgaaggauggugagggcaguuguaaccccgugacugucgacggggccgacggaguuaaaggcuucagcuauagguacgguaaugggguguggaucggccggacaaaguccaaccguuuacgcaaaggauuugaaaugauuugggauccuaauggcuggaccgacacugauucugacuucagcaugaagcaggauguaguggcuaugacagacuggucaggguauaguggauccuuuguccagcacccagagcugaccggucuugauugcaugagacccuguuucuggguggaauugguuaggggccugccucgggagaacacgaccauauggacaagcgggucuucaaucaguuucugcggagugaauagcgaaacugccaacugguccuggccagacggcgcagagcuacccuuuaccauugauaaauga

SEQ ID NO: 137567 - RNA, 1410 nt, Artificial Sequence; identical to SEQ ID NO: 136170
  derived and/or modified sequence opt3 from neuraminidase__InfluenzaA__ABK39965

SEQ ID NO: 137568 - RNA, 1410 nt, Artificial Sequence
  derived and/or modified sequence opt3 from neuraminidase__InfluenzaA__ABK39976
augaaccccaaucagaagaucauuaccauaggcagcgugucccugacaaucucuacuacgugcuucuuuaugcaaauugccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucaguguaacaucaccggguucgcaccauuuagcaaagacaauuccauacggcugucugccggaggugauauuuggguaacgcgcgagcccuaugugucgugcgacccugauaaguguuaccaauucgcgcuaggccaggggacuacccucaacaauguccauucaaacgacacagugcacgaucgaacuccauaucguacccugcuuaugaaugaacugggaguucccuuucauuugggcacaaaacaggugugcaucgcuuggagcaguuccucuugucacgacgguaaggccuggcuccaugucugcgugaccggggaugacaagaacgcaacggccagcuucauuuacaauggaagacugguagauuccaucguuucauggaguaaagagauccugaggacucaggaaagcgagugugugugcauuaacggcacaugugcugucgugaugaccgacggcucugcauccgggaaggccgauacuaaaauacucuuuaucgaggaaggaaagauugugcacacaucaaccuuaagcgguagugcucaacacgucgaggaaugcucuugcuauccucgguacccaggcguucgcugugugugcagagacaacuggaagggguccaauaggccgaucguagauauaaacauuaaagacuacagcaucgugucgucuuaugucuguuccggacuggugggcgacacgccccggaagaaugauucaaguagcuccucucauugccuugacccuaacaaugaggaaggugggcacggaguuaaaggcugggccuucgaugacggcaacgauguguggauggggcgcaccaucagcgagaaguugcgaucaggauacgagacauuuaaagucauugaagguuggaguaauccaaacuccaagcugcagaucaauagacaggugauuguagacaggggcaaccggagcggguauucuggaauauucucaguugagggcaaaaguuguaucaaucguugcuuuuacguggaacuaauucgcgguagaaaggaggaaacugagguccucuggaccagcaacuccaucguggucuucugugggacaucuggcacuuauggaaccggcucguggcccgauggggcggacaucaaucugaugccuauuuga

SEQ ID NO: 137569 - RNA, 1410 nt, Artificial Sequence; identical to SEQ ID NO: 136728
  derived and/or modified sequence opt3 from neuraminidase__InfluenzaA__ABK39987

SEQ ID NO: 137570 - RNA, 1410 nt, Artificial Sequence; identical to SEQ ID NO: 136398
  derived and/or modified sequence opt3 from neuraminidase__InfluenzaA__ABK39998

SEQ ID NO: 137571 - RNA, 1410 nt, Artificial Sequence; identical to SEQ ID NO: 136343
  derived and/or modified sequence opt3 from neuraminidase__InfluenzaA__ABK40020

SEQ ID NO: 137572 - RNA, 1413 nt, Artificial Sequence
  derived and/or modified sequence opt3 from neuraminidase__InfluenzaA__ABK40031
augaaccccaaucagaagaucauuaccauaggcagcaucuccguggccauugggaucauuaaccugauccuccaaauaggaaauaucauuucuaucugggcuucacacaguauucagacagguagccagaacuacacuggcaucugcaaucagagaauaauuacguaugagaacaggaccugggucaaucaaacauacguuaacaucaauaacacuaaugugguagcagggaaagacaagaccuccaugacacuugccggaaacucuucgcuguguccuauucggggcugggcgaucuauaccaaagauaauucaauccgcauugguagcaagggggacguguucgucauacgagaaccauuuaucaguugcucccauuuggagugucguacuuucuuuuuaacacagggagcucugcuaaacgauaaacacucuaauggcaccauuaaggacagaagcccguucagggcccucauguccugcccccugggcgaagcaccuucaccauacaacagucgguuugagagcguggccuggucugcuuccgcaugucaugaugggcuuggauggcugacgaucgguauaucaggccccgacaacggggccguugcuguguugaaguauaauggaauuaucacugaaaccaucaaaagcuggaagaaacagauucuccgcacacaggagagugagugcgucugugugaacggcucuugcuucacuaucaugaccgaugguccuuccaauagagccgcgagcuacaggauuuuuaagauagaaaaagggcggguaacaaagucgaucgagcuggacgcaccaaacuaucacuacgaagaguguucuugcuaccccgauaccggaacgguuaugugugugugccgcgacaauuggcauggcuccaaccgaccuugggucucauucaaucaaaaccuggauuaucagauuggcuacaucugcagugggguguuuggagacaauccaagaccgaaggauggugagggcagcuguaaccccgugacugucgacggggccgacggaguuaaaggcuucuccuauagguacgguaaugggguguggaucggccggacaaagucuaaccgucuccgcaaaggauuugaaaugauuugggauccuaauggcuggaccgacacugauagcgacuucucaaugaagcaggauguaguggcuaugacagacuggaguggguauuccggauccuuuguccagcacccagaguuaaccggucuggauugcaugagacccuguuucuggguggaacuuguuaggggcuugccucgggagaacacgaccauauggacaucugggucaaguaucagcuucugcggagugaauagcgaaacugccaacuggucuuggccagacggcgcagagcugcccuuuaccauugauaaauga

SEQ ID NO: 137573 - RNA, 1413 nt, Artificial Sequence; identical to SEQ ID NO: 137572
  derived and/or modified sequence opt3 from neuraminidase__InfluenzaA__ABK40042

SEQ ID NO: 137574 - RNA, 1413 nt, Artificial Sequence; identical to SEQ ID NO: 137572
  derived and/or modified sequence opt3 from neuraminidase__InfluenzaA__ABK40053

SEQ ID NO: 137575 - RNA, 1410 nt, Artificial Sequence; identical to SEQ ID NO: 136746
  derived and/or modified sequence opt3 from neuraminidase__InfluenzaA__ABK40064

SEQ ID NO: 137576 - RNA, 1410 nt, Artificial Sequence; identical to SEQ ID NO: 136746
  derived and/or modified sequence opt3 from neuraminidase__InfluenzaA__ABK40078

SEQ ID NO: 137577 - RNA, 1413 nt, Artificial Sequence; identical to SEQ ID NO: 137075
  derived and/or modified sequence opt3 from neuraminidase__InfluenzaA__ABK40513

SEQ ID NO: 137578 - RNA, 1413 nt, Artificial Sequence; identical to SEQ ID NO: 137075
  derived and/or modified sequence opt3 from neuraminidase__InfluenzaA__ABK40538

SEQ ID NO: 137579 - RNA, 1413 nt, Artificial Sequence
  derived and/or modified sequence opt3 from neuraminidase__InfluenzaA__ABK40549
augaaccccaaucagaagaucauuaccauaggcagcaucugcaugacaauugggaucauuucccugauccuccaaauaggaaacaucauuucuaucugggugucacacaguauucagacugguagccagaaucauacgggcaucuguaaccagagaauaauuaccuacgaaaauuccacaugggucaaccaaacuuauguuaauaucaacaauaccaacgugguagccgggaaagacacaaccucugugacucuugcuggaaauucgucacugugcccuauuaggggcugggcaaucuacagcaaggauaacaguauccggauugguuccaaaggggacgucuucgugauacgcgagccauuuaucucuuguagccacuuggagugccgaacauucuuuuuaacccagggagcccugcuaaaugauaagcauuccaacggcacgguuaaagaccguucaccguauagagcgcucaugaguugucccauuggcgaagcuccuagcccauacaauucuagguucgaguccguggccuggucagcaagcgccugccacgaugggaugggauggcugacuaucgguauaaguggccccgacgauggggcugucgcagugcuuaaguauaacggaauuaucaccgaaacaaucaagucuuggcggaaacgcauucugagaacucaggaguccgaguguguaugcguuaacggcagcuguuuuaccaucaugacagacgguccuucgaaugggccagccucuuacaggauuuucaagauagaaaaaggaaagaucaccaaauccauugaguuggaugcucccaacucacauuaugaagagugcaguuguuacccugacacgggcacugugaugugcgucugccgggauaauuggcacggcagcaaccgcccauggguguccuuuaaucagaaccucgacuacaagaucggguauaucuguucuggaguguucggugauaauccgcgacccaaggacggcaaagggagcugcgacccugucacaguugauggagccgacggcgugaaggguuuuucauacagauaugggaacggcguauggauuggaaggaccaaaaguaauuccagccggaagggcuucgagaugauaugggauccaaacggguggacugacacagauucuaauuuucuggugaaacaagacgucguggcgaugaccgauuggucaggauacagugguagcuucguucagcaccccgaacugacgggccucgacuguaugcguccuugcuuuuggguggaguuaauccgcgggagaccaagggaaaagaccacaauuuggacuuccggaucuucgaucagcuucuguggcgucaacuccgauaccgcaaauuggucauggcccgacggugccgagcugccguucacaauugauaaauga

SEQ ID NO: 137580 - RNA, 1413 nt, Artificial Sequence; identical to SEQ ID NO: 137075
  derived and/or modified sequence opt3 from neuraminidase__InfluenzaA__ABK40560

SEQ ID NO: 137581 - RNA, 1413 nt, Artificial Sequence; identical to SEQ ID NO: 137075
  derived and/or modified sequence opt3 from neuraminidase__InfluenzaA__ABK40571

SEQ ID NO: 137582 - RNA, 1413 nt, Artificial Sequence; identical to SEQ ID NO: 137075
  derived and/or modified sequence opt3 from neuraminidase__InfluenzaA__ABK40582

SEQ ID NO: 137583 - RNA, 1413 nt, Artificial Sequence
  derived and/or modified sequence opt3 from neuraminidase__InfluenzaA__ABK40593
augaaccccaaucagaagaucauuaccauaggcagcaucugcaugacaauugggaucauuucccugauccuccaaauaggaaacaucauuucuaucugggugucacacaguauucagacugguagccagaaucauacgggcaucuguaaccagagaauaauuaccuacgaaaauuccacaugggucaaccaaacuuauguuaauaucaacaauaccaacgugguagccgggaaagacacaaccucugugacucuugcuggaaauucgucacugugcccuauuaggggcugggcaaucuacagcaaggauaacaguauccggauugguuccaaaggggacgucuucgugauacgcgagccauuuaucucuuguagccacuuggagugccgaacauucuuuuuaacccagggagcccugcuaaaugauaagcauuccaacggcacgguuaaagaccguucaccguauagagcgcucaugaguugucccauuggcgaagcuccuagcccauacaauucuagguucgaguccguggccuggucagcaagcgccugccacgaugggaugggauggcugacuaucgguauaaguggccccgacgauggggcugucgcagugcuuaaguauaacggaauuaucaccgaaacaaucaagucuuggcggaaacgcauucugagaacucaggaguccgaguguguaugcguuaacggcagcuguuuuaccaucaugacagacgguccuucgaaugggccagccucucauaggauuuucaagauagaaaaaggaaagaucaccaaauccauugaguuggaugcucccaacucacacuacgaagagugcaguuguuauccugacacgggcacugugaugugcgucugccgggauaauuggcacggcagcaaccgcccauggguguccuuuaaucagaaccucgacuacaagaucggguacaucuguucuggaguguucggugauaauccgcgacccaaggacggcaaagggagcugcgacccugucacaguugauggagccgacggcgugaaggguuuuucauauagauacgggaacggcguauggauuggaaggaccaaaaguaauuccagccggaagggcuucgagaugauaugggauccaaacggguggacugacacagauucuaauuuucuggugaaacaagacgucguggcgaugaccgauuggucaggauauagugguagcuucguucagcaucccgaacugacgggccucgacuguaugcguccuugcuuuuggguggaguuaauccgcgggagaccaagggaaaagaccacaauuuggacuuccggaucuucgaucagcuucuguggcgucaacuccgauaccgcaaauuggucauggcccgacggugccgagcugccguucacaauugauaaauga

SEQ ID NO: 137584 - RNA, 1413 nt, Artificial Sequence; identical to SEQ ID NO: 137075
  derived and/or modified sequence opt3 from neuraminidase__InfluenzaA__ABK40604

SEQ ID NO: 137585 - RNA, 1410 nt, Artificial Sequence; identical to SEQ ID NO: 136746
  derived and/or modified sequence opt3 from neuraminidase__InfluenzaA__ABK40615

SEQ ID NO: 137586 - RNA, 1410 nt, Artificial Sequence; identical to SEQ ID NO: 136077
  derived and/or modified sequence opt3 from neuraminidase__InfluenzaA__ABK40626

SEQ ID NO: 137587 - RNA, 1410 nt, Artificial Sequence
  derived and/or modified sequence opt3 from neuraminidase__InfluenzaA__ABK40648
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccuggcaagugcuaccaauucgcucucgggcagggaacgacucugaauaaccgacauucgaaugauaccgugcacgaccguacaccauauagaacucuucugaugaacgaauugggcauccccuuucaucucgguaccaaacagguuuguauugccuggucaagcaguuccugccacgaugggaaggcauggcugcaugugugugucacaggacacgacgagaaugccaccgcuucuuucaucuacgauggcaggcugguggacagcaucggcuccuggaguaaaaacauucuccggacgcaggaaucagagugcguauguauaaaugggacuugcacaguugugaugaccgauggaagcgcaucugaccgcgccgauacuaagaucuuauuuauugaggaagguaaaaucguccacauauccccucugucaggcagcgcucaacauguggaggaaugcaguuguuauccaagauacccgggggugaggugcgucugucgggacaacuggaagggaucuaaccgccccauuguugauaucaaugugaaggacuacuccaucguaagcucguaugugugcucuggccuugucggugacacaccucgaaagaacgauuccucaaguagcuccuacuguuggaauccaaacaaugagaaagggggacacggcgugaaaggcugggccuucgacgaugggaacgacguuuggaugggaagaaccauuucugaagagagcaggucagguuaugagacguuuaaggugaucggcggguggaguaaacccaauuccaaguugcagauuaaccggcaggucauaguggaucguggaaaucgcagcggcuacucugguaucuucucaguagaagggaaaaguugcauuaacagauguuuuuauguugagcugaucaggggccggaagcaggaaaccgaggugugguggacaagcaauuccaucgucguguucugcggaacuucuggcaccuacgggacaggaucguggccugacggugcggauauuaaccuaaugccaauauga

SEQ ID NO: 137588 - RNA, 1410 nt, Artificial Sequence; identical to SEQ ID NO: 137129
  derived and/or modified sequence opt3 from neuraminidase__InfluenzaA__ABK40659

SEQ ID NO: 137589 - RNA, 1410 nt, Artificial Sequence; identical to SEQ ID NO: 137117
  derived and/or modified sequence opt3 from neuraminidase__InfluenzaA__ABK40681

SEQ ID NO: 137590 - RNA, 1413 nt, Artificial Sequence
  derived and/or modified sequence opt3 from neuraminidase__InfluenzaA__ABK40692
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcugggagaaaagaaucuugaggacacaggagucggaaugcguguguguaaauggcucuugcuuuacuauuaugaccgauggucccuccaacggggccgcgucauacaagaucuucaaaauugagaagggaaagguuacaaaaaguguggaacucaaugcaccuaacuuucacuaugaggaguguagcugcuacccagacaccggcacggucaugugugugugccgggauaauuggcacggcuccaaccgccccugggugucuuucaaucagaaccuggacuaccagauaggguauaucugcagcggagucuuuggugauaauccuagaccaaaggacggcaaagggucauguaacccgguuacuguggauggagccgacggcguaaaggguuucaguuacaaauaugggaauggcguguggauuggaaggacaaaguccaaccggcugcgcaaaggcuuugaaaugaucugggaccccaauggguggaccgauacugacagcgauuucucugucaagcaagacgugguugcuaucacagauuggucaggauacagugguagcuuugugcagcauccugagcucaccggcuuagacugcauucgaccauguuucugggucgaacuggugagagggcuucccagggagaacacgaccauauggacauccggaucuucgaucagcuucugcggcguagauuccgacacugccaauuggucauggccugauggugcagaauugccauuuaccauugacaaguga

SEQ ID NO: 137591 - RNA, 1410 nt, Artificial Sequence; identical to SEQ ID NO: 136746
  derived and/or modified sequence opt3 from neuraminidase__InfluenzaA__ABK40703

SEQ ID NO: 137592 - RNA, 1410 nt, Artificial Sequence; identical to SEQ ID NO: 136746
  derived and/or modified sequence opt3 from neuraminidase__InfluenzaA__ABK40714

SEQ ID NO: 137593 - RNA, 1410 nt, Artificial Sequence; identical to SEQ ID NO: 136746
  derived and/or modified sequence opt3 from neuraminidase__InfluenzaA__ABK40725

SEQ ID NO: 137594 - RNA, 1410 nt, Artificial Sequence; identical to SEQ ID NO: 136746
  derived and/or modified sequence opt3 from neuraminidase__InfluenzaA__ABK40736

SEQ ID NO: 137595 - RNA, 1410 nt, Artificial Sequence; identical to SEQ ID NO: 137461
  derived and/or modified sequence opt3 from neuraminidase__InfluenzaA__ABK40747

SEQ ID NO: 137596 - RNA, 1413 nt, Artificial Sequence; identical to SEQ ID NO: 136967
  derived and/or modified sequence opt3 from neuraminidase__InfluenzaA__ABK79951

SEQ ID NO: 137597 - RNA, 1413 nt, Artificial Sequence; identical to SEQ ID NO: 137572
  derived and/or modified sequence opt3 from neuraminidase__InfluenzaA__ABK79973

SEQ ID NO: 137598 - RNA, 1410 nt, Artificial Sequence; identical to SEQ ID NO: 136746
  derived and/or modified sequence opt3 from neuraminidase__InfluenzaA__ABK79984

SEQ ID NO: 137599 - RNA, 1410 nt, Artificial Sequence; identical to SEQ ID NO: 136746
  derived and/or modified sequence opt3 from neuraminidase__InfluenzaA__ABK79995

SEQ ID NO: 137600 - RNA, 1413 nt, Artificial Sequence; identical to SEQ ID NO: 137075
  derived and/or modified sequence opt3 from neuraminidase__InfluenzaA__ABK80028

SEQ ID NO: 137601 - RNA, 1413 nt, Artificial Sequence; identical to SEQ ID NO: 137075
  derived and/or modified sequence opt3 from neuraminidase__InfluenzaA__ABK80039

SEQ ID NO: 137602 - RNA, 1413 nt, Artificial Sequence; identical to SEQ ID NO: 137075
  derived and/or modified sequence opt3 from neuraminidase__InfluenzaA__ABK80050

SEQ ID NO: 137603 - RNA, 1410 nt, Artificial Sequence
  derived and/or modified sequence opt3 from neuraminidase__InfluenzaA__ABK80061
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacguaaaagacuacagcauugugucgucuuaugucugcuccggucuugugggggacacgccccggaagaaugauucaaguagcuccucucauuguuuggacccuaacaaugaggaaggaggccacggcguuaaagggugggccuucgaugacggaaacgauguguggaugggucgcaccaucagcgagaagucacgaaguggcuacgagaccuuuaaagucaucgaagggugguccaagccaaauagcaaacugcagauuaacagacaggugaucguagacaggggaaaucggucuggcuauucagguauuuucaguguugagggcaagagcugcauaaaccguuguuuuuacguggaacuaauccgcgggagaaagcaggagacagaaguccucuggacuuccaauucuauuguggucuucugcggaaccucgggcacauaugggacuggaagcuggcccgauggugcggacaucaaccugaugccuaucuga

SEQ ID NO: 137604 - RNA, 1410 nt, Artificial Sequence; identical to SEQ ID NO: 136077
  derived and/or modified sequence opt3 from neuraminidase__InfluenzaA__ABK80072

SEQ ID NO: 137605 - RNA, 1410 nt, Artificial Sequence
  derived and/or modified sequence opt3 from neuraminidase__InfluenzaA__ABK80083
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugauguugugcgaaccgacuaucauagagagaaacaucaccgaaauuguauauuuaacaaauaccacuaucgagaaggaaauuugucccaaacuggcagaguacaggaacuggaguaagccucagugcaauaucacaggguucgccccauuuagcaaagacaacuccauacggcuaucugcgggaggugauauuugggugacccgcgagcccuaugucucgugugacccugauaagugcuaccaauucgcucucggccaggggacgacucugaauaacggacauucaaaugacaccgugcacgaucgaacaccauaucguacucuucugaugaacgaauugggcguucccuuucaucucgguaccaaacagguguguaucgccuggagcaguuccucuugccacgacgggaaggcauggcugcaugucugugugacaggagaugacgagaaugccaccgcuagcuucauuuacaacggcagacugguagauuccaucggcucauggaguaagaaaauccucaggacgcaggaaagcgagugcguuuguauuaaugggacuugcacaguggucaugaccgacggaucugcauccgguaaggccgauacuaaaauauuauuuaucgaggaaggcaagauugugcacacaucacugcuuagcgggagugcucaacacguggaggaaugcucuuguuauccucgguacccaggaguccgcugcguuuguagagacaacuggaagggcuccaacaggccgaucguggauauaaauguaaaagacuacagcauugugucgucuuaugucugcuccgguuuggugggggacacgccccggaagaacgauucaaguagcuccucucauugucuggacccuaauaacgaggaaggaggccacggcguuaaagggugggccuucgaugacggaaaugauguguggaugggucgcaccaucagcgagaagcuacgaucaggcuacgagaccuuuaaagucaucgaaggguggaguaagccaaacuccaaacuccagauuaauagacaggugaucguagacaggggaaaccggagcggcuauucugguauuuucucaguugaggggaagaguugcauaaaucguuguuuuuacguggaacugauccgcggcagaaagcaggagacagaaguccuuuggacuagcaacuccauuguggucuucugcggaaccucuggcacauaugggacuggaucguggcccgauggugcggacaucaaucugaugccuaucuga

SEQ ID NO: 137606 - RNA, 1410 nt, Artificial Sequence
  derived and/or modified sequence opt3 from neuraminidase__InfluenzaA__ABK80094
augaaccccaaucagaagaucauuaccauaggcagcgugucccugaucauugccacaaucugcuuccucaugcaaauugcuauccuugucacuacgguuacccugcacuuuaaacaguacgaguguaacucuccuccaaauaaccaggugauguugugcgaaccgacaauaaucgagagaaauauuacugaaaucguauauuuaaccaacacaaccauugagaaggaaaucugucccaaacuggcagaguacaggaauuggucaaagccucagugcaacauaacuggguucgccccauuuaguaaagacaauagcauucggcuauccgcgggaggugauaucugggugacacgcgagcccuaugucucuugugacccugauaagugcuaccaauucgcucucggccaggggaccacgcugaacaauggacauucgaacgacacugugcacgaucgaaccccauaucguacacuucugaugaaugaauugggcguucccuuucaucucgguacuaaacagguguguauugccuggucaagcaguuccugccacgacgggaaggcauggcugcaugucugugugaccggagaugacgagaacgccacagcuucuuucaucuacaauggcagacugguagauagcaucggcuccuggucaaagaaaauucucaggacccaggaaagugagugcguuuguauaaacgggacgugcacuguggucaugacagacggaagcgcaucugguaaggccgauaccaaaaucuuauuuauugaggaaggcaagaucgugcacacuuccucacugagcgggagugcucaacacguggaggaaugcucuuguuauccucgguacccaggaguccgcugcguuuguagagacaacuggaagggcuccaauaggccgauaguggauauuaacguaaaagacuacagcaucgugucgucuuaugucugcuccggucuugugggggacacaccccggaagaaugauucaaguagcuccucucauuguuuggacccuaacaaugaggaaggaggccacggcguuaaagggugggccuucgaugacggaaacgauguguggaugggucgcaccaucagcgagaagcugcgaucaggcuacgagacguuuaaagucauugaaggguggaguaagccaaauuccaaacuacagaucaacagacaggugauuguagacaggggaaaucggagcggcuauucugguauauucucaguugagaguaagagcugcaucaaccguuguuuuuacguggaacucauucgcgggagaaagcaggagaccgaaguccuguggacauccaauucuaucguggucuucugcggcacuucgggaaccuauggcacagggagcuggcccgauggagcggacaucaaccuuaugccuauuuga

SEQ ID NO: 137607 - RNA, 1410 nt, Artificial Sequence; identical to SEQ ID NO: 136746
  derived and/or modified sequence opt3 from neuraminidase__InfluenzaA__ABK80105

SEQ ID NO: 137608 - RNA, 1410 nt, Artificial Sequence
  derived and/or modified sequence opt3 from neuraminidase__InfluenzaA__ABK80138
augaaccccaaucagaagaucauuaccauaggcagcgugucccugacaaucgccacuauuugcuuccucaugcagacggcuauccuugucaccacaguuacucugcacuuuaaacaguacgaguguaacucuccuccaaauaaccaggugauguugugcgaaccgaccauuaucgagagaaauauaacagaaaucguauauuuaaccaacacuacaauugagaaggaaaucugucccaaacuggcagaguacaggaauuggucaaagccucagugcaacauuaccggguucgccccauuuaguaaagacaauagcauccggcuauccgcgggaggugauauaugggugacgcgcgagcccuaugucucuugugacccugauaagugcuaccaauucgcucucggccaggggacuacccugaacaauggacauucgaacgacacagugcacgaucgaacuccauaucguacccuucugaugaaugaauugggcguucccuuucaucucgguacaagacagguguguauugccuggucaagcaguuccugccacgacgggaaggcauggcugcaugucugugugaccggagaugacgagaacgccacggcuucuuucaucuacaauggcaggcugguagauagcauuggcuccuggaguaaaaagauccuccggacucaggaaucagagugcguuuguaucaacgggacaugcaccguggucaugacugacggaagcgcaucugguaaagccgauacaaagauuuuauuuauagaggaaggcaaaaucgugcacauuuccacccugucagggagcgcucaacacguggaggaaugcaguuguuauccucgcuacccaggagucagaugcguuuguagggacaacuggaagggcucuaaucggccgaucguggauauaaacguaaaggacuacuccauugugagcucguaugucugcucuggucuugugggggacacgccccgcaaaaaugauuccuucucaaguagccauuguuuggacccuaacaaugaggaaggaggccacggcguuaaggggugggccuuugaugacggaaacgauguguggaugggucgaaccaucuccgagaaacugagaucuggcuacgagacauucaaggucaucgaaggguggagcaaaccaaauucaaagcuacagauuaacaggcaagugaucguagagcggggaaaucguaguggcuauuccgguauuuuuagcguugaagggaaaucuugcauaaaccgcuguuucuacguggagcucaucagaggcaggaaggaagagacugaggucugguggaccucaaauaguauuguggucuuuugcggaacaagcggcacuuaugggaccggauccuggcccgacggugcggauaucaaccugaugccuaucuga

SEQ ID NO: 137609 - RNA, 1410 nt, Artificial Sequence
  derived and/or modified sequence opt3 from neuraminidase__InfluenzaA__ABK80149
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggcaauguuguaugaaccgacuaucauagagagaaauaucaccgaaauuguguacuuaacaaacaccacuaucgagaaggaaauuugccccaaacuggccgaguauaggaauuggucaaagccucaguguaacaucacaggguucgcgccauuuaguaaagacaauagcauacggcuauccgcuggaggugauauuuggguaacccgcgagcccuacgugucuugcgacccugauaaguguuaucaauucgcccucggccaggggacgacucugaacaauggacauucgaacgacaccguccacgaucgaacaccauaccguacucuucugaugaaugaauugggcgugcccuuucaucucgguaccagacagguuugcaucgcauggucaagcaguuccugucacgacgggaaggccuggcugcaugugugcgucacaggagaugacgagaacgcuaccgcaucuuucauuuauaauggcaggcugguggauagcaucggcuccuggaguaaaaagauccuccggacgcaggaaucagaguguguaugcauuaacgggacuuguacaguugugaugaccgacggaagcgccucugguaaagcugauacuaagauauuauuuaucgaggaaggcaaaauuguccacaucuccacacugucagggagcgcccaacacguggaggaaugcaguugcuacccucgcuacccaggagugagaugugucugcagggacaacuggaagggcucuaaucggccgauaguugauauuaacgugaaggacuauuccaucguaagcucguacguguguucuggucuugucggggacacgccccgcaaaaaugauuccuucucaaguagccauugcuuggacccuaacaaugaggaaggaggccacggcgugaaggggugggcguuugaugacggaaacgauguuuggaugggucgaaccaucuccgagaaacugagaucuggcuaugagaccuucaaggugauugaaggguggagcaaaccaaauucaaagcuacagaucaacaggcaggucauuguggagcggggaaaucguaguggcuacuccgguauauuuagcguagaagggaaaucuuguaucaaccgcugcuucuauguugagcucauuagaggcaggaaggaagagacagaggugugguggacuucaaauaguaucgucguguuuuguggaaccagcggcacauacgggacuggauccuggcccgacggugcagauaucaaccugaugccuauuuga

SEQ ID NO: 137610 - RNA, 1410 nt, Artificial Sequence; identical to SEQ ID NO: 137609
  derived and/or modified sequence opt3 from neuraminidase__InfluenzaA__ABK80160

SEQ ID NO: 137611 - RNA, 1410 nt, Artificial Sequence
  derived and/or modified sequence opt3 from neuraminidase__InfluenzaA__ABK80171
augaaccccaaucagaagaucauuaccauaggcagcgugucccugacaaucgccacuauuugcuuccucaugcaaaucgcuauucuugucacgaccguuacacugcacuuuaaacaguacgaguguaacccuccaccgaauaaccaggugauguugugcgaacccacuaucauagagagaaauaucaccgaaauuguauauuuaacaaacaccacuaucgagaaggaaauuuguccuaaacuggcagaguacaggaauuggucuaagccacagugcaacaucacaggguucgcccccuuuucaaaagacaauaguauacggcuaagcgcgggaggugauauuugggugacccgcgagccuuaugucuccugugacccagauaagugcuaccaauucgcucucggccaggggacgacucugaacaauggacauucuaacgacaccgugcacgaucgaacacccuaucguacucuucugaugaaugaauugggcguuccuuuucaucucgguaccagacagguguguaucgccuggucgucaagcaguugccacgacgggaaggcauggcugcaugucugugugacaggagaugacgagaacgccaccgcuuccuucauuuacaauggcaggcugguagauucuaucggcagcugguccaaaaagauccuccggacgcaggaaucagagugcguuuguauuaacgggacuugcacaguggucaugaccgacggaagugcaagcgguaaagccgauacuaagauauuauuuaucgaggaaggcaaaauugugcacaucucuacacuguccgggucagcucaacacguggaggaaugcagcuguuauccacgcuacccgggagucagaugcguuuguagggacaacuggaagggcaguaaucggcccauaguggauauuaacguaaaggacuacucuaucuucuccagcuaugugugcucgggucuugucggggacaccccucgcaaaaaugauucuuuuuccucaagucauuguuuggacccaaacaaugaggaaggaggccacggcgugaaggggugggccuucgaugacggaaacgauguuuggaugggucgaacgaucagcgagaaacugagauccggcuacgagaccuuuaaggugauugaaggguggucuaaacccaauagcaagcuacagacaaacaggcaggucaucguggagcggggaaaucguucaggcuauagugguauuuucuccguagaagggaaaagcugcauaaaccgcuguuuuuacguugagcucaucagaggcaggaaggaagagacugaggugugguggaccucuaauucaauugucguguucugcggaacaaguggcacuuaugggaccggaagcuggccugacggugcggauaucaaccugaugccaaucuga

SEQ ID NO: 137612 - RNA, 1410 nt, Artificial Sequence
  derived and/or modified sequence opt3 from neuraminidase__InfluenzaA__ABK80182
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacaaaaacgccaccgcuucuuucauuuacaauggcaagcugguagauagcaucggcuccuggaguaaaaagauccucaggacgcaggagucagaaugcguuuguauuaacgggacuugcgcaguggucaugacagacggaagcgccucugguaaagcugauaccaagauauuauuuaucgaggagggcaagauugugcacaucuccacucugucagggagcgcccaacacguggaagagugcaguuguuauccucgguacccaggaguccgcugcguuuguagagacaacuggaaaggcucuaauaggccgauaguggauauuaacguaaaggacuacuccaucgugagcucguaugucugcucuggucuugugggggacacaccccggaaaaaugauuccuucucaaguagccauuguuuggacccuaacaaugaagagggaggccacggcguuaaggggugggcguuugaugacggaaacgauguguggaugggucgcaccaucuccgaaaaacugcgaucuggcuacgagacguucaaggucauugagggguggagcaaaccaaauucaaagcuacagaccaacagacaggugaucguagaaaggggaaaucggaguggcuauuccgguauuuuuagcguugaggggaagucuugcauaaaccguuguuucuacguggaacucauccgcggcagaaaagaggaaacagaggucugguggacuucaaauaguauuguggucuuuugcggaaccagcggcacauaugggacuggauccuggcccgacggugcagauaucaaccugaugccuaucuga

SEQ ID NO: 137613 - RNA, 1410 nt, Artificial Sequence
  derived and/or modified sequence opt3 from neuraminidase__InfluenzaA__ABK80193
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacccccaggaaaaaugauuccuucucaaguagccauuguuuggacccuaacaaugaggaaggaggccacggcguuaaggggugggccuuugaugacggaaacgauguguggaugggucgaacgaucggcgagaaacugagauccggguacgagaccuucaaggucauugaaggauggucuaaaccaaauagcaagcuacagacaaaccgccaggugaucguagagcggggcaaucguucagguuauagugggauauuuuccguugaaggcaaaagcugcauuaaccgcuguuucuacguggagcucaucagaggaaggaaggaagagacugaggucugguggaccucuaauucaauuguggucuuuugcggcacaagugggacuuauggaaccgguagcuggcccgacggcgcggauaucaaccugaugccuaucuga

SEQ ID NO: 137614 - RNA, 1410 nt, Artificial Sequence
  derived and/or modified sequence opt3 from neuraminidase__InfluenzaA__ABK80204
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaaacugguagauagcaucggcuccuggucaaagaaaauccucaggacgcaggaaagugagugcguuuguauuaacgggacuugcgcaguggucaugacagacggaagcgccucugguaaggcugauaccaaaauauuauuuaucgaggaaggcaagauugugcacaucuccacucugucagggagcgcccaacacguggaggaaugcaguuguuauccucgguacccaggaguccgcugcguuuguagagacaacuggaagggcucuaauaggccgauaguggauauuaacguaaaagacuacuccaucgugagcucguaugucugcucuggucuugugggggacacaccccggaagaaugauuccuucucaaguagccauuguuuggacccuaacaaugaggaaggaggccacggcguuaaagggugggcguuugaugacggaaacgaugcauggaugggucgcaccaucuccgagaagcugcgaucuggcuacgagacguucaaagugauugaaggguggagcaagccaaauucaaaacuacagaccaacagacaggucaucguggagaggggaaaucggaguggcuauuccgguauuuuuagcguagaagggaagucuugcauaaaccguuguuucuacguugagcucauccgcggcagaaaggaagagacagaggugugguggacuucaaauaguauugucguguuuugcggaaccagcggcacauaugggacuggauccuggcccgacggugccgauaucaaccugaugccuaucuga

SEQ ID NO: 137615 - RNA, 1410 nt, Artificial Sequence; identical to SEQ ID NO: 136607
  derived and/or modified sequence opt3 from neuraminidase__InfluenzaA__ABK80215

SEQ ID NO: 137616 - RNA, 1410 nt, Artificial Sequence; identical to SEQ ID NO: 136607
  derived and/or modified sequence opt3 from neuraminidase__InfluenzaA__ABK80226

SEQ ID NO: 137617 - RNA, 1410 nt, Artificial Sequence
  derived and/or modified sequence opt3 from neuraminidase__InfluenzaA__ABK80237
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacugguggaguauaggaauuggucaaagccucagugcaacaucacaggguucgcaccauuuaguaaagacaauagcauacggcuauccgccggaggugauauuugggucacccgcgagcccuacgugucuugugacccugauaagugcuaucaauucgcgcucggccaggggacgacucugaacaauggacacucgaacgacaccguucaugaucgaacaccauaccguacucuucugaugaaugaauugggcgugcccuuucaccucgguaccagacaggucuguaucgcuuggucaagcaguuccugccaugacgggaaggccuggcugcacguguguguaacaggagaugacaaaaacgcaaccgccucuuucauuuauaauggcaggcugguugauagcaucggcuccuggucaaagaaaauccuccggacgcaggagagugaaugcguguguauuaacgggacuugcacagucgugaugaccgacggaagcgcuucugguaaggcagauacuaaaauauuauuuaucgaggagggcaagauugugcacaucuccacacugucagggagcgcccaacaugucgaagagugcaguuguuacccucgcuauccaggaguuagaugcguguguagggacaacuggaagggcucuaaucggccgauaguagauauuaacgugaaagacuacuccaucgucagcucguacgugugcucuggucuuguuggggacacgccccgcaagaccgauuccuucucaaguagccacuguuuggacccuaauaacgaagagggaggccauggcgugaaagggugggcuuuugaugacggaaaugaugucuggaugggucgaaccaucuccgaaaagcugagaucuggcuaugagacauucaaagugauugagggguggagcaagccaaacucaaaacuacagaucaauaggcagguaauuguugaacggggaaaccguaguggcuacuccgguauauuuagcguggaggggaagucuugcaucaaucgcuguuucuaugucgaacucauuagaggcaggaaggaggaaacugaggugugguggaccucaaacaguaucgucguguuuugcggaacaagcggcacuuacgggaccggauccuggcccgacggugccgauaucaaucugaugccuauuuga

SEQ ID NO: 137618 - RNA, 1410 nt, Artificial Sequence
  derived and/or modified sequence opt3 from neuraminidase__InfluenzaA__ABK80259
augaaccccaaucagaagaucauuaccauaggcagcgccucccugacaaucgcuacuauuugcuuccucauccaaauugcaauccuugugacgaccgucacacugcacuuuaaacagcaugaguguaacucuccuccaaauaaccagguuauguugugcgaaccgacuauaaucgagagaaauauuaccgaaaucguguacuuaacaaacaccacuauugagaaggaaaucugucccaaacuggccgaguauaggaauuggucaaagccucagugcaacauaacaggguucgcgccauuuaguaaagacaauagcauucggcuauccgcuggaggugauaucuggguaacccgcgagcccuacgugucuugugacccugauaagugcuaucaauucgcccucggccaggggacgacucugaacaauggacacucgaacgacaccguccaugaucgaacaccauaccguacucuucugaugaaugaauugggcgugcccuuucaccucgguaccagacagguuuguauugcauggucaagcaguuccugccaugacgggaaggccuggcugcacgugugugucacaggagaugacaaaaacgcuaccgcaucuuucaucuauaauggcaggcugguggauagcaucuccucauggaguaagaaaauucuccggacgcaggagagcgaaugcguauguauaaacggcacuugcacaguugugaugaccgacgggucugccuccggaaaggcugauacuaaaaucuuauuuauugaggaggguaagaucauacacauuucaacacugagcggcagugcccaacaugucgaagagugcucuuguuacccucgcuauccaggggugagaugcguguguagggacaacuggaagggauccaaucggccgaucgucgauaucaacguuaaagacuacagcauugugucgucuuacguaugcuccggccuugugggugacacccccaggaagaaugauucauucaguagcucccacuguuuggacccuaacaaugaagaagggggacauggcgucaaaggcugggcguuugaugacgggaacgauguguggaugggacgaacgaucucugagaagcugagaagcgguuaugagaccuucaaaguuauugagggcuggucaaauccaaacaguaagcuacagauaaaucgccaggugaucgucgaacgggggaaccguuccggauacagcggcauuuuuaguguggaggguaaaucaugcaucaaucgcuguuucuauguagaacucaucagagggaggaaggaggaaacagagguuugguggacuucuaacagcauuguggucuuuugcggcaccuccggaacauacggcacugggucuuggcccgacggagcagauauaaaucugaugccuaucuga

SEQ ID NO: 137619 - RNA, 1410 nt, Artificial Sequence; identical to SEQ ID NO: 136343
  derived and/or modified sequence opt3 from neuraminidase__InfluenzaA__ABK80270

SEQ ID NO: 137620 - RNA, 1410 nt, Artificial Sequence; identical to SEQ ID NO: 136730
  derived and/or modified sequence opt3 from neuraminidase__InfluenzaA__ABK80281

SEQ ID NO: 137621 - RNA, 1410 nt, Artificial Sequence
  derived and/or modified sequence opt3 from neuraminidase__InfluenzaA__ABK80292
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucauacacacaucaaccuuaagcgguagugcccaacacguggaggaaugcucuugcuauccucgguacccaggcguccgcuguguuugcagagacaacuggaagggguccaauaggccgauuguggauaucaacaucaaagacuacagcauuguaucgucuuauguguguuccggacuggucggcgacacgccccggaagaaugauucaaguagcuccucucauugccuugacccuaacaaugaggaaggugggcacggagugaaaggcugggcuuucgaugacggcaacgauguuuggauggggcgcaccaucagcgagaaguugcgaucaggauacgagacauuuaaagugauugaagguuggaguaauccaaacuccaagcugcagauaaauagacaggucaucguggacaggagcaaccggucuggcuauucagggauuuucaguguagagggaaaaagcuguaucaaucguugcuuuuacguugaacuaauccgcggcagaaaggaggaaacugaggugcucuggaccuccaacucuauugucguguucugugguacaucggggacuuauggcaccggaagcuggcccgauggcgccgacauaaaucugaugccuaucuga

SEQ ID NO: 137622 - RNA, 1410 nt, Artificial Sequence
  derived and/or modified sequence opt3 from neuraminidase__InfluenzaA__ABK80303
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguuguaugaaccgacuaucauagagagaaauaucaccgaaauuguauacuuaacaaacaccacuaucgagaaggaaauuugccccaaacuggcagaguauaggaauuggucaaagccucaguguaacaucacaggguucgccccauuuaguaaagacaauagcauacggcuauccgcgggaggugauauuugggugacccgcgagcccuacgucucuugcgacccugauaaguguuaucaauucgcucucggccaggggacgacucugaacaauggacauucgaacgacaccgugcacgaucgaacaccauaccguacucuucugaugaaugaauugggcguucccuuucaucucgguaccagacaggugugcaucgccuggucaagcaguuccugucacgacgggaaggcauggcugcaugucugcgugacaggagaugacgagaacgccaccgcuucuuucauuuauaauggcaggcugguagauagcaucggcuccuggaguaaaaagauccuccggacgcaggaaucagaguguguuugcauuaacgggacuuguacaguggucaugaccgacggaaacgcaagcgguaaagccgauacuaagauauuauuuaucgaggaaggcaaaauugugcacaucucuacacuguccgggucagcucaacacguggaggaaugcagcugcuacccucgcuacccaggagucagauguguuugcagggacaauuggaagggcaguaaccggccgauaguggauauuaauguaaaggacuauucuaucguguccagcuacgucuguucgggucuugugggggacacccccaggaaaaacgauucuuucuccucaagucauugcuuggacccuaauaacgaggaaggaggccacggcguuaaggggugggccuuugaugacggaaaugauguguggaugggucgaacgaucagcgagaaacugagauccggcuaugagaccuucaaggucauugaaggguggucuaaaccaaacagcaagcuacagaucaaucgccaggugauuguagagcggggaaaccguucaggcuacagugguauauuuuccguugaagggaaaagcuguaucaaucgcugcuucuauguggagcucauuagaggcaggaaggaagagacagaggucugguggacuucuaacucaaucguggucuuuuguggaaccaguggcacauacgggacuggaagcuggcccgacggugcggauaucaaucugaugccuauuuga

SEQ ID NO: 137623 - RNA, 1410 nt, Artificial Sequence
  derived and/or modified sequence opt3 from neuraminidase__InfluenzaA__ABK80314
augaaccccaaucagaagaucauuaccauaggcagcgugucccugacaaucgccacuauuugcuuccucaugcaaaucgcuauucuugucacgaccguuacacugcacuuuaaacaguacgagugugacucuccuccaaacaaucaggugauguuguaugaaccgacuaucauagagagaaacaucaccgaaauuguauacuuaacaaauaccacuaucgagaaggaaauuugccccaaacuggcagaguauaggaacuggucaaagccucaguguaauaucacaggguucgccccauuuaguaaagauaacagcauacggcuauccgcgggaggugacauuugggugacccgcgagcccuacgucucuugcgauccugacaaguguuaucaauucgcucucggccaggggacgacucugaauaacggacauucgaaugauaccgugcacgaccgaacaccauaccguacucuucugaugaacgaauugggcguucccuuucaucucgguaccagacaggugugcaucgccuggucaagcaguuccugucacgaugggaaggcauggcugcaugucugcgugacaggagacgaugagaaugccaccgcuucuuucauuuauaacggcaggcugguagacagcaucggcuccuggaguaaaaagauccuccggacgcaggaaucagaguguguuugcauuaaugggacuuguacaguggucaugaccgauggaagcgcaucugguaaagccgacacuaagauauuauuuaucgaggaaggcaaaauugugcacaucuccacacugucagggagcgcucaacacguggaggaaugcaguugcuacccucgcuacccaggagucagauguguuugcagggauaacuggaagggcucuaaccggccgauaguggacauuaauguaaaggacuauuccaucgugagcucguacgucuguucuggucuugugggggauacccccaggaaaaacgacuccuucucaaguagccauugcuuggauccuaauaacgaggaaggaggccacggcguuaaggggugggccuuugacgauggaaaugacguguggaugggucgaacgaucuccgagaaacugagaucuggcuaugagaccuucaaggucauugaaggguggagcaaaccaaacucaaagcuacagaucaaucgccaggugauuguagagcggggaaaccguaguggcuacuccgguauauuuagcguugaagggaaaucuuguaucaaucgcugcuucuauguggagcucauuagaggcaggaaggaagagacagaggucugguggacuucaaacaguaucguggucuuuuguggaaccagcggcacauacgggacuggauccuggcccgauggugcggacaucaaucugaugccuauuuga

SEQ ID NO: 137624 - RNA, 1350 nt, Artificial Sequence
  derived and/or modified sequence opt3 from neuraminidase__InfluenzaA__ABL07021
augaaccccaaucagaagaucauuaccauaggcagcaucugcauggugauugggaucgucucccugaugcuccaaauuggaaacaugaucucuauauggguuucacacaguauccagaaagguaaucagcaucaggccgagagcauuuccaacacaaauccucuuacugaaaaggcuguggcaucuaucacgcuggccggcaacucgucauuguguccaauuagagggugggcgguacacagcaaagacaauaacaucaggauaggaaguaagggcgauguguucgucauucgggagccguuuaucuccugcucucauuuagaaugucgcaccuucuuucugacacaaggugcucuacucaaugacaaacacagcaacgggacugugaaggaucgaucaccccaucguacccugauguccugcccuguuggagaggccccaagucccuacaauagcagauucgaaucuguggcaugguccgccucagcuugucacgacggcacaagcuggcuuaccauuggcaucagugggccugauaacgaggcagucgccgugcugaaguauaauggaaucauuacugacacaauaaaaucuuggaggaacaauaucuugcggacccaggaguccgaaugcgcuuguguaaacgguagcugcuuuacgguuaugacugauggcccaucgaacgggcaggccucuuacaagauuuucaaaaugaagaaaggaaagguggucaaguccguggagcucgacgcgcccaauuaucacuacgaagaguguucaugcuauccugaugcaggcgagaucaccugugugugccgcgacaacuggcaugguaguaauagaccaugggucagcuuuaaccagaaucuggaauaccaaauaggguauauuugcuccggaguuuucggcgauaacccgaggcccaaugacggcacagggucuuguggaccuaugagcccaaacggugccuacggcgugaaaggguuuucauucaaguacggaaauggcguauggaucggucggacuaaaaguaccaacucccgcagcggguuugagaugaucugggaucccaauggcuggacaggaaccgacucuucauucagugugaagcaggacauugucgcuaucacggauuggagcggcuauuccgggucuuuugugcagcacccugaacugacuggacucgacugcauucgaccauguuucuggguugaguuaauaagagguaggcccaaagaaucgacaaucuggaccagcggcuccucaauuaguuucugcggggugaacucugauacugucagcugguccuggccggacggagccgagcugccuuuuacaaucgauaaguga

SEQ ID NO: 137625 - RNA, 1350 nt, Artificial Sequence
  derived and/or modified sequence opt3 from neuraminidase__InfluenzaA__ABL07032
augaaccccaaucagaagaucauuaccauaggcagcaucugcauggugauugggaucgucucccugaugcuccaaauuggaaacaugguuucuacaugggugucacacaguauccagacugguaaucaguaccaggccgagagcauauccaacacgaauccucuuaccgaaaaagcuguagcaucugugacacuggccggcaacucgucauuguguccaaucagagggugggcgguccauagcaaggacaauaacauuaggaucggaaguaaaggcgauguguucguuauucgggagccguuuaucuccugcucucacuuagaaugucgcacuuucuuucugacccaaggugcucuacucaaugacaagcauagcaacgggacagugaaagaucgaucaccccaccguacccugauguccugcccugucggagaggccccaagucccuauaauagcagauucgaaucuguggcaugguccgccucagcuugucaugacggcacuagcuggcuuacaauaggcauuagugggccugauaacgaggcaguagccguucugaaguacaauggaaucauuaccgacacgaucaagucuuggaggaacaauaucuugcggacucaggaguccgaaugcgcuugugugaacgguagcugcuuuaccgucaugacagauggcccaucgaacgggcaggccucuuauaaaauuuucaagauggagaaaggaaagguggugaaauccgucgaacucgacgcgcccaauuaccacuaugaggaguguucaugcuacccugaugcaggcgaaauaacuuguguuugccgcgacaacuggcacgguaguaauagaccaugggugagcuuuaaccagaaucuggaguaucaaaucggguacauuugcuccggaguauucggcgauaacccgaggcccaaugacggcaccgggucuuguggaccuaugagcccaaacggugccuacggcgugaagggguuuucauucaaguauggaaauggcgucuggaucggucggacaaaaaguaccaacucccgcagcggguuugaaaugauaugggaucccaauggcuggacgggaacugacucuucauucagugugaagcaggacauuguugcuaucacagauuggagcggcuacuccgggucuuuugugcagcauccugagcugaccggacucgacugcauccgaccauguuucugggucgaauuaauuagagguaggcccaaagagucgacuaucuggacaagcggcuccucaauuaguuucugcggggugaacucugauaccguaagcugguccuggccggacggagccgagcugccuuuuacgauagauaaguga

SEQ ID NO: 137626 - RNA, 1350 nt, Artificial Sequence
  derived and/or modified sequence opt3 from neuraminidase__InfluenzaA__ABL31746
augaaccccaaucagaagaucauuaccauaggcagcaucugcauggugauugggaucgucucccugaugcuccaaauuggaaacaugaucucuauauggguuucacacaguauccagacagguaaucagcaucaggccgagagcauuuccaacacuaauccucuuacggaaaaagcuguggcaucuguaacccuggccggcaacucgucauuguguccaaucagagggugggcggugcacagcaaggacaauaacauuaggaucggaaguaaaggcgaugucuucgugauacgggagccguuuauuuccugcucucauuuagaaugucgcacauucuuucugacucaaggugcucuacucaaugacaagcacagcaacgggaccguuaaagaucgaucaccccaucguacacugauguccugcccugugggagaggccccaagucccuacaauagcagauucgaaucugucgcaugguccgccucagcuugucacgacggcaacagcuggcuuaccaucggcauuagugggccugauaaugaggcaguggccguacugaaguauaacggaaucaucacugacacaauuaagucuuggaggaaaaauauauugcggacccaggaguccgaaugcgcuuguguuaacgguagcugcuuuacggugaugacugauggcccaucgaacgggcaggccucuuacaagaucuucaaaauggagaagggaaaagucgugaaguccguggaacucgacgcgcccaauuaucacuacgaggaguguucaugcuauccugaugcaggcgaaauuaccugugucugccgcgacaacuggcaugguaguaauagaccauggguuagcuuuaaccagaaucuggaguaccaaaucggguauauaugcuccggaguguucggcgauaacccgaggcccaaugacggcacagggucuuguggaccuaugagcccaaacggugccuacggcguaaagggguuuucauucaaauacggaaauggcguguggauuggucggacuaagaguaccaacucccgcagcggguuugaaaugaucugggaucccaauggcuggacaggaaccgacucuucauucagugucaaacaggacaucguggcuauuacggauuggagcggcuauuccgggucuuuuguucagcacccugagcugacuggacucgacugcauccgaccauguuucuggguggaauuaauuagagguaggcccaaggagucgacaauauggaccagcggcuccucaaucaguuucugcggggucaacucugauacugugagcugguccuggccggacggagccgagcugccuuuuacaauugauaaauga

SEQ ID NO: 137627 - RNA, 1350 nt, Artificial Sequence
  derived and/or modified sequence opt3 from neuraminidase__InfluenzaA__ABL31757
augaaccccaaucagaagaucauuaccauaggcagcaucugcauggugauugggaucgucucccugaugcuccaaauuggaaacaugaucucuauauggguuucacacaguauccagacagguaaucagcaucaggccgagagcauuuccaacacuaauccucuuacggaaaaagcuguggcaucuguaacccuggccggcaacucgucauuguguccaaucagagggugggcggugcacagcaaggacaauaacauuaggaucggaaguaaaggcgaugucuucgugauacgggagccguuuauuuccugcucucauuuagaaugucgcacauucuuucugacucaaggugcucuacucaaugacaagcacagcaacgggaccguuaaagaucgaucaccccaucguacacugauguccugcccugugggagaggccccaagucccuacaauagcagauucgaaucugucgcaugguccgccucagcuugucacgacggcaccagcuggcuuacuaucggcauuagugggccugauaacgaggcaguggccguacugaaguauaauggaaucaucacagacaccauuaagucuuggaggaacaauauauugcggacgcaggaguccgaaugcgcuuguguuaacgguagcugcuuuacugugaugaccgauggcccaucgaacgggcaggccucuuacaaaaucuucaagauggagaaaggaaaggucgugaaauccguggaacucgacgcgcccaauuaucacuacgaggaguguucaugcuauccugaugcaggcgaaauuacaugugucugccgcgacaacuggcaugguaguaauagaccauggguuagcuuuaaccagaaucuggaguaccaaaucggguauauaugcuccggaguguucggcgauaacccgaggcccaaugacggcacugggucuuguggaccuaugagcccaaacggugccuacggcguaaagggguuuucauucaaguacggaaauggcguguggauuggucggaccaaaaguacaaacucccgcagcggguuugaaaugaucugggaucccaauggcuggaccggaacggacucuucauucagugucaagcaggacaucguggcuauuacugauuggagcggcuauuccgggucuuuuguucagcacccugagcugacaggacucgacugcauccgaccauguuucuggguggaauuaauuagagguaggcccaaagagucgaccauauggacuagcggcuccucaaucaguuucugcggggucaacucugauacagugagcugguccuggccggacggagccgagcugccuuuuaccauugauaaguga

SEQ ID NO: 137628 - RNA, 1350 nt, Artificial Sequence; identical to SEQ ID NO: 137627
  derived and/or modified sequence opt3 from neuraminidase__InfluenzaA__ABL31768

SEQ ID NO: 137629 - RNA, 1410 nt, Artificial Sequence; identical to SEQ ID NO: 136607
  derived and/or modified sequence opt3 from neuraminidase__InfluenzaA__ABL67168

SEQ ID NO: 137630 - RNA, 1410 nt, Artificial Sequence; identical to SEQ ID NO: 136746
  derived and/or modified sequence opt3 from neuraminidase__InfluenzaA__ABL67179

SEQ ID NO: 137631 - RNA, 1413 nt, Artificial Sequence; identical to SEQ ID NO: 137572
  derived and/or modified sequence opt3 from neuraminidase__InfluenzaA__ABL67190

SEQ ID NO: 137632 - RNA, 1410 nt, Artificial Sequence
  derived and/or modified sequence opt3 from neuraminidase__InfluenzaA__ABL67201
augaaccccaaucagaagaucauuaccauaagcuccgugucucugacaaucucaacuauuugcuucuuuaugcaaaucgccauucucaucacgaccgucacacuucacuucaaacaguacgaguuuaacaguccuccaaauaaccagguuaugcugugugaaccgacuauaaucgagagaaauauuaccgaaaucguguauuugacaaacaccacuauugagaaggaaaucugccccaaauuagcugaguacaggaauuggagcaagccucagugugacauaacaggcuucgcaccauuuuccaaagauaacucuauucggcugucggccgggggagacaucuggguaacccgcgagcccuaugugucaugcgauccugacaaguguuaccaauucgcgcuaggucagggcacgacucucaauaacguccauagcaaugauaccgugcacgaccgaacaccauaucguacucugcuuaugaacgaacuggggguucccuuucauuugggaaccaaacaggugugcauugcuuggaguuccucuagcugucacgauggcaaggccuggcuccaugucugcgugacaggugacgauaagaaugcaaccgccuccuucaucuacaacgggagacugguagacucaaucguuaguuggagcaaaaagauucugaggacgcaggagucugaaugugugugcauaaauggaacuuguacagucgugaugaccgauggcuccgcuucaggcaaagcagacacuaagauccucuuuauugaggaggggaagaucgugcacacaagcaccuuaaguggaucugcccaacacgucgaagagugcuccugcuauccucgguacccagguguucgcugugugugcagagauaacuggaaaggcagcaacaggccgauaguagacauuaauaucaaggacuacucgaucgugucuuccuaugucuguucagggcuggugggagauacgccccggaaaaacgacaguagcuccucuagccauugccuugauccuaauaacgaagagggcggucacgggguuaagggaugggcuuucgacgauggcaaugacguguggaugggccgcaccauuucagaaaaauugcgaaguggguacgagacauuuaaggucaucgagggaugguccaacccaaauagcaaacugcagauuaacagacaggugauaguagauagggguaaucggucuggcuauucagggaucuucaguguugaaggaaagagcuguauuaaccguugcuuuuacguggagcuaauccgcggcagaaaggaagagacugaaguccucuggaccuccaauucuaucguggucuucugugguacaucggggacuuauggcaccggaagcuggcccgacggcgccgauauuaaccugaugccuauauga

SEQ ID NO: 137633 - RNA, 1413 nt, Artificial Sequence; identical to SEQ ID NO: 137572
  derived and/or modified sequence opt3 from neuraminidase__InfluenzaA__ABL67212

SEQ ID NO: 137634 - RNA, 1413 nt, Artificial Sequence; identical to SEQ ID NO: 137075
  derived and/or modified sequence opt3 from neuraminidase__InfluenzaA__ABL67256

SEQ ID NO: 137635 - RNA, 1413 nt, Artificial Sequence; identical to SEQ ID NO: 137075
  derived and/or modified sequence opt3 from neuraminidase__InfluenzaA__ABL67267

SEQ ID NO: 137636 - RNA, 1410 nt, Artificial Sequence; identical to SEQ ID NO: 136077
  derived and/or modified sequence opt3 from neuraminidase__InfluenzaA__ABL67278

SEQ ID NO: 137637 - RNA, 1410 nt, Artificial Sequence
  derived and/or modified sequence opt3 from neuraminidase__InfluenzaA__ABL67289
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguuguaugaaccgacuaucauagagagaaauaucaccgaaauuguauacuuaacaaacaccacuaucgagaaggaaauuugccccaaacuggcagaguauaggaauuggucaaagccucaguguaacaucacaggguucgccccauuuaguaaagacaauagcauacggcuauccgcgggaggugauauuugggugacccgcgagcccuacgucucuugcgacccugauaaguguuaucaauucgcucucggccaggggacgacucugaacaauggacauucgaacgacaccgugcacgaucgaacaccauaccguacucuucugaugaaugaauugggcguucccuuucaucucgguaccagacaggugugcaucgccuggucaagcaguuccugucacgacgggaaggcauggcugcaugucugcgugacaggagaugacgagaacgccaccgcuucuuucauuuauaauggcaggcugguagauagcaucggcuccuggaguaaaaagauccuccggacgcaggaaucagaguguguuugcauuaacgggacuuguacaguggucaugaccgacggaagcgcaucugguaaagccgauacuaagauauuauuuaucgaggaaggcaaaauugugcacaucuccacacugucagggagcgcucaacacguggaggaaugcaguugcuacccucgcuacccaggagucagauguguuugcagggacaacuggaagggcucuaaucggccgauaguggauauuaacguaaaggacuauuccaucgugagcucguacgucuguucuggucuugugggggacacccccaggaaaaaugauuccuucucaaguagccauugcuuggacccuaacaaugaggaaggaggccacggcguuaaggggugggccuuugaugacggaaacgauguguggaugggucgaacgaucuccgagaaacugagaucuggcuaugagaccuucaaggucauugaaggguggagcaaaccaaauucaaagcuacagaucaaccgccaggugauuguagagcggggaaaucguaguggcuacuccgguauauuuagcguugaagggaaaucuuguaucaaccgcugcuucuauguggagcucauuagaggcaggaaggaagagacagaggucugguggacuucaaauaguaucguggucuuuuguggaaccagcggcacauacgggacuggauccuggcccgacggugcggauaucaaccugaugccuauuuga

SEQ ID NO: 137638 - RNA, 1410 nt, Artificial Sequence
  derived and/or modified sequence opt3 from neuraminidase__InfluenzaA__ABL67300
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaacauccuccggacgcaggaaucagagugcguuuguauuaacgggacuugcacaguggucaugaccgacggaagcgcaucugguaaggccgauacuaaaauauuauuuaucgaggaaggcaagauugugcacaucuccacacugucagggagcgcucaacacguggaggaaugcaguuguuauccucgcuacccaggagucagaugcguuuguagggacaauuggaaaggcucuaaccggccgauaguggauauuaauguaaaggaccauuccaucgugagcucguacgucugcucuggucuugugggggacacccccaggaagaacgauuccuucucaaguagccacuguuuggacccuaauaacgaggaaggaggccauggcguuaaagggugggccuuugaugacggaaaugauguguggaugggucgaacgaucuccgagaagcugagaucuggcuaugagaccuucaaagucauugaaggguggagcaagccaaacucaaaacuacagaucaaucgccaggugauuguagagcggggaaaccguaguggcuacuccgguauauuuagcguugaagggaagucuugcaucaaucgcuguuucuauguggagcucauuagaggcaggaaagaagagacagaggucugguggacuucaaacaguaucguggucuuuugcggaaccagcggcacauacgggacuggauccuggcccgacggugcggauaucaaucugaugccuauuuga

SEQ ID NO: 137639 - RNA, 1410 nt, Artificial Sequence; identical to SEQ ID NO: 136196
  derived and/or modified sequence opt3 from neuraminidase__InfluenzaA__ABL67311

SEQ ID NO: 137640 - RNA, 1410 nt, Artificial Sequence
  derived and/or modified sequence opt3 from neuraminidase__InfluenzaA__ABL67322
augaaccccaaucagaagaucauuaccauaggcagcgugucccugacaaucgccacuauuugcuuccucaugcagaucgcuauucuugucacgaccguuacacugcacuuuaaacaguacgaguguaacccuccaccgaauaaccaggugauguugugcgaacccacuaucauagagagaaauaucaccgaaauuguauauuuaacaaacaccacuaucgagaaggaaauuuguccuaaacuggcagaguacaggaauuggucuaagccacagugcaacaucacaggguucgcccccuuuucaaaagacaauaguauacggcuaagcgcgggaggugauauuugggugacccgcgagccuuaugucuccugugacccagauaagugcuaccaauucgcucucggccaggggacgacucugaacaauggacauucuaacgacaccgugcacgaucgaacacccuaucguacucuucugaugaaugaauugggcguuccuuuucaucucgguaccagacagguguguaucgccuggucgucaagcaguugccacgacgggaaggcauggcugcaugucugugugacaggagaugacgagaacgccaccgcuuccuucauuuacaauggcaggcugguagauucuaucggcagcugguccaaaaagauccuccggacgcaggaaucagagugcguuuguauuaacgggacuugcacaguggucaugaccgacggaagugcaagcgguaaagccgauacuaagauauuauuuaucgaggaaggcaaaauugugcacacaucuacccuguccgggucagcucaacacguggaggaaugcagcuguuauccacgcuacccgggagucagaugcguuuguagggacaacuggaagggcaguaaucggcccaucguggauauaaacguaaaggacuacucuauuguguccagcuaugucugcucgggucuugugggggacacgccucgcaaaaaugauucuuucuccucaagucauuguuuggacccaaacaaugaggaaggaggccacggcguuaaggggugggccuuugaugacggaaacgauguguggaugggucgaaccaucagcgagaaacugagauccggcuacgagacauucaaggucaucgaaggguggucuaaacccaauagcaagcuacagacuaacaggcaagugauuguagagcggggaaaucguucaggcuauagugguaucuuuuccguugaagggaaaagcugcauuaaccgcuguuucuacguggagcucauaagaggcaggaaggaagagaccgaggucugguggacaucuaauucaaucguggucuuuugcggaaccaguggcacuuaugggacaggaagcuggccugacggugcggauauuaaccugaugccaaucuga

SEQ ID NO: 137641 - RNA, 1410 nt, Artificial Sequence
  derived and/or modified sequence opt3 from neuraminidase__InfluenzaA__ABL67333
augaaccccaaucagaagaucauuaccauaggcagcgugucccugacaaucgccacuauuugcuuccucaugcaaaucgcuauucuugucaucacgguuacccugcacuuuaaacaguacgaguguaacucuccuccaaauaaccaggugauguugugcgaaccgacaauaaucgagagaaauauuacugaaaucguauauuuaaccaacacaaccauugagaaggaaaucugucccaaacuggcagaguacaggaauuggucaaagccucagugcaacauaacuggguucgccccauuuaguaaagacaauagcauucggcuauccgcgggaggugauaucugggugacacgcgagcccuaugucucuugugacccugauaagugcuaccaauucgcucucggccaggggaccacgcugaacaauggacauucgaacgacacugugcacgaucgaaccccauaucguacacuucugaugaaugaauugggcguucccuuucaucucgguacuagacagguguguauugccuggucaagcaguuccugccacgacgggaaggcauggcugcaugucugugugaccggagaugacgagaacgccacagcuucuuucaucuacaauggcaaacugguagauagcaucggcuccuggucaaagaaaauucucaggacccaggaaagugagugcguuuguauaaacgggacgugcgcaguggucaugacugacggaagcgccucugguaaggcugauacaaaaaucuuauuuauugaggaaggcaagaucgugcacauauccacccugucagggagcgcccaacacguggaggaaugcaguuguuauccucgguacccaggaguccgcugcguuuguagagacaacuggaagggcucuaauaggccgauuguggauaucaacguaaaagacuacuccaucgugagcucguaugucugcucuggucuugugggggacacuccccggaagaaugauuccuucucaaguagccauuguuuggacccuaacaaugaggaaggaggccacggcguuaaagggugggcguuugaugacggaaacgauguguggaugggucgcacaauuuccgagaagcugcgaucuggcuacgagaccuucaaagucaucgaaggguggagcaagccaaauucaaaacuacagacgaacagacaggugauuguagagaggggaaaucggaguggcuauuccgguauauuuagcguugaagggaagucuugcaucaaccguuguuucuacguggagcucauucgcggcagaaaggaagagaccgaggucugguggacaucaaauaguaucguggucuuuugcggaacuagcggcaccuaugggacaggauccuggcccgacggugcagauaucaaccugaugccuauuuga

SEQ ID NO: 137642 - RNA, 1410 nt, Artificial Sequence; identical to SEQ ID NO: 136607
  derived and/or modified sequence opt3 from neuraminidase__InfluenzaA__ABL67344

SEQ ID NO: 137643 - RNA, 1410 nt, Artificial Sequence
  derived and/or modified sequence opt3 from neuraminidase__InfluenzaA__ABL67355
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacugguggaguauaggaauuggucaaagccucagugcaacaucacaggguucgcaccauuuaguaaagacaauagcauacggcuauccgccggaggugauauuugggucacccgcgagcccuacgugucuugugacccugaaaagugcuaucaauucgcgcucggccaggggacgacucugaacaauggacacucgaacgauaccguucaugaccgaacaccauaccguacucuucugaugaaugaguugggcgugcccuuucaccucgguaccaagcaggucuguaucgcuuggucaagcaguuccugccaugaugggaaagccuggcugcacguguguguaacaggagacgauaagaacgcaaccgccucuuucauuuauaauggcagacugguugacagcaucggcuccuggaguaaaaagauccucaggacgcaggaaucagagugcguguguauuaacgggacuugcacagucgugaugaccgauggaagcgcuucugguaaagcagacacuaagauauuauuuaucgaggaaggcaagauugugcacaucuccacacugucagggagcgcccaacaugucgaggaaugcaguuguuacccucgguauccaggaguucgcugcguguguagagauaacuggaaaggcucuaauaggccgauaguagacauuaacgugaaggauuacuccaucgucagcucguacgugugcucuggucuuguuggggacacgccccggaaaaaugacuccuucucaaguagccacuguuuggauccuaacaaugaggaaggaggccauggcgugaaggggugggcuuuugacgauggaaacgacgucuggaugggucgcaccaucuccgagaaacugcgaucuggcuaugagaccuucaaggugauugaaggguggagcaaaccaaauucaaagcuacagaucaacagacagguaauuguugagaggggaaaucggaguggcuacuccgguauauuuagcguggaagggaagucuugcaucaaccguuguuucuaugucgagcucauucgcggcagaaaagaagagacagaggugugguggacuucaaauaguaucgucguguuuugcggaaccagcggcacauacgggacuggauccuggcccgauggugccgacaucaaccugaugccuauuuga

SEQ ID NO: 137644 - RNA, 1410 nt, Artificial Sequence
  derived and/or modified sequence opt3 from neuraminidase__InfluenzaA__ABL67366
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacaaaaacgccaccgcuucuuucauuuauaauggcaggcugguagauagcaucggcuccuggucaaagaaaauccuccggacgcaggagagugaaugcguuuguauuaacgggacuugcacaguggucaugaccgacggaagcgcaucugguaaggccgauacucgcauauuauuuaucgaggagggcaaaauugugcacaucuccacacugucagggagcgcucaacauguggaagagugcaguuguuacccuagauauccaggagucaggugcguuugucgggacaacuggaagggcucuaaucgcccgauaguggauauuaacguaaaggacuacuccaucgugagcucguacgucugcucuggucuugugggggacacgccccggaaaaaugauuccuucucaaguagccacuguuuggacccuaacaaugaagagggaggccauggcguuaaggggugggccuuugaugacggaaacgauguguggauggguagaaccaucuccgaaaaacugaggucuggcuaugagaccuucaaggucauugagggguggagcaaaccaaauucaaagcuacagaucaaccgacaggugauuguagaacguggaaaucgcaguggcuacuccgguauauuuagcguugaggggaaaucuugcaucaacagauguuucuauguggaacucauuaggggccggaaggaggaaacagaggucugguggacuucaaauaguaucguggucuuuugcggaaccagcggcacauacgggacuggauccuggcccgacggugcggauaucaaccugaugccuauuuga

SEQ ID NO: 137645 - RNA, 1410 nt, Artificial Sequence
  derived and/or modified sequence opt3 from neuraminidase__InfluenzaA__ABL67377
augaaccccaaucagaagaucauuaccauaggcagcgccucccugacaaucgcuauuaucugcuuccucauucagaucgcaauacuugugacuacggucacccugcacuuuaaacagcaugaguguaacucuccuccaaauaaccagguuauguugugcgaaccgacaaucauugagagaaauaucacugaaauuguguacuuaaccaacacaaccaucgagaaggaaauaugucccaaacuggccgaguauaggaauuggucaaagccucagugcaacauuacuggguucgcgccauuuaguaaagacaauagcauccggcuauccgcuggaggugauauuuggguaacacgcgagcccuacgugucuugugacccugauaagugcuaucaauucgcccucggccaggggaccacgcugaacaauggacacucgaacgacacuguccaugaucgaaccccauaccguacacuucugaugaaugaauugggcgugcccuuucaccucgguacuagacagguuuguaucgcauggucaagcaguuccugccaugacgggaaggccuggcugcacgugugugucaccggagaugacaaaaacgcuacagcaucuuucaucuauaauggcaggcugguggauagcauuuccucauggaguaagaaaauacuccggacccaggagagcgaaugcguauguaucaacggcacgugcacuguugugaugacagacgggucugccuccggaaaggcugauaccaaaauuuuauuuaucgaggaggguaagauaauucacaucucaacucugagcggcagugcccaacaugucgaagagugcucuuguuacccucgcuauccaggggugagaugcguguguagggacaacuggaagggauccaaucggccgaucgucgauauuaacguuaaagacuacagcaucgugucgucuuacguaugcuccggccuugugggugacacaccccgcaagaaugauucauucaguagcucccacuguuuggacccuaacaaugaagaagggggacauggcgucaaaggcugggcguuugaugacgggaacgauguguggaugggacgaaccauuucugagaagcugagaagcgguuaugagacguucaaaguuauagagggcuggucaaauccaaacaguaagcuacagaucaauaggcaagugauugucgaacgggggaaccguuccggauacagcggcaucuuuucuguggaggguaaaucaugcaucaaucgcuguuucuauguagaacucauuagagggaggaaggaggaaaccgagguuugguggacaaguaacagcauaguggucuuuugcggcacuuccggaaccuacggcacagggucuuggcccgacggagcagaucugaaucuuaugccuaucuga

SEQ ID NO: 137646 - RNA, 1410 nt, Artificial Sequence; identical to SEQ ID NO: 136343
  derived and/or modified sequence opt3 from neuraminidase__InfluenzaA__ABL67388

SEQ ID NO: 137647 - RNA, 1410 nt, Artificial Sequence; identical to SEQ ID NO: 136343
  derived and/or modified sequence opt3 from neuraminidase__InfluenzaA__ABL67399

SEQ ID NO: 137648 - RNA, 1410 nt, Artificial Sequence; identical to SEQ ID NO: 136728
  derived and/or modified sequence opt3 from neuraminidase__InfluenzaA__ABL67410

SEQ ID NO: 137649 - RNA, 1410 nt, Artificial Sequence
  derived and/or modified sequence opt3 from neuraminidase__InfluenzaA__ABL67421
augaaccccaaucagaagaucauuaccauaggcagcaucucccugacaauuucuacuaucugcuucuuuaugcaaauugccauccucauaacgaccgugacacuucacuucaaacaguacgaguuuaacucaccuccaaauaaccaggucaugcugugugaaccgacuaucauugagagaaauaucaccgaaauuguuuauuugacaaacaccacuaucgagaaggaaauaugccccaaauuagcugaguacaggaauuggaguaagccucaguguaacauuacaggguucgcaccauuuagcaaagacaauuccauccggcugucugccggaggugauauuugggugacccgcgagcccuauguaucgugcgacccugauaaguguuaccaauucgcgcuaggccaggggacgacucucaacaaugugcauucaaacgacaccguccacgaucgaacaccauaucguacucugcuuaugaaugaacugggagugcccuuucauuugggcaccaagcagguuugcaucgcuuggagcaguuccucuugucacgacgguaaagccuggcuccaugugugcgucacaggggaugacaagaacgcaaccgccagcuucaucuacaauggaagacugguggauuccauuguaucauggaguaaagagauacugaggacgcaggaaagcgaguguguuugcaucaacggcacuuguacaguggucaugaccgacggcucugcuuccgggaaggcagauacuaaaauucucuuuaucgaggaaggaaagauagugcacacaucaaccuuaagcgguagugcccaacacguggaggaaugcucuugcuauccucgguacccaggcguccgcuguguuugcagagacaacuggaagggguccaauaggccgauuguggauaucaacaucaaagacuacagcauuguaucgucuuauguguguuccggacuggucggcgacacgccccggaagaaugauucaaguagcuccucucauugccuugacccuaacaaugaggaaggugggcacggagugaaaggcugggcuuucgaugacggcaacgauguuuggauggggcgcaccaucagcgagaaguugcgaucaggauacgagacauuuaaagugauugaagguuggaguaauccaaacuccaagcugcagauaaauagacaggucaucguggacaggggcaaccggagcggguauucuggaauuuucucaguagagggcaaaaguuguaucaaucguugcuuuuacguugaacuaauccgcgguagaaaggaggaaacugaggugcucuggaccagcaacuccauugucguguucugugggacaucuggcacuuauggaaccggcucguggcccgauggggccgacauaaaucugaugccuaucuga

SEQ ID NO: 137650 - RNA, 1350 nt, Artificial Sequence
  derived and/or modified sequence opt3 from neuraminidase__InfluenzaA__ABL67772
augaaccccaauaagaaaaucauuaccauaggcagcaucugcauggugacagggauggucucccugaugcuccagauuggaaaccuuaucucuauuuggguuucacacaguauccauacugguaaucaacacaaggccgagccuauaagcaacacgaauuuccugaccgaaaaagcuguggcauccguaaaguuggccggcaacucuucguuauguccaaucaaugggugggcgguguacucaaaagacaacagcauuagaaucggaaguaagggcgaugucuuugugauuagggagccguucaucuccugcucucaucuggaaugucggacauuuuuccuaacucagggugcucuccugaaugacaagcacagcaacgggaccguuaaagaucgcucaccccaucgaacacuuauguccugcccugugggagaggccccaagucccuauaauagccguuuugaaucugucgcaugguccgccucagcuugucacgacggcaccagcuggcugacuauaggcauuagugggccugauaacggagcaguggccguauugaaguacaaugguaucauuacagacaccaucaaaucuuggagaaacaauauccucaggacgcaggaguccgagugcgcuuguguuaacggcagcugcuucacugugaugaccgaugggccaucgaacggacaggccucucacaagauuuuuaaaauggaaaagggcaaggucgugaaauccguggagcuggacgcgcccaauuaucauuacgaagaguguucaugcuauccugaugccggugagauaacaugugucugccgggacaacuggcacgggaguaaucgcccauggguuagcuucaaccaaaaucugaaguaccagaucggauauauuugcuccggcguguuuggcgauaacccgagacccaaugacgggacuggaucuugugguccuguaagcucaaacggcgcauacggggugaaaggauucaguuuuaaguacggcaauggugucuggaucgggaggaccaaauccacaaacagccggucuggcuucgaaaugauaugggauccaaauggauggaccgagacggacucaaguuuuagcgugaagcaggacauuguugcuaucacugauugguccggcuauucugggucguucgugcagcaucccgaacucacaggauuagacugcauccgcccuuguuucugggucgagcugauucgagguagaccaaaagaaagcaccaucuggacuuccggcucaaguauuucuuuuugcggggugaacagcgauacaguaggaugguccuggcccgacggcgccgagcuuccguucaccauagauaaguga

SEQ ID NO: 137651 - RNA, 1350 nt, Artificial Sequence
  derived and/or modified sequence opt3 from neuraminidase__InfluenzaA__ABL67783
augaaccccaauaagaaaaucauuaccauaggcagcaucugcauggugacagggauggucucccugaugcuccagauuggaaaccuuaucucuauuuggguuucacacaguauccauacugguaaucaacacaaggccgagccuauaagcaacacgaauuuccugaccgaaaaagcuguggcauccguaaaguuggccggcaacucuucguuauguccaaucaaugggugggcgguguacucaaaagacaacagcauuagaaucggaaguaagggcgaugucuuugugauuagggagccguucaucuccugcucucaucuggaaugucggacauuuuuccuaacucagggugcucuccugaaugacaagcacagcaacgggaccguuaaagaucgcucaccccaucgaacacuuauguccugcccugugggagaggccccaagucccuauaauagccguuuugaaucugucgcaugguccgccucagcuugucacgacggcaccagcuggcugacuauaggcauuagugggccugauucuggagcaguggccguauugaaguacaacgguaucauuacagacaccaucaaauccuggagaaauaacauccucaggacgcaggagagcgagugcgcuuguguuaauggcucgugcuucacugugaugaccgaugggccaucuaacggacaggccucccacaagauuuuuaaaauggaaaagggcaaggucgugaaaucaguggagcuggacgcgcccaacuaucauuacgaagaguguaguugcuauccugaugccggugagauaacaugugucugccgggacaauuggcacgggagcaaccgcccauggguuuccuucaaucaaaaccuggaauaccagaucggauauauuugcucuggcguguuuggcgauaauccgagacccaacgacgggacuggaagcugugguccuguaucaaguaauggcgcauacggggugaagggauucuccuuuaaauacggcaacggugucuggaucgggaggaccaagagcacaaauucucggucaggcuucgagaugauaugggauccaaacggauggaccgaaacggacaguagcuuuuccgugaaacaggacauuguugcuaucacugauuggucuggcuauucggggagcuucgugcagcaucccgagcucacaggauuagacugcauccgcccuuguuucugggucgaacugauucgagguagaccaaaggaguccaccaucuggacuucaggcaguucuauuagcuuuugcgggguaaauuccgauacagugggauggucauggcccgacggcgccgagcuuccguucaccauagauaaauga

SEQ ID NO: 137652 - RNA, 1350 nt, Artificial Sequence
  derived and/or modified sequence opt3 from neuraminidase__InfluenzaA__ABL67796
augaaccccaauaagaaaaucauuaccauaggcagcaucugcauggugacagggauggucucccugaugcuccagauuggaaaccuuaucucuauuuggguuucacacaguauccauacugguaaucaacacaaggccgagccuauaagcaacacgaauuuccugaccgaaaaagcuguggcauccguaaaguuggccggcaacucuucguuauguccaaucaaugggugggcgguguacucaaaagacaacagcauuagaaucggaaguaagggcgaugucuuugugauuagggagccguucaucuccugcucucaucuggaaugucggacauuuuuccuaacucagggugcucuccugaaugacaagcacagcaacgggaccguuaaagaucgcucaccccaucgaacacuuauguccugcccugugggagaggccccaagucccuauaauagccguuuugaaucugucgcaugguccgccucagcuugucacgacggcaccagcuggcugacuauaggcauuagugggccugauaacggagcaguggccguauugaaguacaaugguaucauuacagacaccaucaaaucuuggagaaacaauauccucaggacgcaggaguccgagugcgcuuguguuaacggcagcugcuucacugugaugaccgaugggccaucgaacggacaggccucucacaagauuuuuaaaauggaaaagggcaaggucgugaaauccguggagcuggacgcgcccaauuaucauuacgaagaguguucaugcuauccugaugccggugagauaacaugugucugccgggacaacuggcacgggaguaaucgcccauggguuagcuucaaccaaaaucuggaauaccagaucggauauauuugcuccggcguguuuggcgauaacccgagacccaaugacgggacuggaucuugugguccuguaagcuacaacggcgcauacggggugaagggauucucauuuaaauauggcaauggugucuggaucgggaggaccaagaguacaaacucccggagcggcuucgagaugauaugggauccaaauggauggaccgaaacggacucuucauuuagugugaaacaggacauuguugcuaucacugauuggagcggcuacuccgggucuuucgugcagcaucccgagcucacaggauuagacugcauccgcccuuguuucugggucgaacugauucgagguagaccaaaggagucgaccaucuggacuagcggcuccucaauuaguuuuugcggggugaacucugauacaguaggauggagcuggcccgacggcgccgagcuuccguucaccauagauaaauga

SEQ ID NO: 137653 - RNA, 1350 nt, Artificial Sequence
  derived and/or modified sequence opt3 from neuraminidase__InfluenzaA__ABL67807
augaaccccaauaagaaaaucauuaccauaggcagcaucugcauggugacagggauggucucccugaugcuccagauuggaaaccuuaucucuauuuggguuucacacaguauccauacugguaaucaacacaaggccgagccuauaagcaacacgaaucuguugaccgaaaaagcuguggcauccguaaaguuagccggcaacucuucgcuguguccaaucgacgggugggcgguguacucaaaagauaauagcauuagaaucggaaguaagggcgacgucuucgugguuagggagccguuuauuuccugcucucaucuagaaugucggacauucuuucucacucagggugcucugcuuaacgauaagcacagcaaugggaccgugaaagaccgcucaccccaucgaacacugauguccugcccugucggagaggccccaagucccuauaacagccguuucgaaucuguggcaugguccgccucagcuugucacgauggcaccagcugguugacuaucggcauaagugggccugacaauggagcaguagccguucucaaguacaacgguauuaucacagauaccauuaaaucuuggagaaauaacauccugaggacgcaggaguccgagugcgcuugugugaauggcagcugcuuuacugucaugaccgacgggccaucgaacggacaggccucucacaagaucuucaaaauggaaaagggcaagguggugaaauccgucgagcuggaugcgcccaacuaucauuacgaagaguguucaugcuauccugacgccggugagauuacauguguuugccgggauaauuggcacgggaguaaccgcccaugggugagcuuuaaucaaaaccucgaauaccagauaggauauaucugcuccggcguauucggcgacaauccgagacccaacgauggggcaggaucuugugguccugugagcucaaauggcgcuuacggggucaagggauuuaguuucaaauacggcaacgguguguggauugggaggacuaaguccaccaauagccggucuggcuuugagaugaucugggacccaaacggauggacagaaaccgacucaaguuucagcguuaaacaggauauaguggccauuacggacugguccggcuauucugggucguuuguccagcaucccgaguuaacuggacuggauugcauccgcccuuguuucuggguggaacuuauccgagguagaccaaaggagagcacaauuuggaccuccggcucaaguaucucuuucugcgggguaaauagcgacacuguuggaugguccuggcccgauggcgcagaguugccguuuacaauugacaaauga

SEQ ID NO: 137654 - RNA, 1350 nt, Artificial Sequence
  derived and/or modified sequence opt3 from neuraminidase__InfluenzaA__ABL67818
augaaccccaauaagaaaaucauuaccauaggcagcaucugcauggugacagggauggucucccugaugcuccagauuggaaaccuuaucucuauuuggguuucacacaguauccauacugguaaucaacacaaggccgagccuauaagcaacacgaaucuguugaccgaaaaagcuguggcauccguaaaguuagccggcaacucuucgcuguguccaaucgacgggugggcgguguacucaaaagauaauagcauuagaaucggaaguaagggcgacgucuucgugguuagggagccguuuauuuccugcucucaucuagaaugucggacauucuuucucacucagggugcucugcuuaacgauaagcacagcaaugggaccgugaaagaccgcucaccccaucgaacacugauguccugcccugucggagaggccccaagucccuauaacagccguuucgaaucuguggcaugguccgccucagcuugucacgauggcaccagcugguugacuaucggcauaagugggccugacaauggagcaguagccguucucaaguacaacgguauuaucacagauaccauuaaaucuuggagaaauaacauccugaggacgcaggaguccgagugcgcuugugugaauggcuauugcuuuacugucaugaccgacgggccaagcaacggacaggccucgcacaagaucuucaaaauggaaaagggcaagguggugaaaucugucgagcuggaugcgcccaacuaccauuaugaagaguguuccugcuacccugacgccggugagauuacauguguuugccgggauaauuggcacgggucaaaccgcccaugggugaguuuuaaucaaaaccucgaauaucagauaggauacaucugcagcggcguauucggcgacaauccgagacccaacgauggggcaggauccugugguccugugucuagcaauggcgcuuacggggucaagggauuuucauucaaauauggcaacgguguguggauugggaggacuaagaguaccaauucccggagcggcuuugagaugaucugggacccaaacggauggacagaaaccgacucuucauucaguguuaaacaggauauaguggccauuacggacuggagcggcuacuccgggucuuuuguccagcaucccgaguuaacuggacuggauugcauccgcccuuguuucuggguggaacuuauccgagguagaccaaaggagucgacaauuuggaccagcggcuccucaaucaguuucugcgggguaaauucugacacuguuggauggagcuggcccgauggcgcagaguugccguuuacaauugacaaauga

SEQ ID NO: 137655 - RNA, 1350 nt, Artificial Sequence
  derived and/or modified sequence opt3 from neuraminidase__InfluenzaA__ABL67829
augaaccccaauaagaaaaucauuaccauaggcagcaucugcauggugacagggauggucucccugaugcuccagauuggaaaccuuaucucuauuuggguuucacacaguauccauacugguaaucaacacaaggccgagccuauaagcaacacgaaucuguugaccgaaaaagcuguggcauccguaaaguuagccggcaacucuucgcuguguccaaucaaugggugggcgguguacucaaaagacaacagcauuagaaucggaaguaagggcgaugucuucgugguuagggagccguuuauuuccugcucucaucuagaaugucggacauucuuucucacucagggugcucugcuuaaugacaagcacagcaacgggaccgugaaagaucgcucaccccaucgaacacugauguccugcccugucggagaggccccaagucccuauaauagccguuucgaaucuguggcaugguccgccucagcuugucacgacggcaccagcugguugacuaucggcauaagugggccugauaacggagcaguagccguucucaaguacaaugguauuaucacagacaccauuaaaucuuggagaaacaauauccugaggacgcaggaguccgagugcgcuugugugaacggcuuuugcuucacugucaugaccgaugggccaagcaacggacaggccucgcacaagaucuuuaaaauggaaaagggcaagguggugaaaucugucgagcuggacgcgcccaauuaucauuacgaagaguguuccugcuauccugaugccggugagauuacauguguuugccgggacaacuggcacgggucaaaucgcccaugggugaguuucaaccaaaaucucgaauaccagauaggauauaucugcagcggcguauuuggcgauaacccgagacccaaugacggggcaggauccugugguccuguggcuucuaacggcgccuacggggucaagggauucagcuuuaaauacggcaaugguguguggauugggaggacuaagucaaccaacagucgguccggcuucgagaugaucugggauccaaauggauggacagaaaccgacagcucuuuuucaguuaaacaggacauaguggcaauuacggauuggaguggcuauagcggguccuucguccagcaucccgaguuaacuggacuggacugcauccgcccuuguuucuggguggaacuuauccgagguagaccaaaggagucuacaauuuggaccucgggcagcuccaucucauuuugcgggguaaacagugauacuguuggauggucuuggcccgacggcgcugaguugccguucacaauugauaaauga

SEQ ID NO: 137656 - RNA, 1410 nt, Artificial Sequence; identical to SEQ ID NO: 136728
  derived and/or modified sequence opt3 from neuraminidase__InfluenzaA__ABM22018

SEQ ID NO: 137657 - RNA, 1413 nt, Artificial Sequence; identical to SEQ ID NO: 137572
  derived and/or modified sequence opt3 from neuraminidase__InfluenzaA__ABM22029

SEQ ID NO: 137658 - RNA, 1410 nt, Artificial Sequence; identical to SEQ ID NO: 136730
  derived and/or modified sequence opt3 from neuraminidase__InfluenzaA__ABM22040

SEQ ID NO: 137659 - RNA, 1410 nt, Artificial Sequence; identical to SEQ ID NO: 137637
  derived and/or modified sequence opt3 from neuraminidase__InfluenzaA__ABM22062

SEQ ID NO: 137660 - RNA, 1410 nt, Artificial Sequence
  derived and/or modified sequence opt3 from neuraminidase__InfluenzaA__ABM22073
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuuaaccucgguaccagacagguguguaucgccuggucaagcaguuccugccaugacgggaaggcauggcugcacgucugugugacaggagaugacgagaaugccaccgcuucuuucauuuacaacggcaaacugguagauagcaucggcuccuggucaaagaaaauccucaggacgcaggaaagugagugcguuuguauuaacgggacuugcgcaguggucaugacagacggaagcgccucugguaaggcugauaccaaaauauuauuuaucgaggaaggcaagauugugcauaucuccacucugucagggagcgcccaacacguggaggaaugcaguuguuauccucgguacccaggaguccgcugcguuuguagagacaauuggaagggcucuaacaggccgauaguggauauuaauguaaaagacuacuccaucgugagcucguaugucugcucuggucuugugggggacacaccccggaagaacgauuccuucucaaguagccacuguuuggacccuaauaacgaggaaggaggccauggcguuaaagggugggcguuugaugacggaaaugauguguggaugggucgcaccaucuccgagaagcugcgaucuggcuacgagacguucaaagucauugaaggguggagcaagccaaacucaaaacuacagaccaauagacaggugaucguagagaggggaaaccggaguggcuauuccgguauuuuuagcguugaagggaagucuugcauaaaucguuguuucuacguggagcucauccgcggcagaaaggaagagacagaggucugguggacuucaaacaguauuguggucuuuugcggaaccagcggcacauaugggacuggauccuggcccgacggugcagauaucaaucugaugccuaucuga

SEQ ID NO: 137661 - RNA, 1410 nt, Artificial Sequence; identical to SEQ ID NO: 136607
  derived and/or modified sequence opt3 from neuraminidase__InfluenzaA__ABM22084

SEQ ID NO: 137662 - RNA, 1410 nt, Artificial Sequence
  derived and/or modified sequence opt3 from neuraminidase__InfluenzaA__ABM22095
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggcaauguugugcgaaccgacuaucauagagagaaauaucaccgaaauugugcacuuaacaaacaccacuaucgagaaggaaauuugucccaaacugguagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcacgucugugugacaggagaugacaaaaacgccaccgcuucuuucauuuacaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauugugcauaucuccacacugucagggagcgcucaacacguggaagagugcaguuguuauccucgcuacccaggagucagaugcguuuguagggacaacuggaagggcucuaaucggccgauaguggauauuaacguaaaagacuauuccaucgugagcucguacgucugcucuggucuugugggggacacccccaggaagaaugauuccuucucaaguagccauuguuuggacccuaacaaugaagagggaggccacggcguuaaagggugggccuuugaugacggaaacgauguguggaugggucgaacgaucuccgaaaagcugagaucuggcuacgagaccuucaaagucauugagggguggagcaagccaaauucaaaacuacagaucaaccgccaggugauuguagaacggggaaaucguaguggcuauuccgguauauuuagcguugaggggaagucuugcaucaaccgcuguuucuacguggaacucauuagaggcaggaaggaggaaacagaggucugguggacuucaaauaguaucguggucuuuugcggaaccagcggcacauaugggacuggauccuggcccgacggugcggauaucaaccugaugccuauuuga

SEQ ID NO: 137663 - RNA, 1410 nt, Artificial Sequence; identical to SEQ ID NO: 136607
  derived and/or modified sequence opt3 from neuraminidase__InfluenzaA__ABM22106

SEQ ID NO: 137664 - RNA, 1410 nt, Artificial Sequence; identical to SEQ ID NO: 136607
  derived and/or modified sequence opt3 from neuraminidase__InfluenzaA__ABM22117

SEQ ID NO: 137665 - RNA, 1410 nt, Artificial Sequence; identical to SEQ ID NO: 137618
  derived and/or modified sequence opt3 from neuraminidase__InfluenzaA__ABM22128

SEQ ID NO: 137666 - RNA, 1410 nt, Artificial Sequence
  derived and/or modified sequence opt3 from neuraminidase__InfluenzaA__ABM22139
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgagaaggcagauacuaaaauccucuuuauugaagaggggaagaucgugcacacaucaaccuuaagcggaagugcccaacacgucgaagagugcucuugcuauccucgguacccagguguucgcugugugugcagagacaacuggaagggcuccaauaggccgauaguagauauuaacaucaaagacuacagcaucgugucgucuuaugucuguuccgggcuggugggagacacgccccggaagaaugauucaaguagcuccucucauugccuugacccuaacaaugaagagggcggucacgggguuaaaggaugggcuuucgaugacggcaacgauguguggaugggccgcaccauuagcgagaaguugcgaucaggguacgaaacauuuaaagucaucgagggauggaguaauccaaacuccaagcugcagauuaauagacaggugauaguagacagggguaaccggagcggcuauucugggaucuucucaguugaaggaaaaaguuguauuaaucguugcuuuuacguggagcuaauccgcggcagaaaggaagagacugagguccucuggaccagcaacuccaucguggucuucugugguacaucugggacuuauggcaccggaucguggcccgauggcgccgacauuaaucugaugccuauauga

SEQ ID NO: 137667 - RNA, 1410 nt, Artificial Sequence
  derived and/or modified sequence opt3 from neuraminidase__InfluenzaA__ABM22150
augaaccccaaucagaagaucauuaccauaggcagcgugucccugacaaucucuacuauuugcuucuuuaugcaaaucgccauucucaucacgaccgucacacuucacuucaaacaguacgaguuuaacucacugccuaauaaccagguuauguugugugaaccaacuauaaucgagagaaauauuaccgaaaucguguauuuaacaaacaccacuauugagaaggaaaucugcccggagcuggcugaguacaggaauuggaguaaaccccagugugacauaacaggguucgcaccuuuuagcaaggauaacuccauucggcuaucugccggaggugacaucuggguaacccgcgaaccauaugugucgugcgaucccgacaaauguuaccaauucgcgcucggccaggggacgacucugaauaacguccauucaaaugauaccgugcacgaccgaacaccuuaucguacucuucugaugaacgaguugggaguuccauuucaucucggcaccaaacaggugugcauugcuuggagcaguuccucuugucacgaugguaaggccuggcugcaugucugcgugacaggggacgauaagaaugcaaccgccagcuucaucuacaacggaagacugguagacuccaucguuucauggaguaagaaaauucucaggacgcaggaaagcgagugugugugcauaaauggcacuuguacagucgugaugaccgauggcucugcuuccgggaaggcagacacuaaaaucuuauuuauugaggaaggaaagaucgugcacacaucaacccugagcgguagugcccaacacgucgaggaaugcucuugcuauccccgguacccuggcguucgcugugugugcagagauaacuggaagggguccaacaggccaauaguagacauuaauaucaaagacuacagcaucgugucgucuuaugucuguuccggacuugugggcgauacgccgcggaagaacgacucaaguagcuccucucauugcuuggaucccaauaacgaggaaggugggcacggaguuaaaggcugggcuuucgacgauggcaaugacguguggauggggcgcaccauuagcgagaagcugcgaucaggauacgagacauuuaaagucaucgaagguuggaguaacccuaauuccaagcuacagauuaacagacaggugauaguagauaggggcaaucggagcggguauucuggaaucuucucaguugagggcaaaaguuguauuaaccguugcuuuuacguggaacucauccgcgguagaaaggaggaaacugagguccuguggaccagcaauuccaucguggucuucugugggacaucuggcacuuauggaaccggcucguggccagacggggccgauauuaaccuuaugcccauauga

SEQ ID NO: 137668 - RNA, 1413 nt, Artificial Sequence; identical to SEQ ID NO: 137075
  derived and/or modified sequence opt3 from neuraminidase__InfluenzaA__ABM22161

SEQ ID NO: 137669 - RNA, 1413 nt, Artificial Sequence; identical to SEQ ID NO: 137075
  derived and/or modified sequence opt3 from neuraminidase__InfluenzaA__ABM22172

SEQ ID NO: 137670 - RNA, 1413 nt, Artificial Sequence; identical to SEQ ID NO: 137075
  derived and/or modified sequence opt3 from neuraminidase__InfluenzaA__ABM22183

SEQ ID NO: 137671 - RNA, 1413 nt, Artificial Sequence; identical to SEQ ID NO: 137075
  derived and/or modified sequence opt3 from neuraminidase__InfluenzaA__ABM22194

SEQ ID NO: 137672 - RNA, 1413 nt, Artificial Sequence; identical to SEQ ID NO: 137075
  derived and/or modified sequence opt3 from neuraminidase__InfluenzaA__ABM22205

SEQ ID NO: 137673 - RNA, 1413 nt, Artificial Sequence; identical to SEQ ID NO: 137075
  derived and/or modified sequence opt3 from neuraminidase__InfluenzaA__ABM22216

SEQ ID NO: 137674 - RNA, 1413 nt, Artificial Sequence; identical to SEQ ID NO: 137075
  derived and/or modified sequence opt3 from neuraminidase__InfluenzaA__ABM22227

SEQ ID NO: 137675 - RNA, 1413 nt, Artificial Sequence; identical to SEQ ID NO: 137075
  derived and/or modified sequence opt3 from neuraminidase__InfluenzaA__ABM22238

SEQ ID NO: 137676 - RNA, 1413 nt, Artificial Sequence
  derived and/or modified sequence opt3 from neuraminidase__InfluenzaA__ABM22271
augaaccccaaucagaagaucauuaccauaggcagcaucuccauugugaucgggauuaucucucugauacuccaaaucggaaacauuaucucaauuugggccagucacagcauccagacagguucccagaaucauacuggcauaugcaaccagagaauuaucacguacgaaaauucuaccugggucaaccaaacauauguuaauauuaacaauacuaacgugguagcugggaaagacaagaccucgaugacacuugcaggaaauucaagccuguguccuaucaggggcugggccaucuacaccaaagauaacaguauucggauagguuccaagggggacguguucgucauccgcgagccauuuauuucuugcagccacuuggagugucgaacuuucuuuuuaacacagggagcgcugcuaaaugauaaacauuccaacggcaccgugaaggaccguucaccguauagagcucucaugaguugcccccugggcgaagccccuagcccauacaauucuagguucgaguccguugcauggucagccagcgcuugucacgaugggcuuggauggcugacgaucgguauaaguggccccgacaacggggcaguggccgucuugaaguauaacggaauuaucacugaaaccaucaaaucuuggaagaaacggauucuccgcacacaggaguccgagugcguguguaugaauggcagcugcuuuacuaucaugaccgaugguccuucgaacggggcugccucuuacagaauuuucaagauagaaaaaggaaggguaacaaaguccaucgagcugggcgcgccaaauuaucauuacgaagaguguucaugcuaccccgacaccggcacgguuaugugugugugccgggauaacuggcacgggaguaaucgcccuugggucagcuuuaaccagaaucuggacuaucaaauuggauacaucugcuccgguguguucggcgauaacccacgaccgaaggacggggagggaucuuguaaucccgugacugucgauggcgcagacgguguuaaaggguuuagcuauagauacggcaacggaguguggaucggcaggacaaagucaaaucggcuccguaaaggguucgaaaugauuugggacccuaacggauggaccgauacugacagugauuuuuccaugaagcaggacauaguagccaugacagauuggagcgguuauucuggcucauucgugcagcacccagaguuaaccgggcuggacugcaugcgccccuguuuuugggucgaacuugugagaggauugccuagggagaauacgaccaucuggacaaguggcagcuccauuucuuucugcgguguuaacucggauacugcuaauuggagcuggccagacggggccgaacugcccuucaccaucgauaaauga

SEQ ID NO: 137677 - RNA, 1413 nt, Artificial Sequence; identical to SEQ ID NO: 136984
  derived and/or modified sequence opt3 from neuraminidase__InfluenzaA__ABM22282

SEQ ID NO: 137678 - RNA, 1410 nt, Artificial Sequence; identical to SEQ ID NO: 136359
  derived and/or modified sequence opt3 from neuraminidase__InfluenzaA__ABM22304

SEQ ID NO: 137679 - RNA, 1410 nt, Artificial Sequence; identical to SEQ ID NO: 136359
  derived and/or modified sequence opt3 from neuraminidase__InfluenzaA__ABM22315

SEQ ID NO: 137680 - RNA, 1410 nt, Artificial Sequence; identical to SEQ ID NO: 136359
  derived and/or modified sequence opt3 from neuraminidase__InfluenzaA__ABM22326

SEQ ID NO: 137681 - RNA, 1410 nt, Artificial Sequence; identical to SEQ ID NO: 136359
  derived and/or modified sequence opt3 from neuraminidase__InfluenzaA__ABM22337

SEQ ID NO: 137682 - RNA, 1410 nt, Artificial Sequence; identical to SEQ ID NO: 136362
  derived and/or modified sequence opt3 from neuraminidase__InfluenzaA__ABM22348

SEQ ID NO: 137683 - RNA, 1410 nt, Artificial Sequence; identical to SEQ ID NO: 136362
  derived and/or modified sequence opt3 from neuraminidase__InfluenzaA__ABM22359

SEQ ID NO: 137684 - RNA, 1410 nt, Artificial Sequence; identical to SEQ ID NO: 136362
  derived and/or modified sequence opt3 from neuraminidase__InfluenzaA__ABM22370

SEQ ID NO: 137685 - RNA, 1413 nt, Artificial Sequence; identical to SEQ ID NO: 136941
  derived and/or modified sequence opt3 from neuraminidase__InfluenzaA__ABM66867

SEQ ID NO: 137686 - RNA, 1413 nt, Artificial Sequence; identical to SEQ ID NO: 137075
  derived and/or modified sequence opt3 from neuraminidase__InfluenzaA__ABM66900

SEQ ID NO: 137687 - RNA, 1413 nt, Artificial Sequence; identical to SEQ ID NO: 137075
  derived and/or modified sequence opt3 from neuraminidase__InfluenzaA__ABM66911

SEQ ID NO: 137688 - RNA, 1410 nt, Artificial Sequence; identical to SEQ ID NO: 136362
  derived and/or modified sequence opt3 from neuraminidase__InfluenzaA__ABM66922

SEQ ID NO: 137689 - RNA, 1410 nt, Artificial Sequence; identical to SEQ ID NO: 136362
  derived and/or modified sequence opt3 from neuraminidase__InfluenzaA__ABM66933

SEQ ID NO: 137690 - RNA, 1410 nt, Artificial Sequence; identical to SEQ ID NO: 136362
  derived and/or modified sequence opt3 from neuraminidase__InfluenzaA__ABM66944

SEQ ID NO: 137691 - RNA, 1410 nt, Artificial Sequence; identical to SEQ ID NO: 136362
  derived and/or modified sequence opt3 from neuraminidase__InfluenzaA__ABM66955

SEQ ID NO: 137692 - RNA, 1410 nt, Artificial Sequence; identical to SEQ ID NO: 136362
  derived and/or modified sequence opt3 from neuraminidase__InfluenzaA__ABM66966

SEQ ID NO: 137693 - RNA, 1410 nt, Artificial Sequence; identical to SEQ ID NO: 136362
  derived and/or modified sequence opt3 from neuraminidase__InfluenzaA__ABM66977

SEQ ID NO: 137694 - RNA, 1410 nt, Artificial Sequence; identical to SEQ ID NO: 136362
  derived and/or modified sequence opt3 from neuraminidase__InfluenzaA__ABM66988

SEQ ID NO: 137695 - RNA, 1410 nt, Artificial Sequence; identical to SEQ ID NO: 136362
  derived and/or modified sequence opt3 from neuraminidase__InfluenzaA__ABM66999

SEQ ID NO: 137696 - RNA, 1410 nt, Artificial Sequence; identical to SEQ ID NO: 136362
  derived and/or modified sequence opt3 from neuraminidase__InfluenzaA__ABM67010

SEQ ID NO: 137697 - RNA, 1410 nt, Artificial Sequence; identical to SEQ ID NO: 136362
  derived and/or modified sequence opt3 from neuraminidase__InfluenzaA__ABM67021

SEQ ID NO: 137698 - RNA, 1413 nt, Artificial Sequence
  derived and/or modified sequence opt3 from neuraminidase__InfluenzaA__ABM67054
augaaccccaaucagaagaucauuaccauaggcagcaucuccauugccaucgggacaauuucucugaugcuccaaaucggaaacaugauaucaaucugggcuagucacagcauucagacugguucccagaaucauacgggcaucugcaaccagagaauuaucaccuacgagaauagcacaugggugaaccacacuuaugucaauauaaacaauaccaacguuguggcagggaaagacaagacaucgguaacccuugccggaaauucaagccuguguaguauuuccggcugggcgaucuacacuaaagauaacucuauuaggaucgguagcaagggggacguguucgucauccgggaaccuuuuauuuccugcucacauuuggagugucgcacauucuuuuuaacccaaggagcucugcuaaaugauaaacacaguaacggcacggugaaggaccgaagcccauaucgugcccucaugucuugcccgcugggcgaagcacccuccccuuacaauucaaaguucgagagcguugccuggagugcuucugcaugucaugaugggaugggauggcuuacuauagguaucuccggcccagacaacggggccguggcuguccugaaauauaacggaauuaucaccgaaacaauaaagagcuggaaaaagagaauuuugaggacucaggagucggagugcguguguguaaauggcucuugcuuuaccaucaugacagauggucccuccaacggggccgcgucauacaaaaucuucaagauugaaaagggaaaaguuaccaagaguaucgagcucaaugcaccuaacuuucacuaugaagaguguagcugcuacccagacacgggcacugugaugugugucugccgggauaauuggcacggcuccaaccgccccugggugucuuucaaucagaaccuggacuaccagauuggguauauaugcagcggaguguuuggugauaauccuagaccaaaagacggcaaggggucauguaacccggucacaguugauggagccgacggcgugaaagguuucaguuacaaguaugggaauggcguauggaucggaaggaccaaauccaaccggcugcgcaagggcuuugagaugauuugggaccccaauggguggacugauacagacagcgauuucucugugaagcaagacgucguggcuaucaccgauuggucaggauacagugguagcuuuguucagcauccugaacucacgggcuuagacugcauccgaccauguuucuggguggagcuggucagagggcuucccagggaaaacaccacaauuuggacuuccggaucuucgauaucuuucugcggcguggauuccgacaccgccaauuggucauggccugauggugcagaguugccauuuacaaucgacaaauga

SEQ ID NO: 137699 - RNA, 1350 nt, Artificial Sequence
  derived and/or modified sequence opt3 from neuraminidase__InfluenzaA__ABM68048
augaaccccaaucagaagaucauuaccauaggcagcaucugcauggugauugggaucgucucccugaugcuccaaauuggaaacaucauaucuaucuggauuucacacaguauccagacagguaaucagugucaggccggcccuauuagcaacacuaaauuccuuacggagaaggcuguugcauccgugacccuggccgggaauaguucguugugcccaaucucaggaugggcgguauacagcaaagacaacaguauaagaauuggcuccaggggugauguguuugucauccgggaaucuuucauuagcuguucccauuuagagugccgcacauuuuuccugacucaaggggcucuacucaaugacaagcacucaaacggaaccgugaaagaucgaaguccgcaucguacacugaugagcugucccguuggcgaagccccuucuccauauaauuccagauuugagucaguggcauggagcgccagugcuugccacgacggcaccucuuggcuuacuaucgggaucuccggacccgauaacggugcagucgccgugcugaaguacaauggcauuauaacagacaccaucaagagcuggaggaacaauauuuugcggacgcaggaaucggagugugcuugcguaaacgggucuuguuucacuguuaugaccgauggaccuuccaauggccaggccucauauaaaaucuuuaagauggagaaagguaagguggucaaaaguguggaacucgacgcgccaaacuaccauuaugaggaaugcagcuguuaccccgaugcaggggagauaacaugcgugugccgcgacuccuggcacggaucuaacagaccuugggucagcuucaaucagaaccuggaguaucaaauuggcuacaucuguucaggcguuuuuggggauaauccaaggccgaacgacggaacugguaguugcggccccguguccccuaauggggccuacggaguaaagggcuucagcuuuaaguaugguaacgggguguggaucggccggaccaaaucuacaaauucacgcaguggauucgaaaugauuugggauccaaacggcuggaccgggacggacagcuccuuuucugucaagcaggacaucguggcuauuacugauuggucgggauacagcgguuccuucguucagcaccccgagcugacaggccucgacuguauacgaccuugcuucuggguggaauuaaucagagggaggccaaaagagucaaccauuuggacuucuggaucuagcaucuccuuuuguggcgucaauucagauacagugagcuggucuuggcccgacggugccgaacugccguucaccaucgauaaguga

SEQ ID NO: 137700 - RNA, 1350 nt, Artificial Sequence
  derived and/or modified sequence opt3 from neuraminidase__InfluenzaA__ABM68049
augaaccccaaucagaagaucauuaccauaggcagcaucugcauggugauugggaucgucucccugaugcuccaaauuggaaacaucauaucuaucuggauuucacacaguauccagacagguaaucagugucaggccgagccuauuagcaacacuaaauuccuuacggaaaaggcuguugcauccgugacccuggccggcaauucuucguugugcccaaucucagggugggcgguauacagcaaagacaacaguauaagaauuggauccaggggcgauguguuugucauccgggagccguucauuucuuguagccauuuagaaugccgcacauuuuuccugacucaaggugcucuacucaaugacaagcacuccaacgggaccgugaaagaucgaucaccccaucguacacugaugaguuguccuguuggagaggccccaagccccuauaauucuagauuugaauccguggcauggucagccagcgcuugccacgacggcaccaguuggcuuacuaucggcaucucugggccugauaacggagcagucgccgugcugaaguacaaugguauuauaacagacaccaucaaguccuggaggaacaauauuuugcggacgcaggagagcgagugugcuugcguaaacggcucguguuucacuguuaugaccgaugggccaucuuccggacaggccucauauaaaaucuuuaagauggaaaaaggcaagguggucaaaaguguggagcucgacgcgcccaauuaccauuaugaagagugcagcuguuacccugaugccggugagauaacaugcgugugccgcgacuccuggcacgggucuaacagaccaugggucagcuucaaccagaaucuggaauaucaaauuggauacaucuguucaggcguuuuuggcgauaacccgaggcccaaugacgggacuggaaguugcgguccuguguccccaaacggcgcauacgggguaaagggauucagcuuuaaguauggcaaugguguguggaucgggcggaccaaaucuacaaacucacgcaguggcuucgagaugauuugggaucccaauggauggaccggcacggacagcuccuuuucugucaagcaggacaucguggcuauuacugauuggucgggguacagcggauccuucguucagcacccugaacugacaggucucgacuguauacgaccaugcuucuggguggaguuaaucagaggcaggcccaaagaaucaaccauuuggacaagugggucuagcaucuccuuuuguggagucaacucagauacugugagcuggucuuggccggacggcgccgagcugccuuucaccaucgauaaguga

SEQ ID NO: 137701 - RNA, 1350 nt, Artificial Sequence
  derived and/or modified sequence opt3 from neuraminidase__InfluenzaA__ABM90436
augaaccccaaucagaagaucauuaccauaggcagcaucugcauggugauugggaucgucucccugaugcuccaaauuggaaacaugaucucuauauggguuucacacaguauccagaaagguaaucagcaucaggccgagagcauuuccaacacaaauccucuuacugaaaaggcuguggcaucuguaacgcuggccggcaacucgucauuguguccaaucagagggugggcggugcacagcaaagacaauaacauuaggaucggaaguaagggcgaugucuucgugauacgggagccguuuauuuccugcucucauuuagaaugucgcaccuucuuucugacacaaggugcucuacucaaugacaaacacagcaacgggacuguuaaggaucgaucaccccaucguacccugauguccugcccugugggagaggccccaagucccuacaauagcagauucgaaucugucgcaugguccgccucagcuugucacgacggcacaagcuggcuuaccaucggcauuagugggccugauaacgaggcaguggccguacugaaguauaauggaaucaucacugacacaauuaaaucuuggaggaacaauauauugcggacccaggaguccgaaugcgcuuguguuaacgguagcugcuuuacggugaugacugauggcccaucgaacgggcaggccucuuacaagaucuucaaaaugaagaaaggaaaggucgugaaguccguggagcucgacgcgcccaauuaucacuacgaagaguguucaugcuauccugaugcaggcgagauuaccugugucugccgcgacaacuggcaugguaguaauagaccauggguuagcuuuaaccagaaucuggaauaccaaaucggguauauaugcuccggaguguucggcgauaacccgaggcccaaugacggcacagggucuuguggaccuaugagcccaaacggugccuacggcguaaaaggguuuucauucaaguacggaaauggcguguggauuggucggacuaaaaguaccaacucccgcagcggguuugagaugaucugggaucccaauggcuggacaggaaccgacucuucauucagugucaagcaggacaucguggcuauuacggauuggagcggcuauuccgggucuuuuguucagcacccugaacugacuggacucgacugcauccgaccauguuucuggguggaguuaauuagagguaggcccaaagaaucgacaauauggaccagcggcuccucaaucaguuucugcggggucaacucugauacugugagcugguccuggccggacggagccgagcugccuuuuacaauugauaaguga

SEQ ID NO: 137702 - RNA, 1350 nt, Artificial Sequence; identical to SEQ ID NO: 137701
  derived and/or modified sequence opt3 from neuraminidase__InfluenzaA__ABM90447

SEQ ID NO: 137703 - RNA, 1350 nt, Artificial Sequence; identical to SEQ ID NO: 137701
  derived and/or modified sequence opt3 from neuraminidase__InfluenzaA__ABM90458

SEQ ID NO: 137704 - RNA, 1350 nt, Artificial Sequence; identical to SEQ ID NO: 137701
  derived and/or modified sequence opt3 from neuraminidase__InfluenzaA__ABM90469

SEQ ID NO: 137705 - RNA, 1350 nt, Artificial Sequence
  derived and/or modified sequence opt3 from neuraminidase__InfluenzaA__ABM90491
augaaccccaaucagaagaucauuaccauaggcagcaucugcauggugauugggaucgucucccugaugcuccaaauuggaaacaugaucucuauauggguuucacacaguauccagaaagguaaucagcaucaggccgagagcauuuccaacacaaauccucuuacugaaaaggcuguggcaucuguaacgcuggccggcaacucgucauuguguccaaucagagggugggcggugcacagcaaagacaauaacauuaggaucggaaguaagggcgaugucuucgugauacgggagccguuuauuuccugcucucauuuagaaugucgcaccuucuuucugacacaaggugcucuacucaaugacaaacacagcaacgggacuguuaaggaucgaucaccccaucguacccugauguccugcccugugggagaggccccaagucccuacaauagcagauucgaaucugucgcaugguccgccucagcuugucacgacggcacaagcuggcuuaccaucggcauuagugggccugauaacgaggcaguggccguacugaaguauaauggaaucaucacugacacaauuaaaucuuggaggaacaauauauugcggacccaggaguccgaaugcgcuuguguuaacgguagcugcuuuacggugaugacugauggcccaucgaacgggcaggccucuuacaagaucuucaaaaugaagaaaggaaaggucauuaaguccguggagcucgacgcgaccaauuaucacuacgaagaguguucaugcuaucccgaugcaggcgagaucacaugugugugccgcgacaacuggcaugguaguaauagaccuugggucagcuuuaaccagaaucuggaauaccaaauaggguauauuugcuccggaguuuucggcgauaacccaaggccgaaugacggcacugggucuuguggacccaugagcccuaacggugccuacggcgugaaaggguuuucauucaaguacggaaauggcguauggaucggucggaccaaaaguacaaacucccgcagcggguuugagaugaucugggauccaaauggcuggaccggaacggacucuucauucagugugaagcaggacauugucgcuaucacugauuggagcggcuauuccgggucuuuugugcagcaccccgaacugacaggacucgacugcauucgaccuuguuucuggguugaguuaauaagagguaggccaaaagaaucgaccaucuggacuagcggcuccucaauuaguuucugcggggugaacucugauacagucagcugguccuggcccgacggagccgagcugccguuuaccaucgauaaguga

SEQ ID NO: 137706 - RNA, 1350 nt, Artificial Sequence; identical to SEQ ID NO: 137705
  derived and/or modified sequence opt3 from neuraminidase__InfluenzaA__ABM90502

SEQ ID NO: 137707 - RNA, 1350 nt, Artificial Sequence
  derived and/or modified sequence opt3 from neuraminidase__InfluenzaA__ABM90524
augaaccccaaucagaagaucauuaccauaggcagcaucugcauggugauugggaucgucucccugaugcuccaaauuggaaacaugaucucuauauggguuucacacaguauccagacagguaaucagcaucaggccgagagcauuuccaacacuaauccucuuacggaaaaagcugugguaucugugacccuggcaggcaacucgucauuguguccaaucagagggugggccguccacagcaaggacaauaacauuaggaucggaaguaaaggcgauguguucguuauacgggagccguuuauuuccugcucucauuuagaaugucgcacauucuuucugacucaaggugcgcuacucaaugacaagcacagcaacgggaccgugaaagaucgaucaccccaucguacacugauguccugcccugucggagaggcuccaagucccuacaauagcagauucgaaucuguggccugguccgcaucagccugucacgacggcaccagcuggcuuacuaucggcauuagugggccugauaacgaggcuguagcaguucugaaguauaauggaaucaucacagacaccauuaagucuuggaggaacaauauauugcggacgcaggaguccgaaugcgccugugugaacgguagcugcuuuacugucaugaccgauggcccaucgaacgggcaggcuucuuacaaaaucuucaagauggagaaaggaaagguggugaaauccgucgaacucgacgcccccaauuaucacuacgaggaguguucaugcuauccugaugcgggcgaaauuacauguguuugccgcgacaacuggcaugguaguaauagaccaugggugagcuuuaaccagaaucuggaguaccaaaucggguauauaugcuccggaguauucggcgauaacccgaggcccaaugacggcacugggucuuguggaccuaugagcccaaacggugcauacggcgugaagggguuuucauucaaguacggaaauggcgucuggauuggucggaccaaaaguacaaacucccgcagcggguuugaaaugaucugggaucccaauggcuggaccggaacggacucuucauucagugugaagcaggacaucguugccauuacugauuggagcggcuauuccgggucuuuugugcagcacccugagcugacaggacucgacugcauccgaccauguuucugggucgaauuaauuagagguaggcccaaagagucgaccauauggacuagcggcuccucaaucaguuucugcggggugaacucugauacaguaagcugguccuggccggacggagcugagcugccuuuuaccauugauaaguga

SEQ ID NO: 137708 - RNA, 1350 nt, Artificial Sequence; identical to SEQ ID NO: 137707
  derived and/or modified sequence opt3 from neuraminidase__InfluenzaA__ABM90535

SEQ ID NO: 137709 - RNA, 1350 nt, Artificial Sequence; identical to SEQ ID NO: 137707
  derived and/or modified sequence opt3 from neuraminidase__InfluenzaA__ABM90546

SEQ ID NO: 137710 - RNA, 1413 nt, Artificial Sequence
  derived and/or modified sequence opt3 from neuraminidase__InfluenzaA__ABN50759
augaaccccaaucagaagaucauuaccauaggcagcaucugcauggccauugggaucauuucccugauccuccaaauaggaaacaucauuucuaucugggugucacacaguauucagacagguagccagaaucauacuggcaucuguaaccagagaauaauuacguacgaaaauuccaccugggucaaccaaacauauguuaauaucucuaacacuaaugugguagcugggaaagacaccacaucgaugacccuugcaggaaacucaagccugugcccuauuaggggcugggccaucuacaguaaggauaauuccauccggauugguucuaaaggggacguguucgucauacgcgaaccauuuaucagcuguucccacuuggagugccgaacuuucuuuuuaacacagggagcgcugcuaaacgauaagcauucaaauggcaccgugaaagaccguaguccguauagagcucucaugagcugucccauuggcgaagccccuucuccauacaacuccagguucgagucaguugcauggagcgccagugcuugccacgaugggaugggauggcugacgaucgguauaucuggccccgacgauggggcaguggccguccuuaaguauaauggaauuaucacugaaaccaucaaguccuggcggaaacagauucugcgcacacaggagagcgagugugugugcguaaacggcucguguuuuacuaucaugaccgacgguccuucugaugggcaggcuuccuacagaauuuucaagauagaaaaaggaaagaucacaaaaucaauugaguuggacgccccaaacagucauuaugaagagugcagcuguuaccccgauaccggcacgguuaugugcgugugcagggacaauuggcacggcuccaaccggccuugggucucuuuuaaucaaaaccucgauuaccagaucggguauaucuguagcggaguguucggugacaauccacgcccgaaggacggcaaggggucaugcgaucccgugaacgucgacggagcggauggcguuaaagguuuuaguuaccgauaugggaauggcguguggauuggaagaacuaaguccaacagcucuaggaaaggcuucgagaugauaugggacccuaauggguggacagauaccgacucaaacuuucugguaaagcaggauguggucgcaaugacugacuggaguggauacagcgguuccuucgugcaacacccagaacugacaggccucgauuguauccggcccugcuuuuggguugaguuaauucgugggcgcccuagagagaaaaccacgaucuggaccucuggaucgagcauuuccuucuguggcgucaauucagacacagugaacuggaguuggccagauggugccgagcugcccuucacuaucgacaaguga

SEQ ID NO: 137711 - RNA, 1410 nt, Artificial Sequence
  derived and/or modified sequence opt3 from neuraminidase__InfluenzaA__ABN50770
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccguugugucauggaguaaaaagauccugaggacgcaggagagcgaaugugucugcauuaauggcacuuguacaguggugaugaccgauggcucugcuuccgggaaagcagacacuaagauacucuuuaucgaggagggaaagauuguccacacaucaaccuuaagcgguagugcccaacacguugaagagugcucuugcuauccucgguacccaggcgugcgcuguguaugcagagauaacuggaaaggguccaacaggccgaucguggacauaaauauuaaggacuacagcaucgucucgucuuauguguguuccggacugguuggcgauacgccccggaaaaacgacucaaguagcuccucucauugccuugauccuaauaacgaagagggugggcacggagugaagggcugggcuuucgacgauggcaaugacgucuggauggggcgcaccaucagcgaaaaauugcgaucaggauacgagacauuuaaggugauugaggguuggaguaacccaaauuccaaacugcagaucaacagacagguaauuguugauaggggcaaucggagcggguauucuggaauauucucaguggaaggcaagaguuguaucaaccguugcuuuuacgucgagcuaauucgcgguagaaaggaagagacugaagugcucuggaccagcaauuccaucgucguguucugugggacaucuggcacuuauggaaccggcucguggcccgacggggccgauaucaaccugaugccuauuuga

SEQ ID NO: 137712 - RNA, 1413 nt, Artificial Sequence
  derived and/or modified sequence opt3 from neuraminidase__InfluenzaA__ABN50903
augaaccccaaucagaagaucauuaccauaggcagcaucugcauggccauugggaucauuucccugauccuccaaauaggaaacaucauuucuaucugggugucacacaguauucagacagguagccagaaucauacuggcaucuguaaccagagaauaauuacguacgaaaauuccaccugggucaaccaaacauauguuaauaucaacaauacuaacgugguagcugggaaagacaccacaucugugacccuugcaggaaauucgucacugugcccugucaggggcugggccauuuacagcaaggauaacaguauccggaucgguuccaaaggggacguguucguuauucgcgaaccauuuauaucuuguagccacuuggagugccgaacuuucuuuuuaacacagggagcgcugcuaaaugauaagcauuccaacggcaccgugaaagaccguucaccguauagagcucucaugaguugucccaucggcgaagccccuagcccauacaauucuagguucgaguccgucgcauggucagccagcgcuugccacgaugggaugggauggcugacgauugguaucaguggccccgacgauggggcaguggccguacuuaaguauaacggaauaauuacugaaaccaucaagucuuggcggaaacgcauccugagaacacaggaguccgaguguguuugcgugaacggcagcuguuuuacuauuaugaccgacgguccuucgaaugggccagcuucuuacaggaucuucaagauugaaaaaggaaagauaacaaaauccaucgaguuggaugcccccaacucacauuaugaagagugcaguuguuacccugacaccggcacggucaugugcgugugccgggauaauuggcacggcagcaaccgcccauggguguccuuuaaucagaaccucgacuaccaaauuggguauaucuguucuggagucuucggugauaauccgcgacccaaggacggcaaggggagcugcggaccuguuacuguggacggcgcggaugguguaaaaggguuuucauacagauauggcaacggaguguggaucggcaggacaaagaguaauuccagccggaaaggguucgagaugauuugggacccaaacggauggaccgauacugacucuaauuuucuggucaagcaggaugugguugcaaugacagacuggucagguuacaguggcagcuucauacagcaccccgaacugaccgggcucgauuguaugcguccuugcuuuuggguggaguuaauccgcggaagaccaagggagaaaacgaccauuuggacauccgguucuucgaucagcuucuguggcgucaacuccgacacugugaauuggucauggcccgauggggccgagcugccguucaccauugacaaguga

SEQ ID NO: 137713 - RNA, 1413 nt, Artificial Sequence; identical to SEQ ID NO: 137075
  derived and/or modified sequence opt3 from neuraminidase__InfluenzaA__ABN50920

SEQ ID NO: 137714 - RNA, 1413 nt, Artificial Sequence
  derived and/or modified sequence opt3 from neuraminidase__InfluenzaA__ABN50931
augaaccccaaucagaagaucauuaccauaggcagcaucugcauggccauugggaucauuucccugauccuccaaauaggaaacaucgugucuauuuggaucucacacaguauucagacagguagccagaauuacacuggcaucuguaaccagagaauaauuacguaugaaaauuccaccugggucaaccaaacauacguuaauaucaacaauacuaacgugguagcugggcaggacaccacaucuguggcacuugccggaaauucgucacugugcccuauuagcggcugggcgaucuauaguaaagauaacuccaucaggauugguucuaagggggacgucuucgugauacgggagccauuuaucagcuguucccauuuggagugccgcaccuucuuuuuaacucagggagcucugcuaaaugauaaacacucaaacggcacaguuaaggaccgaaguccguaccgugcccucaugagcugucccauuggcgaagcaccuucuccauauaauuccagauucgagucaguggccuggagcgcuagugcaugccaugaugggaugggauggcugaccaucgguauaucuggccccgacgauggggccgucgcugugcuuaaauacaacggaauuaucacggaaacuaucaaguccuggaggaagcggauucugcgcacccaggagagcgaguguguaugcguuaacggcucguguuuuacaaucaugacugacgguccuaauaacgggccagccucuuauaaaauuuucaagauagaaaaaggaaagaucaccaaauccauugaguuggaugcgcccaauucacacuacgaagagugcaguuguuacccugacgcaggcacagugaugugcgucugcagagauaacuggcauggcagcaauaggccauggguguccuuuaaccaaaaucucgacuaucagaucggguacaucuguucuggaguguucggugauaacccgcggcccaaggacggcaaggggagcugcggaccugucaccguugacggcgccgauggugugaaaggguuuucauaucgcuacggcaauggaguauggauuggccgaacgaagaguaacuccagcagaaggggguucgagaugauaugggacccaaauggauggacugauacagacucuaaauuucuggugaagcaggaugucguggcuaucaccgacuggucagguuauaguggcagcuucguucagcaccccgaacugacugggcucgauuguaugcggccuugcuuuuggguggaguuaauucguggacgcccaagagaaaacacaaccaucuggacguccgguucuucgauuagcuucuguggcgucaauggggacaccgccaacugguccuggcccgauggcgcagagcugccguucacaaucgacaaauga

SEQ ID NO: 137715 - RNA, 1413 nt, Artificial Sequence
  derived and/or modified sequence opt3 from neuraminidase__InfluenzaA__ABN50943
augaaccccaaucagaagaucauuaccauaggcagcaucugcauggccauugggaucauuucccugauccuccaaauaggaaacaucgugucuauuuggaucucacacaguauucagacagguagccagaauuacacuggcaucuguaaccagagaauaauuacguaugaaaauuccaccugggucaaccaaacauacguuaauaucaacaauacuaacgugguagcugggcaggacaccacaucuguggcacuugccggaaauucgucacugugcccuauuagcggcugggcgaucuauaguaaagauaacuccaucaggauugguucuaagggggacgucuucgugauacgggagccauuuaucagcuguucccauuuggagugccgcaccuucuuuuuaacucagggagcucugcuaaaugauaaacacucaaacggcacaguuaaggaccgaaguccguaccgugcccucaugagcugucccauuggcgaagcaccuucuccauauaauuccagauucgagucaguggccuggagcgcuagugcaugccaugaugggaugggauggcugaccaucgguauaucuggccccgacgauggggccgucgcugugcuuaaauacaacggaauuaucacggaaacuaucaaguccuggaggaagcggauucugcgcacccaggagagcgaguguguaugcguuaacggcucguguuuuacaaucaugacugacgguccuaauaacgggccagccucuuauaaaauuuucaagauagaaaaaggaaagaucaccaaauccauugaguuggaugcgcccaauucacacuacgaagagugcaguuguuacccugacgcaggcacagugaugugcgucugcagagauaacuggcauggcagcaauaggccauggguguccuuuaaccaaaaucucgacuaucagaucggguacaucuguucuggaguguucggugauaacccgcggcccaaggacggcaaggggagcugcggaccugucaccguugacggcgccgauggugugaaaggguuuucauaucgcuacggcaauggaguauggauuggccgaacgaagaguaacuccagcagaaggggguucgagaugauaugggacccaaauggauggacugauacagacucuaaauuucuggugaagcaggaugucguggcuaugaccgacuggucagguuauaguggcagcuucguucagcaccccgaacugacugggcucgauuguaugcggccuugcuuuuggguggaguuaauccguggacgcccaagagaaaacacaaccauuuggacguccgguucuucgaucagcuucuguggcgucaauggggacaccgccaacugguccuggcccgauggcgcagagcugccguucacaauugacaaauga

SEQ ID NO: 137716 - RNA, 1413 nt, Artificial Sequence; identical to SEQ ID NO: 136984
  derived and/or modified sequence opt3 from neuraminidase__InfluenzaA__ABN50954

SEQ ID NO: 137717 - RNA, 1413 nt, Artificial Sequence; identical to SEQ ID NO: 136984
  derived and/or modified sequence opt3 from neuraminidase__InfluenzaA__ABN50965

SEQ ID NO: 137718 - RNA, 1413 nt, Artificial Sequence; identical to SEQ ID NO: 136984
  derived and/or modified sequence opt3 from neuraminidase__InfluenzaA__ABN50976

SEQ ID NO: 137719 - RNA, 1410 nt, Artificial Sequence; identical to SEQ ID NO: 136359
  derived and/or modified sequence opt3 from neuraminidase__InfluenzaA__ABN50987

SEQ ID NO: 137720 - RNA, 1410 nt, Artificial Sequence; identical to SEQ ID NO: 136362
  derived and/or modified sequence opt3 from neuraminidase__InfluenzaA__ABN50998

SEQ ID NO: 137721 - RNA, 1410 nt, Artificial Sequence
  derived and/or modified sequence opt3 from neuraminidase__InfluenzaA__ABN51013
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucuuugcuuggacccuaacaaugaggaaggugggcauggaguuaaaggcugggcuuucgaugacggcaacgauguguggauggggcgcaccauuagcgagaagcugcgaucaggauacgagacauuuaaagucaucgaagguuggaguaauccaaacuccaagcuacagauuaauagacaggugauaguagacaggggcaaccggagcggguauucuggaaucuucucaguugagggcaaaaguuguauuaaucguugcuuuuacguggaacucauccgcgguagaaaggaggaaacugagguccuguggaccagcaacuccaucguggucuucugugggacaucuggcacuuauggaaccggcucguggcccgauggggccgacauuaaucuuaugccuauauga

SEQ ID NO: 137722 - RNA, 1410 nt, Artificial Sequence
  derived and/or modified sequence opt3 from neuraminidase__InfluenzaA__ABN51024
augaaccccaaucagaagaucauuaccauaggcagcgugucccugacagucucuacuaucugcuucuuuaugcaaauugccauccucauuacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucaguguaacaucacaggguucgcaccauuuagcaaagacaauuccauacggcugucugccggaggugauauuugggugacccgcgagcccuaugucucgugcgacccugauaaguguuaccaauucgcgcuaggccaggggacgacucucaacaaugugcauucaaacgacaccguucacgaucgaacaccauaucguacucugcuuaugaaugaacugggagugcccuuucauuugggcaccaagcaggucugcaucgcuuggagcaguuccucuugucacgacgguaaagccuggcuccaugugugcguaacaggggaugacaagaacgcaaccgccagcuucauuuacaauggaagacugguugauuccaucgugucauggaguaaagagauccugaggacgcaggaaagcgagugugucugcauuaacggcacuuguacaguggugaugaccgacggcucugcuuccgggaaggcagauacuaaaauacucuuuaucgaggaaggaaagauuguccacacaucaaccuuaagcgguagugcccaacacguugaggaaugcucuugcuauccucgguacccaggcgugcgcuguguaugcagagacaacuggaagggguccaauaggccgaucguggauauaaacauuaaagacuacagcaucgucucgucuuauguguguuccggacugguuggcgacacgccccggaagaaugauucaaguagcuccucucauugccuugacccuaacaaugaggaaggugggcacggagugaaaggcugggcuuucgaugacggcaacgaugucuggauggggcgcaccaucagcgagaaguugcgaucaggauacgagacauuuaaagugauugaagguuggaguaauccaaacuccaagcugcagacuaauagacagguaaucguugacaggggcaaccggagcggguauucuggaauuuucucaguggagggcaaaaguuguauaaaucguugcuuuuacgucgaacuaauccgcgguagaaaggaggaaaccgaggugcucuggacaagcaacuccauugucguguucugugggacuucuggcaccuauggaacaggcucguggcccgauggggccgacaucaaucugaugccuaucuga

SEQ ID NO: 137723 - RNA, 1410 nt, Artificial Sequence
  derived and/or modified sequence opt3 from neuraminidase__InfluenzaA__ABN51035
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccguugugucauggaguaaagauauccugaggacgcaggagagcgaaugugucugcauuaauggcacuuguacaguggugaugaccgacggcucugcuuccgggaaggcagauacuaaaauacucuuuaucgaggagggaaagauuguccacacaucaaccuuaagcgguagugcccaacacguugaagagugcucuugcuauccucgguacccaggcgugcgcuguguaugcagagacaacuggaagggguccaacaggccgaucguggacauaaauauuaaaaacuacagcaucgucucgucuuauguguguuccggacugguuggcgauacgccccggaagaccgacucaaguagcuccucucauugccuugauccuaauaacgaagagggugggcacggagugaaaggcugggcuuucgacgauggcaaugacgucuggauggggcgcacaaucagcgaaaaguugcgacugggauacgagacuuuuaaagugauugaggguuggucaaacccaaauaguaagcuacagaucaacagacagguaauuguugauaggggcaaucgguccggguauagcggaauauucucuguggaaggcaaaucauguaucaaccguugcuuuuacgucgagcucauucgcgguagaaaggaagagaccgaagugcuguggacaaguaauagcaucgucguguucugugggacuuccggcaccuauggaacaggcucuuggcccgacggggccgauaucaaccuuaugccuauuuga

SEQ ID NO: 137724 - RNA, 1410 nt, Artificial Sequence; identical to SEQ ID NO: 137723
  derived and/or modified sequence opt3 from neuraminidase__InfluenzaA__ABN51046

SEQ ID NO: 137725 - RNA, 1413 nt, Artificial Sequence
  derived and/or modified sequence opt3 from neuraminidase__InfluenzaA__ABN51069
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaaccaaacauaugucaauauuaacaauacuaacguuguggcagggaaagacaagaccucgaugacacuugccggaaauucaagccuguguccuaucaggggcugggcgaucuacaccaaagauaacaguauucggauagguuccaagggggacguauucgugauccgcgagccauuuauuucuugcagccacuuggagugucgaacuuucuuuuuaacacagggagcucugcuaaaugauaaacauuccaacggcaccgucaaggaccguucaccguauagagcccucaugaguugcccccugggcgaagcaccuagcccauacaauucuagguucgaguccguggccuggucagcuagcgcaugucacgaugggcuuggauggcugacgaucgguauaaguggccccgacaacggggccguugcuguguugaaguauaacggaauuaucacugaaaccaucaaaucuuggaagaaacggauucuccgcacacaggaguccgagugcgucuguaugaauggcagcugcuuuacuaucaugaccgaugguccuucgaacggggccgcgucuuacagaauuuucaagauagaaaaaggaagggugacaaaguccaucgagcuggacgcaccaaauuaucauuacgaagaguguucaugcuaccccgauaccggcacgguaauguguguuugccgggacaacuggcacggcaguaaucgcccuugggugagcuuuaaccagaaucuggauuaucaaauuggguacaucugcuccggagucuucggugacaacccacgaccgaaggauggcgaggggucuuguaaucccgugacuguggacggagccgacggcgucaaagguuuuagcuauagauacgggaacggcguuuggaucggaaggacaaagucaaaucggcuccguaaaggcuucgaaauggugugggauccuaacggguggaccgacacugauagugacuuuuccaugaagcaggauauuguagcuaugacagacuggagcggauauucugguucauucgugcagcacccagaguuaaccggccuggauugcaugcgccccuguuuuugggucgaacuugugagaggguugccuagggagaauacgaccauauggacaaguggaagcuccaucucuuucugcggcguuaacucggacacugccaauuggagcuggccagauggugcagaacugcccuucaccauugacaaauga

SEQ ID NO: 137726 - RNA, 1413 nt, Artificial Sequence
  derived and/or modified sequence opt3 from neuraminidase__InfluenzaA__ABN51080
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagagaaagacaagaccucgguaacacuugccggaaauucaagccuguguaguauuuccggaugggcgaucuacaccaaagauaacucuaucaggauuggcagcaagggugacguguucgucauacgggagccuuuuaucuccugcucacauuuggaaugucgcacuuucuuuuuaacacaaggggcucugcuaaaugauaaacacaguaacggaaccgugaaggaccgaagcccauaucgugcccucaugucuugcccgcugggcgaggcacccuccccuuacaauucaaaguucgaaagcguugccuggagugcuucugcaugucaugauggcaugggguggcuuacgauuggaaucuccgguccagacaacggcgccguggcuguccugaaauauaacgggauaauuacugagaccaucaagagcuggaaaaagcagaucuugagaacacaggagucggaaugcguguguguaaauggaucuugcuuuacuauuaugaccgauggccccuccaacggugccgcgucauacaaaaucuucaagauugagaaggggaaaguuacaaagaguguggaacucaaugcaccuaacuuucacuaugaggaguguagcugcuacccagacaccggaacggucaugugugugugcagggauaauuggcacggcuccaaccggcccugggugucuuucaaucagaaccuggacuaccaaauaggcuauaucugcagcggggucuuuggagauaauccucgcccaaaagacggugaaggcucauguaacccgguuacuguggauggggccaauggaguaaagggcuucaguuacaaauaugguaacgggguguggauuggcagaacaaaguccaauaggcugcggaaaggauuugagaugaucugggaccccaacggcuggaccgacacugauagcgacuucucugucaagcaggaugugguugcuaucacagacuggucaggguacagugggagcuuugugcagcauccugaacucaccgguuuagauugcauucgcccauguuucugggucgagcuggugcgaggccuucccaaggaaaauacgaccauauggacauccgggucuucgaucagcuucugcggaguaaacuccgacacugccaacuggucauggccugauggcgcagaguugccauuuaccauugacaaauga

SEQ ID NO: 137727 - RNA, 1413 nt, Artificial Sequence; identical to SEQ ID NO: 136402
  derived and/or modified sequence opt3 from neuraminidase__InfluenzaA__ABN51091

SEQ ID NO: 137728 - RNA, 1410 nt, Artificial Sequence; identical to SEQ ID NO: 136111
  derived and/or modified sequence opt3 from neuraminidase__InfluenzaA__ABN51102

SEQ ID NO: 137729 - RNA, 1410 nt, Artificial Sequence; identical to SEQ ID NO: 136119
  derived and/or modified sequence opt3 from neuraminidase__InfluenzaA__ABN51113

SEQ ID NO: 137730 - RNA, 1410 nt, Artificial Sequence
  derived and/or modified sequence opt3 from neuraminidase__InfluenzaA__ABN51124
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugauccuggcaagugcuaccaguucgcucuggggcagggaacaacccuagacaacaagcauucaaaugauacgauccacgaccgagucccacaucguacucuccugaugaacgaacuuggcgugcccuuucaccuggguaccagacagguauguauugccuggagcaguuccucuugccaugaugggaaagcaugguugcacguuuguaucacaggagacgauaagaaugccacugcuagcuucaucuaugacggcaggcucguggauuccauuggcucauggagucaaaacauacugcggacccaggagagcgaaugcgucuguaucaaugggacaugcaccguggugaugacggacggaucugcauccggucgcgccgauacuaggauucuguuuaucgaggagggcaaaauaguccacauuucaccucucagcgggagugcucagcauguugaagagugcucuuguuacccaagguauccgggagugcggugcaucugucgcgacaacuggaagggcuccaaucgacccguaguggacaucaacauggaagauuacagcauugacucgucuuacgucugcuccgguuuagugggggauacaccuagaaacgacgauaggucaaguaauagcaacugucggaauccaaacaaugagcguggaaaccagggcguuaaaggcugggccuucgacaauggggaugacguguggaugggacgcaccaucuccaaggaucugagaucugguuaugaaacuuuuaaggucauuggcggguggagcacacccaacucaaaaagucaaauaaauagacaggugaucguagacuccgauaaccggagcggauacucuggcauuuucucaguugaggguaagaguugcaucaaucgauguuuuuauguggagcuuauccgcgggagaaaacaggaaaccagggucugguggacgagcaacuccauuguggucuucugcggcaccucuggaacauacggcacugggucguggccugacggagcgaauauaaacuuuaugccaaucuga

SEQ ID NO: 137731 - RNA, 1410 nt, Artificial Sequence; identical to SEQ ID NO: 136119
  derived and/or modified sequence opt3 from neuraminidase__InfluenzaA__ABN51135

SEQ ID NO: 137732 - RNA, 1413 nt, Artificial Sequence; identical to SEQ ID NO: 136412
  derived and/or modified sequence opt3 from neuraminidase__InfluenzaA__ABN51146

SEQ ID NO: 137733 - RNA, 1410 nt, Artificial Sequence
  derived and/or modified sequence opt3 from neuraminidase__InfluenzaA__ABN51157
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgagacuaagauauuauuuaucgaagagggcaaaauugugcacaucuccacacugucagggagcgcucaacacguggaagagugcaguuguuauccucgcuacccaggagucagaugcguuuguagggauaacuggaagggcucuaaucggccgauaguggacauuaacguaaaggauuacuccaucgugagcucguaugucugcucuggucuugugggggacacccccaggaaaaaugacuccuucucaaguagccauuguuuggauccuaacaaugaagagggaggccacggcguuaaggggugggccuuugacgauggaaacgacguguggaugggucgaacgaucuccgagaaacugagaucuggcuacgaaaccuucaaggucauugagggguggagcaaaccaaauucaaagcuacagacaaaccgccaggugaucguagaacggggaaaucguaguggcuauuccgguauuuuuagcguugaggggaaaucuugcauaaaccgcuguuucuacguggaacucaucagaggcaggaaggaggagacugaagucugguggaccucaaauaguauuguggucuuuugcggaacaagcggcacuuaugggaccggauccuggcccgauggugcggacaucaaccugaugccuaucuga

SEQ ID NO: 137734 - RNA, 1410 nt, Artificial Sequence; identical to SEQ ID NO: 137722
  derived and/or modified sequence opt3 from neuraminidase__InfluenzaA__ABN59393

SEQ ID NO: 137735 - RNA, 1365 nt, Artificial Sequence
  derived and/or modified sequence opt3 from neuraminidase__InfluenzaA__ABN59415
augaaccccaaucagaagaucauuaccauaggcagcaucugccugguggucgggcucauuucccuuauccugcaaauuggaaacaucauaucuaucuggauuucacacaguauccagacagguagccagaaucauacuggcauuuguaaccagaauaucauaacguacaaaaacuccaccuggguuaaggacacaacuucugugauuuugaccggaaauucgucauuaugcccuaucagagggugggccauuuauagcaaagauaacaguaucaggaucggcuccaagggugacguauucgugauucgggagccauuuauaucuuguagccaccuggaaugccgcacauucuuucuaacccaaggggcucuccugaaugauaaacauuccucaggaacugucaaggaccgaaguccguaccgugcacuuaugagcugucccgugggcgaggccccuucuccauauaacuccagauucgaaucaguugcguggagcgcuagugccugccacgauggcaugggguggcugacaaucggaauuucuggucccgacaauggcgcaguggccgucuugaaguacaacgggaucauaaccgagacgauuaaauccuggaggaagaaaauccuccggacucaggaaagcgagugugcuugcgugaauggaucguguuuuaccaucaugacagauggcccuucugacggucuggcauccuauaagauuuucaaaaucgagaaggggaagguaacuaaaucaauugaacugaacgccccaaauagucauuacgaggaaugcagcuguuaucccgauaccggaaagguuaugugcgugugccgcgacaacuggcacggcuccaacagaccuugggucucuuuugaucagaaucucgacuaccagauaggcuacaucuguagcgggguguucggagauaacccaaggccggaggacgguacaggcucaugcgggcccguguaugucgacggagcuaauggcguuaaagguuuuaguuaccgguaugggaacggcguguggauuggacgcaccaagucccacagcucucgacauggcuucgagaugaucugggauccuaauggguggacggaaacugacucaaaauuuaguguaagacaagauguggucgccaugacagacuggagcggauacuccgguucuuucgugcagcacccagaguuaaccggccuggauuguaugaggcccugcuuuuggguugaacuuauccgggggcguccuaaggagaaaacuauuuggacaucggcgagcuccauaucauucuguggagugaacagugacaccgucgauuggucuuggccagacggcgcagaauugcccuucagcaucgauaaguga

SEQ ID NO: 137736 - RNA, 1413 nt, Artificial Sequence; identical to SEQ ID NO: 136967
  derived and/or modified sequence opt3 from neuraminidase__InfluenzaA__ABN59426

SEQ ID NO: 137737 - RNA, 1410 nt, Artificial Sequence; identical to SEQ ID NO: 136269
  derived and/or modified sequence opt3 from neuraminidase__InfluenzaA__ABO32659

SEQ ID NO: 137738 - RNA, 1410 nt, Artificial Sequence
  derived and/or modified sequence opt3 from neuraminidase__InfluenzaA__ABO32670
augaaccccaaucagaagaucauuaccauaggcagcgugucccugacaaucucuacuauuugcuucuuuaugcaaaucgccauucucgucacgaccguuacacuucacuucaaacaguacgaguguaacucaccuccaaauaaccaggugaugcugugcgaaccgacuaucauagagagaaauaucaccgaaauuguauauuugacaaacaccacuaucgagaaggaaauuugucccaaauuagcugaguacaggaauuggaguaagccucagugcaacaucacaggguuugcaccauucagcaaagacaauuccauacggcugucugccggaggugauauuugggugacccgcgagcccuaugucucgugugacccugauaagugcuaccaauuugcgcuaggccaggggacgacucucaacaauggacauucaaacgacaccgugcacgaucgaacaccauaucguacucugcuuaugaaugaacugggcguucccuuccauauggguaccaaacagguguguaucgcuuggagcaguuccucuugccacgacgggaaggccugguugcaugucugugugacaggagaugacgagaacgcaaccgccagcuuuauuuacaauggcagacucguagauuccaucggcucauggaguaagaaaauccugaggacgcaggaaagcgagugcguuuguauuaacgggacuugcacaguggucaugaccgacggaucugcuuccgguaaggcagauacuaaaauacuguucaucgaggaaggcaagauugugcacacaucaacccucagcgggagugcccaacacguggaggaaugcucuuguuauccucgguacccaggaguccgcugcguuuguagagacaacuggaagggcuccaauaggccgaucguggauauaaacauuaaagacuacagcaucguaucgucuuaugugugcuccgguuuagucggggacacgccccggaagaaugauucaaguagcuccucucauugucuggacccuaacaaugaggaaggaggccacggcgugaaagggugggcuuuugaugacggaaacgauguuuggaugggucgcaccaucagcgagaaacuucgaucaggcuacgagacauucaaggugauugaaggguggaguaagccaaauuccaaauugcagaucaacagacaggucauuguggacaggggaaaucggagcggcuauucugguauauuuucaguagaggggaagaguugcaucaaccguuguuucuacguugaacugauucgcggcagaaagcaggagacugaagugcuauggaccagcaauuccaucgucguguuuugcggaacaucuggcacuuaugggaccggaucguggcccgauggugccgacaucaaccucaugccuauuuga

SEQ ID NO: 137739 - RNA, 1413 nt, Artificial Sequence; identical to SEQ ID NO: 137590
  derived and/or modified sequence opt3 from neuraminidase__InfluenzaA__ABO32681

SEQ ID NO: 137740 - RNA, 1410 nt, Artificial Sequence
  derived and/or modified sequence opt3 from neuraminidase__InfluenzaA__ABO32695
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugcagcgacccuaacaaugaggaaggugggcacggaguuaaaggcugggcuuucgaugacggcaacgauguguggauggggcgcaccauuucagagaaacuucgaaguggauacgagacauuuaaggucaucgaagguugguccaauccaaacagcaaguugcagauuaauagacaggugauaguagacaggggcaaccggucuggguauucaggaaucuucaguguugagggcaaaagcuguauuaaucguugcuuuuacguggaacugauccgcgguagaaaggaggaaacugagguccuauggaccuccaacucuaucguggucuucugugggacaucgggcacuuauggaaccggcagcuggcccgauggggccgacauuaaucucaugccuauauga

SEQ ID NO: 137741 - RNA, 1410 nt, Artificial Sequence; identical to SEQ ID NO: 136746
  derived and/or modified sequence opt3 from neuraminidase__InfluenzaA__ABO32754

SEQ ID NO: 137742 - RNA, 1410 nt, Artificial Sequence; identical to SEQ ID NO: 136746
  derived and/or modified sequence opt3 from neuraminidase__InfluenzaA__ABO32765

SEQ ID NO: 137743 - RNA, 1410 nt, Artificial Sequence; identical to SEQ ID NO: 137618
  derived and/or modified sequence opt3 from neuraminidase__InfluenzaA__ABO32778

SEQ ID NO: 137744 - RNA, 1410 nt, Artificial Sequence
  derived and/or modified sequence opt3 from neuraminidase__InfluenzaA__ABO32793
augaaccccaaucagaagaucauuaccauaggcagcgugucccugacaaucucuacuauuugcuucuuuaugcaaaucgucauucucaucacgaccguuacacuucacuucaaacaguacgaguuuaacucaccuccaaauaaccaggugaugcugugugaaccgacuauaaucgagagaaauauuaccgaaaucguauauuugacaaacaccacuauugagaaggaaaucugccccaaauuagccgaguacaggaauuggaguaagccucagugugacauaacaggguucgcuccauuuagcaaagauaacuccauucggcugucugcaggaggugacaucugggugacccgcgagcccuaugucucgugcgauccugacaaguguuaccaauucgcccuaggccaggggacgacucucaauaacgugcauucaaaugauaccguucacgaccgaacaccauaucguacucugcuuaugaacgaacugggagugcccuuucauuugggcaccaagcaggucugcauugcguggagcaguuccucuugucacgaugguaaagcauggcuccaugugugcguaacaggggacgauaagaaugccaccgcuagcuucaucuacaacggaagacugguugacuccaucgugucauggaguaaagagauucugaggacgcaggaaagcgagugugucugcauaaauggcacuuguacaguggugaugaccgauggcucugccuccgggaagacugacacaaaaauccucuuuauugaggaaggaaagaucguccacaccucaacguuaagcgguagugcucaacacguugaggaaugcucuugcuauccucgguacccaggcgugcgcuguguaugcagagauaacuggaagggguccaacaggccgauaguggacauuaauaucaaagacuacagcaucgucucgucuuauguguguuccggacugguuggcgauacaccccggaagaacgacucaaguagcuccucucauugccuugauccuaauaacgaggaaggugggcacggagugaaaggcugggcauucgacgauggcaaugacgucuggauggggcgcaccauuagcgagaaguugcgaucaggauacgagacuuuuaaagugaucgaagguuggaguaacccaaauuccaagcugcagauuaacagacagguaauaguugauaggggcaaucggagcggguauucuggaaucuucucaguggagggcaaaaguuguauuaaccguugcuuuuacgucgaacuaauccgcgguagaaaggaggaaaccgaggugcucuggacaagcaauuccaucgucguguucugugggacuucuggcaccuauggaacaggcucguggcccgacggggccgauauuaaccugaugccuauauga

SEQ ID NO: 137745 - RNA, 1410 nt, Artificial Sequence; identical to SEQ ID NO: 136343
  derived and/or modified sequence opt3 from neuraminidase__InfluenzaA__ABO32806

SEQ ID NO: 137746 - RNA, 1410 nt, Artificial Sequence; identical to SEQ ID NO: 136730
  derived and/or modified sequence opt3 from neuraminidase__InfluenzaA__ABO32819

SEQ ID NO: 137747 - RNA, 1410 nt, Artificial Sequence; identical to SEQ ID NO: 136362
  derived and/or modified sequence opt3 from neuraminidase__InfluenzaA__ABO32830

SEQ ID NO: 137748 - RNA, 1410 nt, Artificial Sequence; identical to SEQ ID NO: 136728
  derived and/or modified sequence opt3 from neuraminidase__InfluenzaA__ABO32841

SEQ ID NO: 137749 - RNA, 1410 nt, Artificial Sequence; identical to SEQ ID NO: 136728
  derived and/or modified sequence opt3 from neuraminidase__InfluenzaA__ABO32852

SEQ ID NO: 137750 - RNA, 1410 nt, Artificial Sequence; identical to SEQ ID NO: 136728
  derived and/or modified sequence opt3 from neuraminidase__InfluenzaA__ABO32863

SEQ ID NO: 137751 - RNA, 1410 nt, Artificial Sequence; identical to SEQ ID NO: 137722
  derived and/or modified sequence opt3 from neuraminidase__InfluenzaA__ABO32874

SEQ ID NO: 137752 - RNA, 1410 nt, Artificial Sequence; identical to SEQ ID NO: 137722
  derived and/or modified sequence opt3 from neuraminidase__InfluenzaA__ABO32885

SEQ ID NO: 137753 - RNA, 1410 nt, Artificial Sequence; identical to SEQ ID NO: 137723
  derived and/or modified sequence opt3 from neuraminidase__InfluenzaA__ABO32896

SEQ ID NO: 137754 - RNA, 1410 nt, Artificial Sequence; identical to SEQ ID NO: 137723
  derived and/or modified sequence opt3 from neuraminidase__InfluenzaA__ABO32907

SEQ ID NO: 137755 - RNA, 1410 nt, Artificial Sequence
  derived and/or modified sequence opt3 from neuraminidase__InfluenzaA__ABO32918
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaacaugccccaaauuagcugaguacaggaauuggaguaagccucaguguaacaucaccggguucgcaccauuuagcaaagacaauuccauacggcugucugccggaggugauauuuggguaacgcgcgagcccuaugugucgugcgacccugauaaguguuaccaauucgcgcuaggccaggggacuacccucaacaauguccauucaaacgacacagugcacgaucgaacuccauaucguacccugcuuaugaaugaacugggaguucccuuucauuugggcacaaaacaggugugcaucgcuuggagcaguuccucuugucacgacgguaaggccuggcuccaugucugcgugaccggggaugacaagaacgcaacggccagcuucauuuacaauggaagacugguagauuccaucguuucauggaguaaagagauccugaggacucaggaaagcgagugugugugcauuaacggcacauguaccgucgugaugacugacggcucugcuuccgggaaggcagauacaaaaauacucuuuaucgaggaaggaaagauugugcacaccucaacguuaagcgguagugcccaacacgucgaggaaugcucuugcuauccucgguacccaggcguucgcugugugugcagagacaacuggaagggguccaauaggccgaucguagauauaaacauuaaagacuacagcaucgugucgucuuaugucuguuccggacuggugggcgacacaccccggaagaaugauucaaguagcuccucucauugccuugacccuaacaaugaggaaggugggcacggaguuaaaggcugggcuuucgaugacggcaacgauguguggauggggcgcaccaucagcgagaaguugcgaucaggauacgagacuuuuaaagucauugaagguuggaguaauuccaacagcaagcugcagaccaauagacaggugaucguagacaggggcaaccggucuggguauucaggaauuuucaguguugagggcaaaagcuguauaaaucguugcuuuuacguggaacuaauccgcgguagaaaggaggaaacagagguccucuggacuuccaacucuauuguggucuucugugggaccucgggcacauauggaaccggcagcuggccagauggggccgacaucaaucugaugcccaucuga

SEQ ID NO: 137756 - RNA, 1410 nt, Artificial Sequence; identical to SEQ ID NO: 137755
  derived and/or modified sequence opt3 from neuraminidase__InfluenzaA__ABO32929

SEQ ID NO: 137757 - RNA, 1410 nt, Artificial Sequence; identical to SEQ ID NO: 137755
  derived and/or modified sequence opt3 from neuraminidase__InfluenzaA__ABO32940

SEQ ID NO: 137758 - RNA, 1413 nt, Artificial Sequence
  derived and/or modified sequence opt3 from neuraminidase__InfluenzaA__ABO32951
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagcagaucuugagaacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugcagggauaauuggcacggcuccaaccggcccugggugucuuucaaucagaaccuggacuaccaaaucggguauauuugcagcggaguguuuggugauaauccucgcccaaaagacggcgaggggucauguaacccggucacuguugauggagccaauggcgugaaggguuucaguuacaaauaugggaacggcguauggaucggaagaacaaaguccaauaggcugcggaaaggcuuugaaaugaucugggaccccaacggguggaccgacacugauagcgacuucucugugaagcaggaugucguggcuauuacagacuggucaggauacagugguagcuuuguucagcauccugagcucaccggcuuagauugcauacgcccauguuucuggguggaacugguccgagggcuucccagagagaauacgaccaucuggacauccggaucuucgauuagcuucugcggcgugaacuccgacacugccaacuggucauggccugauggugcagaauugccauuuaccaucgacaaguga

SEQ ID NO: 137759 - RNA, 1413 nt, Artificial Sequence
  derived and/or modified sequence opt3 from neuraminidase__InfluenzaA__ABO32962
augaaccccaaucagaagaucauuaccauaggcagcaucuccauugccaucgggauuaucucucugaugcuccaaauaggaaacaucauuucaaucugggcuagucacagcauucagacagguuccaaaaaucauacuggcgugugcaaccagagaaucauaacguacgaaaauucuaccugggucaaccacacauauguuaauauuaacaauacuaacgugguagcagggaaggacaaaaccucggugacacuugccggaaauucaagccuguguaguaucuccggcugggcgauuuacaccaaggauaacucuaucaggaucgguagcaaaggggacgucuucgugauucgggagccuuuuauauccugcucacauuuggagugucgcacuuucuuuuuaacacagggagcucugcuaaaugauaagcacaguaacggcaccguuaaggaccgaagcccauaucgugcccucaugucuugcccgcugggcgaagcacccuccccuuacaauucaaaauucgagagcguggccuggagugcuaacgcaugucaugaugggaugggauggcuuacgaucgguauuucuggcccagacaacggggccgucgcugugcugaaguauaauggaaucauaacugaaaccauuaaauccuggaagaaacaaaucuugagaacacaggagagcgagugcguauguguuaacggcucgugcuuuacuaucaugaccgauggucccucuaauggggccgcguccuacaagauuuucaagaucaaaaagggaaaagugacaaagucaauugaacucaacgcaccuaauuuucacuaugaggaauguaguugcuacccagacaccggcacggucaugugugugugcagggauaacuggcacggcagcaaucggcccuggguguccuucaaccagaaucuggacuaccagauaggguauaucugcucuggagucuuuggugauaacccucgcccaaaagacggcgaggggagcuguaauccgguuacuguggauggagccaacggcguaaaggguuucucauacaaauaugggaauggcguguggauuggaagaacaaagaguaacaggcugcggaagggcuuugagaugaucugggaccccaauggguggaccgacacugauuccgacuucagcguccgccaagaugugguugcuaucacagacuggucuggauacucagguaguuuugugcagcauccugaacucaccggcuuagauugcauucgaccauguuucugggucgagcuggugagagggcuucccagggaaaacacgaccauauggacaagcggauccucuaucucguucugcggcguaaacagcgacacugccaauugguccuggccugauggugcagaguugccauuuaccauugacaaauga

SEQ ID NO: 137760 - RNA, 1413 nt, Artificial Sequence; identical to SEQ ID NO: 136402
  derived and/or modified sequence opt3 from neuraminidase__InfluenzaA__ABO32973

SEQ ID NO: 137761 - RNA, 1413 nt, Artificial Sequence; identical to SEQ ID NO: 136967
  derived and/or modified sequence opt3 from neuraminidase__InfluenzaA__ABO32984

SEQ ID NO: 137762 - RNA, 1413 nt, Artificial Sequence; identical to SEQ ID NO: 136967
  derived and/or modified sequence opt3 from neuraminidase__InfluenzaA__ABO32995

SEQ ID NO: 137763 - RNA, 1413 nt, Artificial Sequence
  derived and/or modified sequence opt3 from neuraminidase__InfluenzaA__ABO33009
augaaccccaaucagaagaucauuaccauaggcagcaucugcauggccauugggaugaucucccugauucuccaaaucggaaacauaaucucuauuugggugucacacaguauccagacagguagccagaaucauacuggcauuuguaaccagagaaucauaacguacgaaaauuccaccugggucaaccaaacauauguuaauauuucuaacacuaaugugguagcugggaaagacaccacaucgaugacccuugcaggaaacucaagccugugcccuaucaggggcugggccauuuacaguaaggauaauuccauccggaucgguucuaaaggggacguguucgucauucgcgaaccauuuauaagcuguucccacuuggagugccgaacuuucuuuuuaacacagggagcgcugcuaaacgauaagcauucaaauggcaccgugaaagaccguaguccguauagagcucucaugagcugucccaucggcgaagccccuucuccauacaacuccagguucgagucaguugcauggagcgccagugcuugccacgaugggaugggauggcugacgauugguaucucuggccccgacgauggggcaguggccguccuuaaguauaauggaauaauuacugaaaccaucaaguccuggcggaaacagauccugcgcacacaggagagcgagugugugugcguaaacggcucguguuuuacuauuaugaccgacgguccuucugaugggccagcuuccuacagaaucuucaagauugaaaaaggaaagauaacaaaaucaaucgaguuggacgcccccaacagucauuaugaagagugcagcuguuacccugauaccggcacgguuaugugcgugugcagggacaauuggcacggcuccaaccggccaugggucucuuuuaaucaaaaccucgauuaccagauuggguauaucuguagcggaguguucggugacaauccgcgccccaaggacggcaaggggucaugcgauccugugaacgucgacggagcggauggcguuaaagguuuuaguuaccgauaugggaauggcguguggaucggaagaacuaaguccaacagcucuaggaaaggcuucgagaugauuugggacccaaauggguggacagauaccgacucaaacuuucugguaaagcaggauguggucgcaaugacugacuggaguggauacagcgguuccuucgugcagcaccccgaacugacaggccucgauuguaugcggccuugcuuuuggguugaguuaauacgugggcgcccaagagagaaaaccacgaucuggaccucuggaucgagcauuuccuucuguggcgucaauucagacacagugaacuggaguuggcccgauggugccgagcugccguucacuaucgacaaguga

SEQ ID NO: 137764 - RNA, 1410 nt, Artificial Sequence; identical to SEQ ID NO: 137534
  derived and/or modified sequence opt3 from neuraminidase__InfluenzaA__ABO33039

SEQ ID NO: 137765 - RNA, 1410 nt, Artificial Sequence
  derived and/or modified sequence opt3 from neuraminidase__InfluenzaA__ABO33050
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccccucugucagggagcgcucaacacguggaggaaugcaguuguuauccacgguacccgggaguccgcugcguuuguagagacaacuggaagggcucuaauaggcccaucguggauauaaacguaaaagacuacuccauugugagcucguaugucugcucuggucuugugggggacaccccucggaagaaugauuccucaaguagcucccauuguuuggacccaaacaaugaggaaggaggccacggcguuaaagggugggccuucgaugacggaaacgauguguggaugggucgcacgaucucugagaagcugcgaagcggcuacgagaccuuuaaagucaucgaaggguggucaaagcccaauaguaaacuacagauuaacagacaggugaucguagacaggggaaaucgguccggcuauagcgguauuuucucuguugaggggaagucaugcauaaaccguuguuuuuacguggaacucauccgcggcagaaagcaggagacagaaguccuguggaccaguaauagcauuguggucuucugcggaacuuccggcacauaugggacuggaucuuggccugauggugcggacaucaaccuuaugccaaucuga

SEQ ID NO: 137766 - RNA, 1410 nt, Artificial Sequence; identical to SEQ ID NO: 136746
  derived and/or modified sequence opt3 from neuraminidase__InfluenzaA__ABO33061

SEQ ID NO: 137767 - RNA, 1410 nt, Artificial Sequence
  derived and/or modified sequence opt3 from neuraminidase__InfluenzaA__ABO33072
augaaccccaaucagaagaucauuaccauaggcagcgugucccugacaaucgccacuauuugcuuccucaugcaaaucgcuauucuugucacgaccguuacacugcacuuuaaacaguacgagugugggucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggauucgccccauuuaguaaggacaauagcauucggcuguccgcggguggcgauaucugggucacacgcgagcccuaugugucuugugacccugggaagugcuaccaauucgcucuaggacagggcaccacgcucgauaacaaacauucgaaugacacuauucacgaucgaaccccacaucguacacugcuuaugaacgaacuggguguucccuuucacuuggggacuagacagguguguaucgccuggucaagcaguuccugccaugacggaaaggcauggcuccacgucugugugaccggcuaugauaaaaaugccacagcuucuuucaucuacgacggcaggcugguagauagcauuggguccuggucaaagaacauacugcggacccaggagagugaaugcguuuguaucaauggaacgugcacuguggucaugacagacgguagcgcaucugagcgcgccgauaccaaaauucucuuuaucgaggaaggcaagauagugcacauuuccccuuuaucagggagcgcucaacauguggaggaaugcaguuguuauccaagauacccgggagucaggugcguuugucgggacaacuggaagggcucuaaucgccccgugguagauaucaacgugaaagacuacuccaucgucagcucguaugugugcucuggucugguuggggacacuccucgaaagaacgauagauccucaaguagcuacuguaggaauccaaacaaugagaaaggaaaccacggcgugaagggcugggccuucgacgaugggaaugacgucuggaugggacggacaauuuccgaagagucucguagcgguuaugagaccuuuaaagugaucggcggguggucaacgcccaacaguaaacuucagauuaaucgccagguaauaguugauuccgacaacagaagcggauacucuggcaucuucucaguggaagguaagaguugcauuaauagguguuuuuaugucgaguugauccgggggcgagaacaggagacccgcgugugguggacaagcaacuccaucgucguguucugcggcacuucuggaaccuacggcacagggucguggccugauggagcggacauuaaucugaugccaauauga

SEQ ID NO: 137768 - RNA, 1413 nt, Artificial Sequence; identical to SEQ ID NO: 137075
  derived and/or modified sequence opt3 from neuraminidase__InfluenzaA__ABO37991

SEQ ID NO: 137769 - RNA, 1413 nt, Artificial Sequence
  derived and/or modified sequence opt3 from neuraminidase__InfluenzaA__ABO38013
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaaccaaacauaugucaauauuaacaauacuaacguuguggcagggaaagacaagaccucgaugacacuugccggaaauucaagccuguguccuaucaggggcugggcgaucuacaccaaagauaacaguauucggauagguuccaagggggacguauucgugauccgcgagccauuuauuucuugcagccacuuggagugucgaacuuucuuuuuaacacagggagcucugcuaaaugauaaacauuccaacggcaccgucaaggaccguucaccguauagagcccucaugaguugcccccugggcgaagcaccuagcccauacaauucuagguucgaguccguggccuggucagcuagcgcaugucacgaugggcuuggauggcugacgaucgguauaaguggccccgacaacggggccguugcuguguugaaguauaacggaauuaucacugaaaccaucaaaucuuggaagaaacggauucuccgcacacaggaguccgagugcgucuguaugaauggcagcugcuuuacuaucaugaccgaugguccuucgaacggggccgcgucuuacagaauuuucaagauagaaaaaggaagggugacaaaguccaucgagcuggacgcaccaaauuaucauuacgaagaguguucaugcuaccccgauaccggcacgguaauguguguuugccgggacaacuggcacggcaguaaucgcccuugggugagcuuuaaccagaaucuggauuaucaaauuggguacaucugcuccggagucuucggugacaacccacgaccgaaggauggcgaggggucuuguaaucccgugacuguggacggagccgacggcgucaaagguuuuagcuauagauacgggaacggcguuuggaucggaaggacaaagucaaaucggcuccguaaaggcuaugaaaugauuugggauccuaacggguggaccgacacugauagugacuucuccaugaagcaggauauaguggcuaugacagacuggagcggauacucugguucauuuguacagcacccagaguuaaccggccuggauugcaugcgccccuguuucuggguggaacuugucagaggguugccuagggagaauacgaccaucuggacaaguggaagcuccauuucuuuuugcggcgugaacucggacacugccaauuggagcuggccagauggugcagaacugcccuucaccaucgacaaauga

SEQ ID NO: 137770 - RNA, 1413 nt, Artificial Sequence
  derived and/or modified sequence opt3 from neuraminidase__InfluenzaA__ABO38024
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgagaauaacaccugggugaaucacacauaugucaacaucaauaacacuaauauuguugcagggaaagacaagaccucugugacacuugccggaaacucgucacuguguagcaucaguggcugggcgaucuacaccaaagauaauuccauuaggauagguucuaagggggacguauucgugauccgggaaccuuuuauuagcugcucccauuuggagugucgcacuuucuuuuuaacacaaggagcucugcuaaacgauaaacacucaaauggcaccgucaaggaccgaaguccauaucgugcccucaugagcugcccgcugggcgaagcacccucuccuuacaacuccaaguucgagucaguggccuggagcgcuagugcaugucaugaugggaugggauggcuuacgaucgguauaucuggcccagacaacggggccguugcugugcugaaauauaauggaauuaucacugaaaccaucaaguccuggaaaaagagaauuuugaggacacaggagagcgagugcgucugugugaacggcucgugcuuuacuaucaugaccgauggucccucuaauggggccgcguccuacaaaauuuucaagauagaaaagggaaaaguaacaaagucaaucgagcucaacgcaccuaauuuucacuaugaagaguguaguugcuacccagacaccggcacgguuaugugugugugccgggauaacuggcacggcagcaaucgccccugggucuccuucaaccagaaucuggacuaccagauuggguauaucugcucuggaguguuuggugauaacccuagaccaaaagacggcgaggggagcuguaauccggugacugucgauggagccgacggcguuaaggguuucucauacaaauaugggaacggcguguggaucggaaggacaaagaguaaucggcugcgcaaaggcuuugaaaugguaugggaccccaacggguggaccgauacugacuccgauuucagcgugaagcaagacgucguggcuauuacagauuggucuggauacucagguaguuuuguucagcauccugagcucaccggcuuagacugcauacgaccauguuucuggguggaacuggucagagggcuucccagggagaauacgaccaucuggacaagcggauccucuauuucguucugcggcgugaacagcgauacugccaacugguccuggccugacggugcagaauugccauuuaccaucgauaaguga

SEQ ID NO: 137771 - RNA, 1413 nt, Artificial Sequence
  derived and/or modified sequence opt3 from neuraminidase__InfluenzaA__ABO38035
augaaccccaaucagaagaucauuaccauaggcagcaucuccauugccaucgggauuaucucucugaugcuccaaauaggaaacaucauuucaaucugggcuagucacagcauucagacagguucccagaaucauacuggcacgugcaaccagagaaucauaaccuacgaaaauucuacaugggugaaccacacuuaugucaauauuaacaauaccaacguuguggcagggaaagacaagacaucgguaacccuugccggaaauucaagccuguguaguaucuccggcugggcgauuuacacuaaagauaacucuaucaggaucgguagcaagggggacguguucgucauucgggagccuuuuauauccugcucacauuuggagugucgcacauucuuuuuaacccaaggagcucugcuaaaugauaaacacaguaacggcacggugaaggaccgaagcccauaucgugcccucaugucuugcccgcugggcgaagcacccuccccuuacaauucaaaguucgagagcguugccuggagugcuucugcaugucaugaugggaugggauggcuuacuaucgguauuuccggcccagacaacggggccguggcuguccugaaauauaacggaaucauaaccgaaacaauuaagagcuggaaaaagagaaucuugaggacucaggagucggagugcguguguguaaauggcucuugcuuuaccaucaugacagauggucccuccaacggggccgcgucauacaaaauuuucaagaucgaaaagggaaaaguuaccaagaguauugagcucaaugcaccuaacuuucacuaugaagaguguagcugcuacccagacacgggcacugugaugugugucugccgggauaauuggcacggcuccaaccgccccugggugucuuucaaucagaaccuggacuaccagauaggguauaucugcagcggaguguuuggugauaauccuagaccaaaagacggcgaggggucauguaacccggucacaguugauggagccgacggcgugaaggguuucaguuacaaauaugggaauggcguauggauuggaaggaccaaguccaaccggcugcgcaaaggcuuugaagugaucugggaccccaauggguggacugauacagacagcgauuucucugucaagcaagacgugguugcuaucaccgauuggucaggauacagugguagcuuugugcagcauccugagcucacgggcuuagacugcauucgaccauguuucugggucgaacuggugagagggaugcccagggagaacaccacaauauggacuuccggaucuucgaucagcuucugcggcguaaauuccgauaccgccaacuggucauggccugacggugcagaacuuccauuuacaauugauaaguga

SEQ ID NO: 137772 - RNA, 1413 nt, Artificial Sequence; identical to SEQ ID NO: 136412
  derived and/or modified sequence opt3 from neuraminidase__InfluenzaA__ABO38046

SEQ ID NO: 137773 - RNA, 1413 nt, Artificial Sequence; identical to SEQ ID NO: 136967
  derived and/or modified sequence opt3 from neuraminidase__InfluenzaA__ABO38068

SEQ ID NO: 137774 - RNA, 1410 nt, Artificial Sequence; identical to SEQ ID NO: 136343
  derived and/or modified sequence opt3 from neuraminidase__InfluenzaA__ABO38079

SEQ ID NO: 137775 - RNA, 1410 nt, Artificial Sequence
  derived and/or modified sequence opt3 from neuraminidase__InfluenzaA__ABO38090
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaacgaacaccauaucguacucuucugaugaaugaguugggcguucccuuucaucucgguaccaaacagguguguaucgccuggucaagcaguuccugccacgaugggaaggcauggcugcaugucugugugacaggagacgaugaaaacgccaccgcuucuuucauuuacaauggcagacugguagacagcaucggcuccuggucaaagaaaauccucaggacgcaggagagugagugcguuuguauuaacgggacuugcacaguggucaugaccgauggaagcgcaucugguaaggccgacacuaaaauauuauuuaucgaagagggcaagauugugcacacaucccugcuuucagggagcgcucaacacguggaagagugcaguuguuauccucgguacccaggaguccgcugcguuuguagagauaacuggaagggcucuaauaggccgaucguggacauaaacguaaaagauuacuccauugugagcucguaugucugcucugguuuggugggggacacuccccggaagaaugacuccucaaguagcucccauugucuggauccuaacaaugaagagggaggccacggcguuaaagggugggccuucgacgauggaaacgacguguggaugggucgcacgaucucugagaagcuacgaagcggcuacgaaaccuuuaaagucaucgagggguggucaaagccaaauaguaaacuccagauuaacagacaggugaucguagauaggggaaaucgguccggcuauagcgguauuuucucuguugaagggaagucaugcauaaaccguuguuuuuacguggagcugauccgcggcagaaagcaggaaacagagguccuuuggaccaguaauagcauuguggucuucugcggaaccuccggcacauaugggacuggaucuuggcccgacggugcggauaucaaccugaugccuaucuga

SEQ ID NO: 137776 - RNA, 1410 nt, Artificial Sequence
  derived and/or modified sequence opt3 from neuraminidase__InfluenzaA__ABO38101
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuggcaaaugcuaucaguucgcccuggggcagggaacaacccuagacaacaagcacucaaauggcacgauccaugaucguauuccacaccgaacucuccugaugaacgagcuuggugugcccuuucaucuggggaccaagcaggucuguguggcauggagcaguuccucuugccacgacggaaaagccugguugcacguauguguuacaggcgaugacagaaaugcuacugccagcuucaucuacgauggcaggcucguggacuccaucgggucauggagucaaaacauucugcggacccaggaaagcgagugcgucuguauaaauggaacaugcaccguggugaugacggaugguucugcauccggccgcgcugacacuagaauccuguuuauuaaggaggggaaaaucguccauauaucaccucucagcggaagugcccagcacauugaagagugcucuuguuauccaagguacccggauguucggugcaucugucgcgacaacuggaagggcuccaaucgacccgugaucgacauuaacauggaagauuauagcaucgacucgucuuacguaugcuccgguuuagugggggauacaccuagaaacgacgauucaaguagcaauuccaacuguagggacccaaauaacgagcggggaaaucccggcgucaaaggcugggcguucgauaacggggacgauguguggaugggacguaccauuaauaaggacucucgcagcgguuacgaaacuuuuaagguuauaggcggguggucaacaccuaacaguaaaucccaggugaauagacaagucaucguggauaacaauaacuggagcggauauucuggcauuuucucaguagaggguaagaguugcaucaauagguguuuuuacguugagcugauccgggggcgaccacaggaaacccgcgugugguggacgagcaacuccauugucguguucugcggcaccucuggaacauauggcacugggucguggcccgacggagcaaauauaaacuuuaugccgaucuga

SEQ ID NO: 137777 - RNA, 1410 nt, Artificial Sequence
  derived and/or modified sequence opt3 from neuraminidase__InfluenzaA__ABO38233
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucaaagaacauacugcggacccaggagagugaaugcguuuguaucaaugggacgugcacuguggucaugacagauggaagcgcaucugagcgcgccgacaccaaaauucucuuuaucgaggaagguaagauagugcacauuuccccuuuaucaggcagcgcucaacauguggaggaaugcaguuguuauccaagauacccgggggucaggugcguuugucgggauaacuggaagggaucuaaucgccccgugguagacaucaacgugaaagacuacuccaucgccagcucguaugucugcucuggccuggugggugauacuccucgaaagaacgacagauacuccucaaguuauuguaggaauccaaacaaugagaaagggaaccacggaguuaagggcugggcguucgaugacggcaaugauguguggauggggcggacaauuagcgacgaaucccguucuggauacgagaccuuuaaagucaucgguggcuggagcacgcccaacucaaaacuucagauuaaucgccaggugauaguagauagugacaacagauccggguauagcggaaucuucucuguugagggcaagucaugcauuaauagguguuuuuacguggaauugauccggggucgagagcaggaaacccgcgucugguggacaaguaacagcaucguggucuucugcgggacuuccggcaccuauggaacaggcucuuggccugauggggcagacauuaaucugaugccaauauga

SEQ ID NO: 137778 - RNA, 1410 nt, Artificial Sequence; identical to SEQ ID NO: 137127
  derived and/or modified sequence opt3 from neuraminidase__InfluenzaA__ABO38244

SEQ ID NO: 137779 - RNA, 1410 nt, Artificial Sequence; identical to SEQ ID NO: 136343
  derived and/or modified sequence opt3 from neuraminidase__InfluenzaA__ABO38255

SEQ ID NO: 137780 - RNA, 1410 nt, Artificial Sequence; identical to SEQ ID NO: 136728
  derived and/or modified sequence opt3 from neuraminidase__InfluenzaA__ABO38277

SEQ ID NO: 137781 - RNA, 1410 nt, Artificial Sequence; identical to SEQ ID NO: 137755
  derived and/or modified sequence opt3 from neuraminidase__InfluenzaA__ABO38288

SEQ ID NO: 137782 - RNA, 1410 nt, Artificial Sequence
  derived and/or modified sequence opt3 from neuraminidase__InfluenzaA__ABO38299
augaaccccaaucagaagaucauuaccauaggcagcgugucccugacaaucgccacugucugcuucauuaugcaaaucgcuauucucgcaacgaccguuacacuucacuuuaaacagcaugagugugacucuccugccucaaaccaggugaugccaugcgaaccgaucauaaucgagagaaauauuacugaaaucguauaccugaacaauaccacaauugagaaggaaaucugucccgaggcgguggaguauaggaacuggaguaaaccucagugccaaauaaccggguucgcuccauuuagcaaggauaauuccauucgguugucugccggaggugacaucugggucacucgcgaacccuacgugucgugugauccuggcaaaugcuaucaguucgcauuagggcagggaacaacccuggacaacaagcacucaaauggcacgauucaugaucgaaucccacaccguacucuacucaugaacgagcuggguguucccuuucaucuugggaccaaacaggugugugucgccuggagcaguuccucuugccacgacggaaaggcuuggcugcacguguguguaacaggcgaugacagaaaugcaacugccagcuucaucuacgauggcagguugguugacuccauugggucauggagucaaaacauacuccggacccaggaaagcgagugcguguguaucaauggaacaugcaccgucgugaugacggaugguucugcuuccggccgcgccgacacuaggauucuguuuaucaaggaggggaaaauagugcauauuucaccucugagcggaagugcgcagcacgucgaagagugcucuuguuauccaagauacccggauguucggugcacaugucgcgacaacuggaagggcuccaaucgacccgugaucgacaucaacauggaagauuauagcauugacucgucuuacguaugcuccggucucgugggggauaccccuagaaacgacgauucaaguagcaauuccaacuguagggacccaaauaacgagcggggaaaucccggcgucaaaggcugggcauucgauaacggggacgauguguggaugggacguacuaucaauaaggacucucgcagcgguuacgaaacauuuaagguuauuggcggguggucaaccccuaacaguaaaucccaggugaauagacaagucauaguggauaacaauaacuggagcggauauucuggcaucuucucaguagaggguaagaguugcauuaauagguguuuuuacguugaguuaauccgggggcgaccacaggaaacgcgcgugugguggaccagcaacuccaucgucguguucugcggcacaucuggaacuuauggcaccgggucguggcccgacggagccaauauuaacuuuaugccgauauga

SEQ ID NO: 137783 - RNA, 1410 nt, Artificial Sequence
  derived and/or modified sequence opt3 from neuraminidase__InfluenzaA__ABO38310
augaaccccaaucagaagaucauuaccauaggcagcgugucccugacaaucgccacugucugcuuccucaugcaaauugcuauccuugcaacgaccguuacacugcacuuuaaacagcaugagugugacucuccuacuucaaaccaggugaugccaugcgaaccgauuaucauagagagaaauaucaccgaaauuguauacuugaacaauacaaccaucgagaaggaaauuugucccgagguggucgaguauaggaacuggaguaaaccucagugccaaaucacuggguucgccccauuuagcaaggauaauuccauacgguuaucugcgggaggugacauuugggugacacgcgaacccuacguuucgugugauccuggcaaaugcuaucaguucgcucuggggcagggaaccacgcuagacaacaagcacucaaauggcacuauccaugaucguauuccacaccgaacccuccugaugaacgagcuuggugugcccuuucaucuggggacaaagcaggucuguguggccuggagcaguuccucuugccacgacggaaaagcaugguugcacguauguguuacuggcgaugacagaaaugccaccgcuagcuucaucuacgauggcaggcucguggacuccaucgggucauggagucaaaacauucugcggacacaggaaagcgagugcgucuguauaaauggaaccugcacgguggugaugacugaugguucugcauccggccgcgccgacacaagaauccuguuuauuaaggaggggaaaaucguccauauaucaccucucagcggaagugcucagcacauugaagagugcucuuguuauccaagguacccggauguucggugcaucugucgcgacaacuggaagggcuccaaucgacccgugaucgacauuaacauggaagauuauagcaucgacucgucuuacguaugcuccgguuuagugggggauaccccuagaaacggagacucaaguagcaauuccaacuguagggauccaaauaacgagcggggcaaucccggcgucaaagggugggccuucgacaacggagaugacguguggaugggucguacuauuaauaaggaaucucgcagcggcuacgagacauuuaagguuauagggggauggucaaccccuaacaguaaaucccaggugaauagacaagucaucguggauaacaauaacuggagcggcuauucugguauuuucucaguagaggggaagaguugcaucaauagguguuuuuacguugaacugauccggggccgaccacaggagacgcgcgugugguggaccagcaacuccauugucguguucugcggaacaucuggcacuuaugggaccggaucguggcccgacggugcgaauauaaacuuuaugccgaucuga

SEQ ID NO: 137784 - RNA, 1413 nt, Artificial Sequence; identical to SEQ ID NO: 136946
  derived and/or modified sequence opt3 from neuraminidase__InfluenzaA__ABO38332

SEQ ID NO: 137785 - RNA, 1413 nt, Artificial Sequence
  derived and/or modified sequence opt3 from neuraminidase__InfluenzaA__ABO38343
augaaccccaaucagaagaucauuaccauaggcagcaucugcaugacaauugggaucauuucccugauccuccaaauaggaaacaucauuucuaucugggugucacacaguauucagacugguagccagaaucauacgggcaucuguaaccagagaauaauuaccuacgaaaauuccacaugggucaaccaaacuuauguuaauaucaacaauaccaacgugguagccgggaaagacacaaccucugugacucuugcuggaaauucgucacugugcccuauuaggggcugggcaaucuacagcaaggauaacaguauccggauugguuccaaaggggacgucuucgugauacgcgagccauuuaucucuuguagccacuuggagugccgaacauucuuuuuaacccagggagcccugcuaaaugauaagcauuccaacggcacgguuaaagaccguucaccguauagagcgcucaugaguugucccauuggcgaagcuccuagcccauacaauucuagguucgaguccguggccuggucagcaagcgccugccacgaugggaugggauggcugacuaucgguauaaguggccccgacgauggggcugucgcagugcuuaaguauaacggaauuaucaccgaaacaaucaagucuuggcggaaacgcauucugagaacucaggaguccgaguguguaugcguuaacggcagcuguuuuaccaucaugacagacgguccuucgaaugggccagccucuuacaggauuuucaagauagaaaaaggaaagaucaccaaauccauugaguuggaugcucccaacucacauuaugaagagugcaguuguuacccugacacgggcacugugaugugcgucugccgggauaauuggcacggcagcaaccgcccauggguguccuuuaaucagaaccucgacuaccaaaucggguauaucuguucuggaguguucggugauaauccgcgacccaaggacggcaaggggagcugcgacccugucacaguugauggagccgacggcgugaaagguuuuucauacagauaugggaacggcguauggauuggaaggaccaagaguaauuccagccggaaaggcuucgagaugauaugggauccaaacggguggacugacacagauucuaauuuucuggugaagcaggacgucguggcgaugaccgauuggucaggauacagugguagcuucguucagcaccccgaacugacgggccucgacuguaugcguccuugcuuuuggguggaguuaguccgcgggagaccaagggaaggaaccacaguguggacuuccgguucuucgaucagcuucuguggcguaaacuccgauaccgcaaauuggucauggcccgacggggccgagcugccguucacaauugauaaauga

SEQ ID NO: 137786 - RNA, 1410 nt, Artificial Sequence
  derived and/or modified sequence opt3 from neuraminidase__InfluenzaA__ABO38354
augaaccccaaucagaagaucauuaccauaggcagcaucugcaugguggucgggauuaucucccugauucuccaaaucggaaacauaaucucuauuuggaucucacacaguauucagacagguagccagaaucauacuggcaucuguaaccagaauauaauuacguacaaaaacuccaccuggguuaaucaaacauaugugaacaucucuaauacuaacguaguggccgggcaggacaccacaucggucauucuuaccggaaauucaagccugugcccuaucagaggcugggcuaucuacaguaaggauaacuccauuaggauagguucuaaaggggacguguucguuauccgggagccauuuauuagcuguucccacuuggaaugccgcacuuucuuuuuaacacagggagcacugcuaaaugaucgacauucaaacggcaccgugaaggaccguaguccguauagagcccucaugagcugucccgucggcgaggcgccuucuccauacaauuccagguucgaaucaguggcuuggagcgccagugcaugccacgaugggaugggauggcugacgaucgguauaucuggccccgacaacggggccguagcuguucuuaaauauaacggaauuaucacugagaccaucaaguccuggcggaagaaaauucugcgcacacaggaaagcgagugugcaugcgugaauggcucguguuuuacuaucaugaccgaugguccuucuaacggguuggccuccuacaagauuuucaaaauagagaagggaaaagucacaaagucaaucgaacucaaugcuccaaacagucauuaugaggaaugcagcuguuaccccgacaccggcaaggugaugugcgugugcagagauaauuggcacggcuccaacaggccuugggucucuuuugaccaaaaucuggauuaccagauuggguauaucuguagcggaguuuucggugacaacccacggccgaaagauggcacggggucaugcggacccguguacguagacggcgccaauggugugaagggguuuaguuaucgcuacggcaacggagucuggaucggccgaacuaaauccaauagcucuagacacggguucgagaugauuugggacccuaacggauggacagagaccgauucaaaguuuagugugaggcaggacguuguggcgaugacugauuggagcgguuauuccggcucuuucguccagcauccagaacugacagggcucgacuguaugcggcccugcuuuuggguggaguuaauacguggacgcccuaaagaaaauaccaucuggacgucgggcagcuccauuucauucugugguguaaacagugauaccguugacuggucuuggccagauggggcagagcugcccuucacaaucgacaaguga

SEQ ID NO: 137787 - RNA, 1413 nt, Artificial Sequence
  derived and/or modified sequence opt3 from neuraminidase__InfluenzaA__ABO38365
augaaccccaaucagaagaucauuaccauaggcagcaucugcauggccauugggaucauuucccugauccuccaaaugggaaacauaaucucuauuugggugucacacaguauccagacagguagccagaaucauacuggcauuuguaaccagagaaucauaacguacgaaaauuccaccugggucaaccaaacauauguuaauauuaacaauacuaacgugguagcugggaaagacaccacaucugugacccuugcaggaaauucgucacugugcccuaucaggggcugggccauuuacagcaaggauaacaguauccggaucgguuccaaaggggacgucuucgugauucgcgaaccauuuauaucuuguagccacuuggagugccgaacuuucuuuuuaacacagggagcgcugcuaaaugauaagcauuccaacggcaccguuaaagaccguucaccguauagagcucucaugaguugucccaucggcgaagccccuagcccauacaauucuagguucgaguccguggcauggucagccagcgcuugccacgaugggaugggauggcugacgauugguaucaguggccccgacgauggggcagucgccgugcuuaaguauaacggaauaauuacugaaaccaucaagucuuggcggaaacgcauccugagaacacaggaguccgaguguguaugcguuaacggcagcuguuuuacuauuaugaccgacgguccuucgaaugggccagcuucuuacaggaucuucaagauugaaaaaggaaagauaacaaaauccaucgaguuggaugcccccaacucacauuaugaagagugcaguuguuacccugacaccggcacggugaugugcgucugccgggauaauuggcacggcagcaaccgcccauggguguccuuuaaucagaaccucgacuaccaaauuggguauaucuguucuggaguguucggugauaauccgcgacccaaggacggcaaggggagcugcgacccugucacuguugauggagcggacggcgugaaagguuuuucauacagauaugggaacggcguauggaucggaaggacaaagaguaauuccagccggaaaggcuucgagaugauuugggauccaaacggguggaccgacacugauucuaauuuucuggugaagcaggacgucguggcaaugacagauuggucaggauacagugguagcuucguucagcaccccgaacugaccggccucgacuguaugcguccuugcuuuuggguggaguuaauacgcgggagaccaagggagaaaacgaccaucuggacauccggaucuucgauuagcuucuguggcgucaacuccgauacugccaauuggucauggcccgacggugcugagcugccguucaccaucgauaaguga

SEQ ID NO: 137788 - RNA, 1410 nt, Artificial Sequence
  derived and/or modified sequence opt3 from neuraminidase__InfluenzaA__ABO38376
augaaccccaaucagaagaucauuaccauaggcagcaucugcaugguggucgggauuaucucccugauucuccaaaucggaaacauaaucucuauuuggaucucacacaguauucagacagguagccagaaucauacuggcacguguaaccaguccaucauaaccuacaaaaauucuacauggguuaaccaaacuuaugugaauauuucgaacaccaauguaguggccgggaaggacacaaccucagucauccuugcuggaaacagcagucugugcccuauuagaggcugggcaaucuacuccaaagauaauggugugaggaucgggucuaagggagacguuuucgugauucgggagccauuuauaagcuguucccacuuggaaugccgcacuuucuuuuuaacacagggcgcccugcuaaacgauaaacauucaaauggcaccgucaaggaccgaaguccguaucgugcgcucaugagcugucccgugggggaggcuccuucuccauacaacuccagauucgaaucaguagccuggagcgcaagugccugccacgauggaauggguuggcugacgaucggcauuucugggcccgacgauggagcuguugcagugcuuaaguauaauggcaucauaacugagaccauuaaauccuggaggaaggaaauccugcggacacaggagagcgagugugccugcgucaacgguucguguuuuacuaucaugaccgacgggccuucuggaggcccagcuuccuacaaaauuuucaagaucgaaaaaggcaaggugacaaagucaauugaguuggaugcccccaacagucauuaugaagagugcagcuguuacccugacaccgggaaagugaugugcgucugccgcgauaauuggcacggauccaacagaccauggguuucuuuugaccagaaucucgauuaccaaauggguuauauauguagcggcguguucggggacaacccgaggcccaaggacggaaaaggcaauugcgguccuguauacguggauggggcgaacggcgucaagggauuuucauaucgguacggcaaugggguguggaucggacgcacgaaaaguaacuccagccgacaggguuucgagaugauuugggacccaaauggcuggacugaaacagauucuaacuuuuucguuaagcaggacguggucgcagugaccgauuggucaggguauaguggauccuuuguacagcaccccgagcugacuggccuggacuguaugagaccuugcuucuggguugaacucaucaggggucggccaaaagagaagacaaucuggaccuccgggucuucgauuagcuucuguggcgugaauagcgauacggucgacuggucauggcccgauggagccgaauuaccguuuaccauagacaaguga

SEQ ID NO: 137789 - RNA, 1410 nt, Artificial Sequence
  derived and/or modified sequence opt3 from neuraminidase__InfluenzaA__ABO38387
augaaccccaaucagaagaucauuaccauaggcagcaucugcaugguggucgggauuaucucccugauucuccaaaucggaaacauaaucucuauuuggaucucacacaguauucagacagguagccagaaucauacuggcaucuguaaccaguccauaauuacguacaaaaauucuaccuggguuaaccaaacauaugugaauaucucgaacacuaauguaguggccgggcaggacaccacaucagucauucuuaccggaaacagcagucugugcccuaucagaggcugggcuaucuacuccaaggauaaugguauuaggauagggucuaaaggagacguguucguuauccgggagccauuuauuagcuguucccacuuggaaugccgcacuuucuuuuuaacacagggcgcacugcuaaacgauaagcauucaaauggcaccgugaaagaccgaaguccguaucgugcccucaugagcugucccgucggggaggcgccuucuccauacaacuccagauucgaaucaguggcuuggagcgccagugcaugccacgauggaauggguuggcugacgaucggcauaucugggcccgacaaugaggccguagcuguucuuaaguauaacggaauuaucacugaaaccaucaaguccuggaggaaaaagauucugcggacacaggagagcgagugugcaugcgugaacggcucguguuuuacuaucaugaccgaugguccuucugacggguuggccuccuacaaaauuuucaagauagaaaaaggaaaggucacaaagucaaucgagcucaaugcuccaaacagucauuaugaagagugcagcuguuaccccgauaccggcaaagugaugugcgugugccgcgacaauuggcacggcuccaacagaccuugggucucuuuugaucaaaaucuggacuaccagauuggguauaucuguagcggaguuuucggugauaacccaaggccgaaggacggcacggggucaugcggacccguguacguagacggcgccaauggugugaaaggguuuaguuaucgguacggcaacggagucuggaucggccgcacuaaguccacaagcucucgacacggguucgagaugauuugggauccuaauggauggaccgaaacugacucaaaauuuagugugagacaggauguuguggcgaugacagacuggagcgguuauuccggcucuuucguccagcauccagagcugaccgggcucgauuguaugaggcccugcuuuuggguggaauuaauacggggacaaccuaaggagaaaacgaucuggaccucgggcagcuccauuucauucugugguguaaacagugacacaguugauuggucuuggccagacggggcagaacugcccuucacuaucgauaaguga

SEQ ID NO: 137790 - RNA, 1413 nt, Artificial Sequence
  derived and/or modified sequence opt3 from neuraminidase__InfluenzaA__ABO38398
augaaccccaaucagaagaucauuaccauaggcagcaucugcauggccauugggaucauuucccugauccuccaaauaggaaacaucgugucuauuuggaucucacacaguauucagacagguagccagaauuacacuggcaucuguaaccagagaauaauuacguaugaaaauuccaccugggucaaccaaacauacguuaauaucaacaauacuaacgugguagcugggcaggacaccacaucuguggcacuugccggaaauucgucacugugcccuauuagcggcugggcgaucuauaguaaagauaacuccaucaggauugguucuaagggggacgucuucgugauacgggagccauuuaucagcuguucccauuuggagugccgcaauuucuuuuuaacccagggagcucugcuaaacgauaaacacucaaauggcacuguuaaggaccgaaguccguaccgugcccucaugagcugucccauuggcgaagcaccuucuccauauaacuccagauucgagucaguggccuggagcgcuagugcaugccaugaugggaugggauggcugacaaucgguauaucuggccccgacgauggggccgucgcugugcuuaaauacaacggaauuaucaccgaaacgaucaaguccuggaggaagcggauucugcgcacucaggagagcgaguguguaugcguuaauggcucguguuuuaccaucaugacagacgguccuaacaaugggccagccucuuauaaaauuuucaagauagaaaaaggaaagaucacuaaauccauugaguuggaugcgcccaacucacacuacgaagagugcaguuguuacccugacgcaggcaccgugaugugcgucugcagagauaauuggcauggcagcaacaggccauggguguccuuuaaucaaaaccucgacuaucagaucggguacaucuguucuggaguguucggugauaauccgcggcccaaggacggcaaggggagcugcgacccugucacaguugauggagccgacggcgugaaagguuuuucauaucgcuacgggaacggcguauggauuggacgaaccaagaguaauuccagcagaaggggcuucgagaugauaugggauccaaacggguggacggacacugauucuaaauuucuggugaagcaggacgucguggcuaugacagauuggucaggauauagugguagcuucguucagcaccccgaacugaccggccucgacuguaugcggccuugcuuuuggguggaguuaauccgugggcgcccaagagaaaauacuacaauuuggaccuccggaucuucgaucagcuucuguggcgucaacggugauacggccaauugguccuggcccgacggggcagagcugccguucaccauugauaaauga

SEQ ID NO: 137791 - RNA, 1410 nt, Artificial Sequence; identical to SEQ ID NO: 136269
  derived and/or modified sequence opt3 from neuraminidase__InfluenzaA__ABO38420

SEQ ID NO: 137792 - RNA, 1410 nt, Artificial Sequence
  derived and/or modified sequence opt3 from neuraminidase__InfluenzaA__ABO38715
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgauuaucauagagagaaauaucacugaaauuguguacuugaacaauaccacaaucgagaaggaaaccugucccaaagucguggaguauaggaguuggagcaagccucagugcaaaauuacuggguucgccccauuuuccaaggauaacucuauccgguuaucggcgggaggugacauauggguuacacgcgagcccuacgugucaugugauccuggcaagugcuaucaauucgcucuggggcagggaaccacgcuagacaauaaacacagcaacgauacuauucaugaccgaaucccacaccguacccuccugaugaaugaacuuggcguccccuuucaucuggguacaagacagguguguauugccuggaguuccucuagcugccacgaugggaaggcaugguugcacguauguguuacuggagacgauaaaaacgccaccgcuuccuucaucuacgacggcaggcucguggauucaaucggcaguuggagccagaauauucugcggacacaagagucugaaugcgucuguauaaacgggaccugcacgguggugaugacugacggauccgcaucaggucgcgccgauacaagaauccuguuuauugaggagggcaagaucguccauauaagcccucucagugggucugcucagcacguugaagagugcuccuguuauccaagguacccggacgugcggugcauuugucgcgacaauuggaaaggaagcaaccgacccaucguagauaucaauauggaagacuauucgauugauucuuccuacgugugcucaggcuuagucggugacaccccuagaaacgaugacaggaguagcaacuccaauugucggaacccaaauaacgagcgugggaaucagggagugaagggcugggccuucgauaacggcgacgauguuuggauggggcgcacuaucucuaaggaccugagaagcggauacgaaacauuuaaagugauugguggcuggucaacccccaauaguaagucccagauaaacaggcaagucaucguggauagcgacaaucggucuggguauucaggaauuuucaguguagagggcaaaagcugcaucaaccgauguuuuuacguugagcuuauccgcgguagaaagcaggaaacgagggugugguggaccuccaauucuauugucguguucugcgggacaucgggcacuuauggaaccggcagcuggccugacggggcgaacauaaauuuuaugccaaucuga

SEQ ID NO: 137793 - RNA, 1410 nt, Artificial Sequence; identical to SEQ ID NO: 137792
  derived and/or modified sequence opt3 from neuraminidase__InfluenzaA__ABO38726

SEQ ID NO: 137794 - RNA, 1413 nt, Artificial Sequence
  derived and/or modified sequence opt3 from neuraminidase__InfluenzaA__ABO44049
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaucugugucugccgggauaauuggcacggcuccaaccgccccugggugucuuucaaucagaaccuggacuaccagauuggguauaucugcagcggaguguuuggugauaauccuagaccaaaagacggcgaggggucauguaacccggucacuguugauggagccgacggcgugaaggguuucaguuacaaauaugggaauggcguauggaucggaaggacaaaguccaaccggcugcgcaaaggcuuugaaaugauuugggaccccaauggguggaccgauacugacagcaacuucucugugaagcaagaugucguggcuauaacagacuggucaggauacagugguagcuuuguucagcauccugagcucaccggcuuagauugcauccgaccauguuucuggguggaacuggucagagggcuucccagggagaauacgaccauuuggacauccggaucuucgaucagcuucugcggcgugaacuccgacacugccaacuggucauggccugauggugcagaauugccauuuaccauugacaaguga

SEQ ID NO: 137795 - RNA, 1410 nt, Artificial Sequence
  derived and/or modified sequence opt3 from neuraminidase__InfluenzaA__ABO44060
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgauuaucauagagagaaauaucacugaaauuguguacuugaacaauaccacaaucgagaaggaaauuugucccaaagucguggaguauaggaacuggaguaagccucagugcaaaaucaccggguucgccccauuuagcaaggauaauuccauacgguuaucugcgggaggugacauuuggguuacucgcgagcccuacgugucgugugauccuggcaagugcuaucaauucgcucuggggcagggaacaacccuagacaacaaacacucaaaugauacgauccaugaccguauuccacaccgaacucuccugaugaacgaacuuggcguccccuuucaucuggguaccagacagguguguaucgccuggagcaguuccucuugccacgaugggaaggcaugguugcacguauguguuacaggagacgauaaaaaugccacugcuagcuucaucuacgacggcaggcucguggauuccauuggcucauggagucagaacauacugcggacccaagagagcgaaugcgucuguaucaaugggacaugcaccguggugaugacggacggaucugcauccggucgcgccgauacuaagauucuguuuaucgaggagggcaaaauaguccauauuucaccucucagcgggagugcucagcacguugaagagugcucuuguuauccaagauacccggacgugaggugcaucugucgggacaacuggaagggauccaaucgccccguaguggauaucaacauggaagacuauagcauugauucgucuuacgucugcuccggcuuagugggugacacaccucgaaacgaugacagaucaaguaauagcaacuguaggaauccaaacaaugagcgggggaaccagggaguuaagggcugggccuucgauaauggcgacgauguguggauggggcguaccaucuccaaagaccugcgcucuggauacgaaacuuuuaaggucauugguggcuggagcacacccaacucaaaaagucagauaaauagacaagugaucguagauuccgacaacaggagcggguauucuggaauuuucucaguugagggcaagaguugcaucaaucgguguuuuuacguggagcuuauccgaggucgcaaacaggaaaccagagucugguggacgagcaacuccauuguggucuucugcgggaccucuggcacauauggaacuggcucguggccugacggggcgaauauaaacuugaugccaaucuga

SEQ ID NO: 137796 - RNA, 1410 nt, Artificial Sequence
  derived and/or modified sequence opt3 from neuraminidase__InfluenzaA__ABO44071
augaaccccaaucagaagaucauuaccauaggcuucguguuucugacaaucgccacugucugcuuccucaugcaaauugcuauccuuguuacgaccgugacacugcacuuuaaacaguacgagugugacagcccugcauccaaccagguaaugccaugcgaaccgauuaucauagagagaaauaucacugaaauuguguauuugaacaauaccacaaucgagaaggaaauuugucccaaagucguggaguacaggaacuggucuaagccucagugccaaaucaccggguucgccccauuuucaaaagauaauaguauacgguuaagcgcgggaggugacauuuggguuacucgcgagcccuauguguccugugaucauggcaagugcuaccaguucgcucuggggcagggaacaacccuagacaacaagcacucuaaugauacgauccaugaccguauuccucaccgaacucuccugaugaacgaacuuggcgucccauuucaucuggguaccagacagguguguaucgccuggucgucaagcaguugccacgaugggaaagcaugguugcacguauguaucacaggagacgauaagaaugccacugcuuccuucauuuaugacggcaggcucguugauucuauaggcagcuggucccaaaacauccugcggacccaggagucagaaugcguguguauuaaugggacaugcaccgucgugaugacggacggaagugcaagcggucgcgccgauacuagaauccuguuuauagaggagggcaaaauugugcauaucucuccccucuccgggucagcucagcacgucgaagagugcagcuguuacccuagguauccaggaguucggugcaucugucgcgacaacuggaagggcaguaaucgaccggugguagacauuaacauggaagauuacucuaucgacuccagcuacgugugcucggguuuagucggggauacacccagaaacgacgauaggucuuccaauucaaacuguaaaaauccuaacaaugagcggggaaaccagggcgugaagggcugggccuucgacaauggggaugacguuuggaugggacguaccauuaguaaggaucugcgcagcgguuaugaaacuuuuaaagugauaggcgggugguccacaccaaacucuaagagccaaaucaauagacaggucauuguggacucagauaacaggaguggauacuccggcaucuucagcguagaggguaaaucuugcaucaaucgguguuuuuauguugagcuuauucgagggcgcaagcaggaaaccagagugugguggacgucaaacaguauagucguguucugcggcaccagcggaacauacggcacuggguccuggcccgacggagcgaauaucaacuucaugccuauuuga

SEQ ID NO: 137797 - RNA, 1410 nt, Artificial Sequence; identical to SEQ ID NO: 136362
  derived and/or modified sequence opt3 from neuraminidase__InfluenzaA__ABO44082

SEQ ID NO: 137798 - RNA, 1410 nt, Artificial Sequence
  derived and/or modified sequence opt3 from neuraminidase__InfluenzaA__ABO44093
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuggcaaaugcuaucaguucgcccuggggcagggaacaacccuagacaacaagcacucaaauggcacgauccaugaucguauuccacaccgaacucuccugaugaacgagcuuggugugcccuuucaucuggggaccaagcaggucuguguggcauggagcaguuccucuugccacgacggaaaagccugguugcacguauguguuacaggcgaugacagaaaugcuacugccagcuucaucuacgauggcaggcucguggacuccaucgggucauggagucaaaacauucugcggacccaggaaagcgagugcgucuguauaaauggaacaugcaccguggugaugacggaugguucugcauccggccgcgcugacacuagaauccuguuuauuaaggaggggaaaaucguccauauaucaccucucagcggaagugcccagcacauugaagagugcucuuguuauccaagguacccggauguucggugcaucugucgcgacaacuggaagggcuccaaucgacccguguuagacaucagcauggaagauuauucgauugacucuuccuacguaugcucaggucuggugggggauacaccuagaaacgacgauaguagcuccaacucuaauuguagggacccaaacaaugagcggggaaaccccggcgucaaaggcugggcguucgauaauggggacgauguguggaugggacguaccaucagcaaggaccuucgcucagguuacgaaacuuuuaagguuauuggcggguggaguacaccuaacuccaaaagccaggugaauagacaagucauaguggauaacaauaacuggucuggauauucaggcaucuucaguguagaggguaagagcugcauuaauagguguuuuuacguugaguugauccgggggcgaucccaggaaacccgcgugugguggacgucuaacucgaucgucguguucugcggcaccagcggaacauauggcacuggguccuggccagacggagcaaauauuaacuuuaugcccauauga

SEQ ID NO: 137799 - RNA, 1410 nt, Artificial Sequence
  derived and/or modified sequence opt3 from neuraminidase__InfluenzaA__ABO44104
augaaccccaaucagaagaucauuaccauaggcagcgccucccugacaaucgcuacugugugcuuccucaugcaaauugcaauccuugucacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccaaaguggucgaguauaggaacuggaguaagccucagugcaaaaucaccggguucgcgccauuuagcaaggauaauuccauacgguuaucugcuggaggugacauuugggugacucgcgagcccuacguuucgugugauccuggcaagugcuaucaauucgcccuggggcagggaacaacccuagacaacaaacacucaaaugauacgauccaugaccgaaucccacaccguacucuccugaugaacgaacuuggcgugcccuuucaucuggguaccagacaggucuguauugcauggagcaguuccucuugccacgaugggaaggccugguugcacguguguguaacaggagacgauaaaaaugcuacugccagcuucaucuacgacggcaggcucguugauuccauuggcucauggagucagaacauacugcggacccaagagagcgaaugcguguguaucaaugggacaugcaccgucgugaugacggacggaucugcauccggucgcgcugauacuaggauucuguuuaucgaggagggcaagauagugcauauuucaccucucagcgggagugcccagcacgucgaagagugcucuuguuauccaagauacccggacguucggugcaucugucgcgacaacuggaaaggauccaaucgacccgugguagauaucaacauggaagacuauagcauugauucgucuuacgugugcuccggcuuagucggugacacaccuagaaacgaugacaggucaaguaauagcaacugucggaauccaaacaaugagaaggggaaccagggagugaagggcugggcguucgauaauggcgacgauguuuggauggggcguaccaucuccaaagaccugcgcucuggauacgaaacuuuuaaggugauugguggcuggagcacacccaacucaaaaagucagauaaauagacaagucaucguggauuccgacaacaggagcggguauucuggaauuuucucaguagagggcaagaguugcaucaaucgguguuuuuacguugagcuuauccgaggucgcaaacaggaaaccagagugugguggacgagcaacuccauugucguguucugcgggaccucuggcacauauggaacuggcucguggccugacggggcaaauauaaacuugaugccaaucuga

SEQ ID NO: 137800 - RNA, 1413 nt, Artificial Sequence
  derived and/or modified sequence opt3 from neuraminidase__InfluenzaA__ABO44126
augaaccccaaucagaagaucauuaccauaggcagcaucugcauggccauugggaucauuucccugauccuccaaauaggaaacaucgugucuauuuggaucucacacaguauucagacagguagccagaauuacacuggcaucuguaaccagagaauaauuacguaugaaaauuccaccugggucaaccaaacauacguuaauaucaacaauacuaacgugguagcugggcaggacaccacaucuguggcacuugccggaaauucgucacugugcccuauuagcggcugggcgaucuauaguaaagauaacuccaucaggauugguucuaagggggacgucuucgugauacgggagccauuuaucagcuguucccauuuggagugccgcaccuucuuuuuaacucagggagcucugcuaaaugauaaacacucaaacggcacaguuaaggaccgaaguccguaccgugcccucaugagcugucccauuggcgaagcaccuucuccauauaauuccagauucgagucaguggccuggagcgcuagugcaugccaugaugggaugggauggcugaccaucgguauaucuggccccgacgauggggccgucgcugugcuuaaauacaacggaauuaucacggaaacuaucaaguccuggaggaagcggauucugcgcacccaggagagcgaguguguaugcguuaacggcucguguuuuacaaucaugacugacgguccuaauaacgggccagccucuuauaaaauuuucaagauagaaaaaggaaagaucaccaaauccauugaguugaaugcgcccaacucacacuacgaagagugcaguuguuacccugaugcaggcacagugaugugcgucugcagagacaauuggcauggcagcaacaggccauggguguccuuuaaucaaaaccucgauuaucagaucggguacaucuguucuggaguguucggugacaauccgcggcccaaggauggcaaggggagcugcggaccugucaccguugacggcgccgacggugugaaaggguuuucauaucgcuacggcaacggaguauggauuggccgaacgaagaguaauuccagcagaaggggguucgagaugauaugggauccaaacggauggacugacacagauucuaaauuucuggugaagcaggacgucguggcuaucaccgauuggucagguuauaguggcagcuucguucagcaccccgaacugacugggcucgacuguaugcggccuugcuuuuggguggaguuaauucguggacgcccaagagaaaauacaaccaucuggacguccgguucuucgauuagcuucuguggcgucaacggggauaccgccaauugguccuggcccgacggcgcagagcugccguucacaaucgauaaauga

SEQ ID NO: 137801 - RNA, 1413 nt, Artificial Sequence
  derived and/or modified sequence opt3 from neuraminidase__InfluenzaA__ABO52228
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaaccaaacauaugucaauauuaacaauacuaacguuguggcagggaaagacaagaccucgaugacacuugccggaaauucaagccuguguccuaucaggggcugggcgaucuacaccaaagauaacaguauucggauagguuccaagggggacguauucgugauccgcgagccauuuauuucuugcagccacuuggagugucgaacuuucuuuuuaacacagggagcucugcuaaaugauaaacauuccaacggcaccgucaaggaccguucaccguauagagcccucaugaguugcccccugggcgaagcaccuagcccauacaauucuaaguucgaguccguggccuggucagcuagcgcaugucacgaugggcuuggauggcugacgaucgguauaaguggccccgacaacggggccguugcuguguugaaauauaacggaauuaucacugaaaccaucaagucuuggaaaaagaggauucuccggacacaggaguccgagugcgucuguaugaauggcagcugcuuuacuaucaugaccgaugguccuucgaacggggccgcgucuuaccgcauuuucaaaauagaaaagggaagagugacaaaguccaucgagcuggacgcaccaaauuaucauuacgaagaguguucaugcuaccccgauaccggcacgguaauguguguuugcagggacaacuggcacggcaguaaucggccuugggugagcuuuaaccagaaucuggauuaucaaauuggguacaucugcuccggagucuucggugacaacccacgcccgaaagauggcgaggggucuuguaaucccgugacuguggacggagccgacggcgucaaggguuuuagcuaucgauacgggaacggcguuuggaucggaagaacaaaaucaaauaggcuccggaagggcuucgaaaugauuugggauccuaacggguggaccgacacugauagugacuuuuccaugaaacaggauauaguggcuaugacagacuggagcggauauucugguucauucguacagcacccagaguuaaccggccuggauugcaugcgucccuguuuuuggguggaacuuguccgcggguugccuagagagaauacgaccaucuggacaaguggaagcuccauuucuuucugcggcgugaacucggacacugccaauuggagcuggccagauggugcagaacugcccuucaccaucgacaaguga

SEQ ID NO: 137802 - RNA, 1410 nt, Artificial Sequence
  derived and/or modified sequence opt3 from neuraminidase__InfluenzaA__ABO52239
augaaccccaaucagaagaucauuaccauaggcagcgugucccugacaaucgccacugucugcuucauuaugcaaaucgcuauucucgcaacgaccguuacacuucacuuuaaacagcaugagugugacucuccugccucaaaccaggugaugccaugcgaaccgaucauaaucgagagaaauauuacugaaaucguauaccugaacaauaccacaauugagaaggaaaucugucccgaggcgguggaguauaggaacuggaguaaaccucagugccaaauaaccggguucgcuccauuuagcaaggauaauuccauucgguugucugccggaggugacaucugggucacucgcgaacccuacgugucgugugauccuggcaaaugcuaucaguucgcauuagggcagggaacaacccuggacaacaagcacucaaauggcacgauucaugaucgaaucccacaccguacucuacucaugaacgagcuggguguucccuuucaucuugggaccaaacaggugugugucgccuggagcaguuccucuugccacgacggaaaggcuuggcugcacguguguguaacaggcgaugacaagaaugcaacugccagcuucaucuacgauggcagauugguugacuccauugggucauggagucaaaacauacucaggacccaggaaagcgagugcguguguaucaauggaacaugcaccgucgugaugacggaugguucugcuuccggccgggccgacacucgcauucuguuuaucaaagaggggaagauagugcauauuucaccucugagcggaagugcgcagcacgucgaagagugcucuuguuauccaagauacccggauguuaggugcaucugucgggacaacuggaaaggcuccaaucgccccgugaucgacauuaacauggaagauuauagcaucgacucgucuuacguaugcuccggucucgugggggauacaccucgaaacgacgauucaaguagcaauuccaacuguagagacccaaauaacgagaggggaaaucccggcgucaagggcugggcauucgauaacggggacgauguguggaugggacggaccauuaauaaggacucucguagcgguuacgaaacuuuuaaaguuauaggcggguggucaacaccuaacaguaagucccaggugaaucgccaagucaucguggauaacaauaacuggagcggauauucuggcauuuucucaguagaggguaaaaguugcaucaauagauguuuuuacguugaguuaaucagggggcggccacaggaaacccgagugugguggacgagcaacuccauugucguguucugcggcaccucuggaacauauggcacugggucguggcccgacggagccaauauaaacuuuaugccgaucuga

SEQ ID NO: 137803 - RNA, 1410 nt, Artificial Sequence; identical to SEQ ID NO: 137799
  derived and/or modified sequence opt3 from neuraminidase__InfluenzaA__ABO52250

SEQ ID NO: 137804 - RNA, 1413 nt, Artificial Sequence
  derived and/or modified sequence opt3 from neuraminidase__InfluenzaA__ABO52261
augaaccccaaucagaagaucauuaccauaggcagcaucugcauggccauugggaucauuucccugauccuccaaauaggaaacaucauuucuaucugggugucacacaguauucagacagguagccagaaucauacuggcaucuguaaccagagaauaauuacguacgaaaauuccaccugggucaaccaaacauauguuaauaucaacaauacuaacgugguagcugggaaagacaccacaucugugacccuugcaggaaauucgucacugugcccuauuaggggcugggccaucuacagcaaggauaacaguauccggauugguuccaaaggggacgucuucgugauacgcgaaccauuuaucucuuguagccacuuggagugccgaacuuucuuuuuaacacagggagcgcugcuaaaugauaagcauuccaacggcaccguuaaagaccguucaccguauagagcucucaugaguugucccauuggcgaagccccuagcccauacaauucuagguucgaguccguggcauggucagccagcgcuugccacgaugggaugggauggcugacgaucgguauaaguggccccgacgauggggcagucgccgugcuuaaguauaacggaauuaucacugaaaccaucaagucuuggcggaaacgcauucugagaacacaggaguccgaguguguaugcguuaacggcagcuguuuuacuaucaugaccgacgguccuucgaaugggccagcuucuuacaggauuuucaagauagaaaaaggaaagaucacaaaauccauugaguuggaugcccccaacucacauuaugaagagugcaguuguuacccugacaccggcacggugaugugcgucugccgggauaauuggcacggcagcaaccgcccauggguguccuuuaaucagaaccucgacuaccaaaucggguauaucuguucuggaguguucggugauaauccgcgacccaaggacggcaaggggagcugcgacccugucacuguugauggagcggacggcgugaaagguuuuucauacagauaugggaacggcguauggauuggaaggacaaagaguaauuccagccggaaaggcuucgagaugauaugggauccagacggguggaccgauacugacucuaacuuucuggugaagcaggaugucguggcaaugacagacuggucaggauacagugguagcuucguucagcaccccgaacugaccggccucgauuguauccguccuugcuuuuggguggaguuaauucgcgggagaccaagggagaaaacgaccaucuggacauccggaucuucgauuagcuucuguggcgucaauuccgacacugugaacuggucauggcccgauggugccgagcugccguucaccaucgacaaguga

SEQ ID NO: 137805 - RNA, 1413 nt, Artificial Sequence
  derived and/or modified sequence opt3 from neuraminidase__InfluenzaA__ABO52283
augaaccccaaucagaagaucauuaccauaggcagcaucugcaugacaauugggacuaucucccugauucuccaaaucggaaacauaaucucuauuuggaucucacacaguauucagacggguagccagaaucauaccggcaucuguaaccagagaauaauuacauacgagaauaacacuugggugaaucaaaccuaugucaacaucuccaauacaaacguuguggccgggaaagacaccacuucuaugauucuugcuggaaauucgucacugugcccuaucaggggcugggcaaucuacagcaaggauaacaguauucggauagguuccaaaggggacguauucgugauccgcgaaccauuuauuucuuguagccacuuggagugccgaacauucuuuuuaacccagggagcccugcuaaaugauaagcauuccaacggcacggucaaagaccguucaccguauagagcgcucaugaguugucccaucggcgaagcuccuagcccauacaauucuagguucgaguccguggccuggucagcaagcgccugccacgaugggaugggauggcugacuauagguauuaguggccccgacgauggggcuguugcagugcuuaaguauaacggaaucaucaccgaaauuaucaagucuuggcggaaacagauucugcgcacacaggaguccgagugugucugcgugaacggcagcuguuuuacuauaaugaccgacgguccuucggaugggccagccucuuacagaaucuucaagauugaaaaaggaaagaucacaaaauccaucgaguuggacgcucccaauucacauuaugaagagugcaguuguuacccugauaccggcaagguaaugugcguuugcagggacaacuggcacggcagcaaucggccauggguguccuuuaaccaaaaucucgauuaccagauuggguauauauguucuggagucuucggugacaacccgcgccccaaggacggcaaagggagcugcgauccugugaauguggacggagccgauggcgucaaggguuuuucauaccgauauggggacggcguuuggaucggaagaacgaaaaguaacuccagcaggaagggcuucgagaugauuugggauccaaauggguggacugacacagaugacaacuuucuggugaaacaggauguaguggcgaugaccgacuggucuggauacucagguaguuucguccagcaccccgaacugacuggccucgauuguaugcggccuugcuuuuggguggaguuaauccgugggcgcccaagagaaaagacaaccauuuggacgagcggauccucuaucucguucuguggcguuaauagcgacaccgugaacugguccuggcccgacggugcagagcugccguucacaauagauauguga

SEQ ID NO: 137806 - RNA, 1410 nt, Artificial Sequence; identical to SEQ ID NO: 137534
  derived and/or modified sequence opt3 from neuraminidase__InfluenzaA__ABO52294

SEQ ID NO: 137807 - RNA, 1410 nt, Artificial Sequence
  derived and/or modified sequence opt3 from neuraminidase__InfluenzaA__ABO52316
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucagaucaugccaugcgaaccgacuauaaucgagagaaacauuaccgaaaucguguauuugacaaauauuaccaucgagaaggaaauaugucccaaauuaguagaguacaggaacuggucaaagccucagugcaaaauuacuggguucgccccauuuaguaaggauaauagcauccggcuguccgcgggaggugacauuugggugacacgcgagcccuaugucucuugugauccuucgcgaugcuaccaauucgcucuaggccaggggaccacgcucgacaacaagcauucaaaugauacuauccacgaccguaccccacauagaacacugcuuaugaacgaacugggagugcccuuucacuugggcacuaggcagguuuguaucgccuggagcaguuccucuugccaugaugguaaagcauggcuccacgugugugucaccggguaugacaagaaugccacagcuagcuucauuuacgauggacggcugguggacuccauaggcucauggagucagaacauccugcgcacccaagagagcgaaugcguauguauuaauggcacgugcacuguugugaugacagaugggucugcauccgguagagccgacaccaaaauccucuuuauagaggagggaaagauuguccacaucucaccuuuaagcggcagugcucagcauguggaagagugcucuuguuauccaagguacccgggggugcggugcaucugucgcgauaacuggaaaggauccaaucgacccgucguugacauuaacgugaaggacuacagcaucgauucgucuuauguaugcuccggccuggugggugacacuccuagaaagaacgauaggucaaguaauagcuacugucggaacccaaauaacgaaaaagggaaucacggagucaagggcugggccuucgacgauggcaacgacguguggauggggcguacaauuuccgaggauucucgcagcggauaugaaaccuuuaaaguuauagguggcuggucaacgcccaauaguaaacuucagaucaacagacaggugauugucgacuccgauaauaggagcggguacucuggaaucuucucaguggagggcaagaguugcaucaaccgguguuuuuauguagaguugauucgaggucgcgaacaagagaccagaguuugguggacaagcaauuccauaguggucuucugcgggacuucuggcaccuacggagcgggcucguggccugacggggcagauaucaaccugaugccaauuuga

SEQ ID NO: 137808 - RNA, 1410 nt, Artificial Sequence; identical to SEQ ID NO: 136130
  derived and/or modified sequence opt3 from neuraminidase__InfluenzaA__ABO52327

SEQ ID NO: 137809 - RNA, 1410 nt, Artificial Sequence
  derived and/or modified sequence opt3 from neuraminidase__InfluenzaA__ABO52338
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucaaagaacauacugcggacccaggagagugaaugcguuuguaucaaugggacgugcacuguggucaugacagauggaagcgcaucuggucgcgccgacaccaaaauucucuuuaucgaggagggcaagauagugcacauuuccccuuuaucagggagcgcucaacauguggaagagugcaguuguuauccaagauacccgggagucaggugcaucugucgggauaacuggaagggcucuaaucgccccguuguggacaucaacguaaaagacuacuccauugauagcucguaugugugcucuggucuggucggggacacuccucgaaacaaugauagauccucaaguagcuacuguaggaacccaaauaacgaaaagggaaaucacggcgugaaaggcugggccuucgacgaugggaacgacguuuggaugggacggacaaucuccgaggauucucguagcgguuaugaaaccuuuaaggugauuggcggguggucaacgcccaauaguaaacuucagauaaaccgccaggucaucguggacuccgauaauagaagcggauacucuggcauuuucucaguagaggguaagaguugcaucaacagguguuuuuauguugaguugauccgggggcgagaacaggagacccgcgugugguggacaagcaauuccauugucguguucugcggcacuucuggaaccuacggcacagggucguggccugacggagcggauauaaaccugaugccaaucuga

SEQ ID NO: 137810 - RNA, 1410 nt, Artificial Sequence
  derived and/or modified sequence opt3 from neuraminidase__InfluenzaA__ABO52349
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacguaacugaaauuguguauuugaccaauacaaccaucgagaaggaaauuugucccaaauuagucgaguacaggaacuggucaaagccucagugcaaaaucacuggguucgccccauuuaguaaggauaauagcauacggcuguccgcgggaggugacauuugggugacacgcgagcccuauguuucuugugauccuggcaagugcuaccaauucgcucuagggcagggaaccacgcucgacaacaaacauucgaaugauacuauccacgaccgaaccccauaucguacacugcuuaugaacgaacugggcgugcccuuucauuuggguacuagacaggucuguauugccuggucaagcaguuccugccacgaugggaaggcauggcuccauguguguguaaccggauacgacaaaaaugccacagcuucuuucaucuaugauggcaggcugguugacagcaucggcuccuggucaaagaacauucugcggacccaggagagugaaugcguguguauaaaugggacgugcacugucgugaugacagauggaagcgcaucugagcgcgccgacaccaaaauccucuuuauugaggaagguaagaucauacacauuuccccuuuaucaggcagcgcucaacacguggaggaaugcaguuguuacccaagauacccgggggucaggugcaucugucgggauaacuggaagggaucuaaucgccccguuguggacaucaacaugcgagacuauuccauuguaagcucguacgugugcucuggccuggucggugauacuccuaggaaaaacgacagauccucaaguagcuauugucggaauccaaacaaugagaaggggaaccauggagugaaaggcugggccuucgaugacggcaaugauguuuggauggggcguacaaucuccgaagagucucgcagcggauacgagaccuuuaaggugauugguggcuggucaacgcccaacaguaaacuucagauaaauagacaggucaucguggacuccaacaauaggagcggguauucuggaauuuucucaguagaaggcaagaguugcaucaaccgguguuuuuacguugaguugauccgaggucgcgaacaggagaccagagugugguggacaagcaauuccauugucguguucugcgggacuucuggcaccuauggaacaggcucguggccugauggggcggacauaaaccugaugccaaucuga

SEQ ID NO: 137811 - RNA, 1410 nt, Artificial Sequence
  derived and/or modified sequence opt3 from neuraminidase__InfluenzaA__ABO52360
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugaucauggcaagugcuaccaguucgcucuggggcagggaacaacccuagacaacaagcacucaaaugauacgauccaugaccguauuccucaccgaacucuccugaugaacgaacuuggcgucccauuucaucuggguaccagacagguguguaucgccuggagcaguuccucuugccacgaugggaaagcaugguugcacguauguaucacaggagacgauaagaaugccacugcuagcuucauuuaugacggcaggcucguugauuccauaggcucauggagucaaaacauccugcggacccaggagagcgaaugcguguguauuaaugggacaugcaccgucgugaugacggacggaucugcauccggucgcgccgauacuagaauccuguuuauagaggagggcaaaauugugcauaucucaccccucagcgggagugcucagcacgucgaagagugcucuuguuacccuagguauccaggaguucggugcaucugucgcgacaacuggaagggcuccaaucgaccggugguagacauuaacauggaagauuacagcaucgacucgucuuacgugugcuccgguuuagucggggauacacccagaaacgacgauaggucaaguaauagcaacugucggaauccuaacaaugagcguggaaaccagggcgugaaaggcugggccuucgacaaugggaacgauguuuggaugggacgcaccauuuccaaggaccugagaucugguuaugaaacuuuuaaggugauaggcggguggagcacaccaaauucaaaaagucaaaucaacaggcaggucauuguggauuccgacaaucggagcggauacucuggcaucuucucaguagaggguaagaguugcaucaaccgauguuuuuauguugagcuuauucgcgggagaaaacaggaaaccagggugugguggacgagcaauuccauagucguguucugcggcaccucuggaacauacggcacugggucguggcccgauggagcgaacaucaauuuuaugccuauuuga

SEQ ID NO: 137812 - RNA, 1410 nt, Artificial Sequence
  derived and/or modified sequence opt3 from neuraminidase__InfluenzaA__ABO52371
augaaccccaaucagaagaucauuaccauaggcagcgugucccugacaaucgccacugucugcuuccucaugcaaauugcuauccuuguuacgaccgugacacugcacuuuagacaguacgagugugacucuccugcaaacaaucagguaaugccaugcgaaccgauuaucauagagaggaacaucacugaaauuguguauuugaauaacaccacaaucgagaaagaaauuugucccaaguuagucgaguaccggaauuggucaaaaccucagugcaagaucaccggguucgccccauuuaguaaagauaacagcauacgccuguccgcgggaggugacauuugggugacucgagagcccuauguuucuugugauccuggcaagugcuaccaauucgcucuagggcagggaacaacccucgacaauaagcauucgaacgauacgauccacgaccguauuccacauagaacucugcuuaugaaugaacugggcgugcccuuucacuuggguaccaggcaggucuguaucgccuggucaagcaguuccugccaugaugggaaagcauggcuccacguguguguaacaggagacgauaagaacgccacugcuucuuucaucuaugacggcaaacugguugauagcauuggcuccuggucacagaauauacugcggacccaagagagugaaugcguguguaucaacgggacaugcaccgucgugaugacggacggaagcgcaucuggucgcgccgauacuaggauucucuuuaucgaggagggcaagauagugcacauuuccccuuuaucagggagcgcucagcaugucgaagagugcaguuguuacccaagguauccgggaguucggugcaucugucgcgacaauuggaaaggcucuaaccgacccgugguagacaucaacguggaagauuacuccauugacagcucguacgucugcucuggucuggugggggauacaccuagaaauaacgacagguccggaaauucaaacugucggaauccaaacaaugagcguggcaaccacggcguuaaggggugggccuucgaugacggaaaugauguguggaugggucgcaccaucaacaaggaccuuagaaguggcuaugaaacuuuuaaagucauugggggauggagcacacccaauuccaagucucagauaaacagacaggugaucguagauagcgacaaucggucaggcuacagugguauuuucuccguugaggggaaaagcugcaucaaccgauguuuuuauguggaguugauccgcggcagagaacaagagaccagggucugguggacgucuaauucaauuguggucuucugcggaaccaguggcacauacgggacuggaagcuggccugauggugcggacauaaaccugaugccaaucuga

SEQ ID NO: 137813 - RNA, 1413 nt, Artificial Sequence
  derived and/or modified sequence opt3 from neuraminidase__InfluenzaA__ABO52800
augaaccccaaucagaagaucauuaccauaggcagcaucugcaugacaauugggaucauuucccugauccuccaaauaggaaacaucauuucuaucugggugucacacaguauucagacugguagccagaaucauacgggcaucuguaaccagagaauaauuaccuacgaaaauuccacaugggucaaccaaacuuauguuaauaucaacaauaccaacgugguagccgggaaagacacaaccucugugacucuugcuggaaauucgucacugugcccuauuaggggcugggcaaucuacagcaaggauaacaguauccggauugguuccaaaggggacgucuucgugauacgcgagccauuuaucucuuguagccacuuggagugccgaacauucuuuuuaacccagggagcccugcuaaaugauaagcauuccaacggcacgguuaaagaccguucaccguauagagcgcucaugaguugucccauuggcgaagcuccuagcccauacaauucuagguucgaguccguggccuggucagcaagcgccugccacgaugggaugggauggcugacuaucgguauaaguggccccgacgauggggcugucgcagugcuuaaguauaacggaauuaucaccgaaacaaucaagucuuggcggaaacgcauucugagaacucaggaguccgaguguguaugcguuaacggcagcuguuuuaccaucaugacagacgguccuucgaaugggccagccucuuacaggauuuucaagauagaaaaaggaaagaucaccaaauccauugaguuggaugcucccaacucacauuaugaagagugcaguuguuacccugacacgggcacugugaugugcgucugccgggauaauuggcacggcagcaaccgcccauggguguccuuuaaucagaaccucgacuaccaaaucggguauaucuguucuggaguguucggugauaauccgcgacccaaggacggcaaggggagcugcgacccugucacaguugauggagccgacggcgugaaagguuuuucauacagauaugggaacggcguauggauuggaaggaccaagaguaauuccagccggaaaggcuucgagaugauaugggauccaaacggguggacugacacagauucuaauuuucuggugaagcaggacgucguggcgaugaccgauuggucaggauacagugguagcuucguucagcaccccgaacugacgggccucgacuguaugcguccuugcuuuuggguggaguuaauccgcgggagaccaagggaacggaccacaauuuggacuuccggaucuucgaucagcuucuguggcgucaacuccgauaccgcaaauuggucauggcccgacggugccgagcugccguucacaauugauaaauga

SEQ ID NO: 137814 - RNA, 1413 nt, Artificial Sequence; identical to SEQ ID NO: 136844
  derived and/or modified sequence opt3 from neuraminidase__InfluenzaA__ABP49220

SEQ ID NO: 137815 - RNA, 1413 nt, Artificial Sequence
  derived and/or modified sequence opt3 from neuraminidase__InfluenzaA__ABP49319
augaaccccaaucagaagaucauuaccauaggcagcaucugcauggccauugggaucauuucccugauccuccaaauaggaaacaucauuucuaucugggugucacacaguauucagacagguagccagaaucauacuggcaucuguaaccagagaauaauuacguacgagaauaacaccugggucaaucaaacauauguuaacaucuccaauacuaacgugguagcugggaaagacaccacaucuaugauucuugcaggaaauucgucacugugcccuaucaggggcugggccaucuacagcaaggauaacaguauucggauagguuccaaaggggacguguucgucauccgcgaaccauuuauuucuuguagccacuuggagugccgaaccuucuuuuuaacucagggagcgcugcuaaaugauaagcauuccaacggcacagugaaagaccguucaccguauagagcucucaugaguugucccaucggcgaagccccuagcccauacaauucuagguucgaguccguugcauggucagccagcgcuugccacgaugggaugggauggcugaccauagguauuaguggccccgacgauggggcaguggccguccuuaaguauaacggaaucaucacggaaacuauuaagucuuggcggaaacagauccugcgcacccaggaguccgagugugugugcguaaacggcagcuguuuuacaauuaugacugacgguccuucggaugggccagcuucuuacagaauauucaagaucgaaaaaggaaagauuaccaaauccaucgaguuggacgcccccaauucacauuaugaagagugcaguuguuacccugauacaggcaagguuaugugcgugugcagggacaacuggcacggcagcaaucggccaugggucuccuuuaaccaaaaucucgauuaccagaucggguauauuuguucuggaguguucggugacaacccgcgccccaaggacggcaaagggagcugcgauccugugaaugucgacggagcggauggcguuaaggguuuuucauaccgauaugggaacggcguguggauaggaagaaccaaaaguaauuccagcaggaagggcuucgagaugaucugggacccaaacggguggacggauacugacggaaauuuucugguaaaacaggauguggucgcaaugacagacuggucugguuacucaggcaguuucgugcagcaccccgaacugaccgggcucgauuguaugcggccuugcuuuuggguugaguuaauucguggacgcccaagagaaaagacuacaaucuggaccagcggcuccucuauuucguucuguggugugaacagcgacacggucaauugguccuggcccgauggggccgagcugccguucaccaucgacaaauga

SEQ ID NO: 137816 - RNA, 1410 nt, Artificial Sequence
  derived and/or modified sequence opt3 from neuraminidase__InfluenzaA__ABP49330
augaaccccaaucagaagaucauuaccauaggcagcaucugcaugguggucgggauuaucucccugauucuccaaaucggaaacauaaucucuauuuggaucucacacaguauucagacagguagccagaaucauacuggcaucuguaaccaguccauaauuacguacaaaaauucuaccuggguuaaccaaacauaugugaauaucucgaacacuaauguaguggccgggaagggaaccacaccugucauucuugcuggcaacucaagccugugcccaaucagagguugggcaaucuacaguaaagacaaugggauuaggauaggauccaagggcgauguguucguuauccgggagccguuuauuucuuguagccacuuggaaugccgcaccuucuuuuuaacucagggcgcccugcuaaacgacaaacauuccaaugggacagugaaggaucgaucacccuaucgugcgcucaugaguuguccugucggagaggcuccaagccccuacaacucuagauucgaauccguggccuggucagcaugcgccugucacgacgguaugggcuggcugaccaucgggauaagcggaccugaugacgaggcuguagcaguucuuaaguauaauggcauuaucacggaaacuaucaaaaguuggaggaagaaaauucugcggacccaggagucugagugcgugugugucaacgguuccugcuuuacaaucaugacugaugggccaagcgacggacccgccucguacaagauuuucaaaauagaaaagggcaaggugaccaaaucuaucgaguuggaugcuccuaacucccauuaugaagaguguucaugcuacccagacacaggcaaggugaugugcgucugucgcgauaauuggcacgggaguaacagaccguggguuagcuuugaccagaaucucgauuaccaaauuggauauaucugcuccgguguguucggcgacaaccccaggccuaaagacgggaagggaucuuguggcccaguauacguggauggugccaauggggucaaaggcuuuagcuaucgguacggaaacggcguguggaucgggcgcauuaagucaaauaguucccgacagggauucgagaugauaugggaccccaacgguuggaccgaaacggauagcucauuuuucguuaaacaggacguggucgcgaugacugauuggucuggcuauagugggagcuuugugcagcacccugagcugacaggacuggacugcaugagaccauguuucuggguagaacucaucaggggccggcccaaggagaagaccauuuggacuuccgguucuucgaucagcuucugcgggguuaauuccgauacaguggacuggucauggccggauggcgcagaauuaccuuuuaccauugacaaauga

SEQ ID NO: 137817 - RNA, 1413 nt, Artificial Sequence
  derived and/or modified sequence opt3 from neuraminidase__InfluenzaA__ABP49352
augaaccccaaucagaagaucauuaccauaggcagcaucugcaugacaauugggaucauuucccugauccuccaaauaggaaacaucauuucuaucugggugucacacaguauucagacugguagccagaaucauacgggcaucuguaaccagagaauaauuaccuacgaaaauuccacaugggucaaccaaacuuauguuaauaucaacaauaccaacgugguagccgggaaagacacaaccucuguggcucuugcaggaaauucgucacugugcccuauuaggggcugggccaucuacagcaaggauaacaguauccggauugguuccaaaggggacgucuucgugauacgcgagccauuuaucucuuguagccacuuggagugccgaacuuucuuuuuaacacagggagcgcugcuaaaugauaagcauuccaacggcaccguuaaagaccguucaccguauagagcucucaugaguugucccauuggcgaagccccuagcccauacaauucuagguucgaguccguggcauggucagccagcgcuugccacgaugggaugggauggcugacgaucgguauaaguggccccgacgauggggcagucgccgugcuuaaguauaacggaauuaucacugaaaccaucaagucuuggcggaaacgcauucugagaacacaggaguccgaguguguaugcguuaacggcagcuguuuuacuaucaugaccgacgguccuucggaugggccagcuucuuacaggauuuucaagauagaaaaaggaaagaucacaaaauccauugaguuggacgcccccaauucacauuaugaagagugcaguuguuacccugauaccggcacggugaugugcgucugccgggacaacuggcacggcagcaaucgcccauggguguccuuuaaccagaaucucgauuaccaaaucggguauaucuguucuggaguguucggugacaacccgcgacccaaggacggcaaggggagcugcggaccugucacuguugauggcgcggacggugugaaaggguuuucauacaaguauggcaauggaguauggauuggcagaacaaaaaguaacuccagcaggaagggguucgagaugauaugggauccaaauggauggaccgacacugauucuaacuuucuggugaaacaggacgucguggcaaugacagauuggucagguuacaguggcagcuucguucagcaccccgaacugaccgggcucgacuguaugcggccuugcuuuuggguggaguuaauccguggacgcccaagagaaaggacgaccauuuggacauccgguucuucgaucagcuucuguggcgucgauuccgacacugccaauuggucauggcccgauggggcugagcugccguucaccauugacaaguga

SEQ ID NO: 137818 - RNA, 1413 nt, Artificial Sequence; identical to SEQ ID NO: 137714
  derived and/or modified sequence opt3 from neuraminidase__InfluenzaA__ABP49363

SEQ ID NO: 137819 - RNA, 1410 nt, Artificial Sequence; identical to SEQ ID NO: 136746
  derived and/or modified sequence opt3 from neuraminidase__InfluenzaA__ABP49374

SEQ ID NO: 137820 - RNA, 1413 nt, Artificial Sequence
  derived and/or modified sequence opt3 from neuraminidase__InfluenzaA__ABP49385
augaaccccaaucagaagaucauuaccauaggcagcaucuccguggccauugggaucauuaaccugacacuccaaaucggaaauauaaucucuauuugggcuucacacaguauccagacugguagccagaacuacacgggcauuugcaaucagagaaucauaaccuaugagaacaggacaugggucaaucaaacuuacguuaacauuaauaacaccaaugugguagcagggaaagacaagacauccaugacccuugccggaaacucuucgcuguguccuauccggggcugggcgauuuauacuaaagauaauucaauccgcaucgguagcaagggggacguguucgucauucgagaaccauuuauaaguugcucccauuuggagugucguacauucuuuuuaacccagggagcucugcuaaacgauaaacacucuaauggcacgaucaaggacagaagcccguucagggcccucauguccugcccccugggcgaagcaccuucaccauacaacagucgguuugagagcguggccuggucugcuuccgcaugucaugaugggcuuggauggcugacuauugguaucucaggccccgacaacggggccguugcuguguugaaguauaauggaauaauuaccgaaacaaucaaaagcuggaagaaacagauccuccgcacucaggagagugagugcgucugugugaacggcucuugcuucaccauuaugacagaugguccuuccaauagagccgcgagcuacaggaucuuuaagauugaaaaagggcggguaaccaagucgauagagcuggacgcaccaaacuaucacuacgaagaguguucuugcuaccccgauacgggaacuguuaugugugugugccgcgacaauuggcauggcuccaaccgaccuugggucucauucaaucaaaaccuggauuaucagaucggcuacauuugcagugggguguuuggagacaauccaagaccgaaggauggugagggcagcuguaaccccgugacagucgacggggccgacggaguuaaaggcuucuccuauagguacgguaaugggguguggaucggccggaccaagucuaaccgucuccgcaaaggauuugaaaugaucugggauccuaauggcuggacugacacagauagcgacuucucaaugaagcaggauguaguggcuaugaccgacuggaguggguauuccggauccuuuguccagcacccagaguuaacgggucuggauugcaugagacccuguuucuggguggaacuuguuaggggcuugccucgggagaacaccacaauuuggacuucugggucaaguaucagcuucugcggagugaauagcgaaaccgccaacuggucuuggccagacggcgcagagcugcccuuuacaauagauaaauga

SEQ ID NO: 137821 - RNA, 1413 nt, Artificial Sequence; identical to SEQ ID NO: 136402
  derived and/or modified sequence opt3 from neuraminidase__InfluenzaA__ABP49396

SEQ ID NO: 137822 - RNA, 1410 nt, Artificial Sequence
  derived and/or modified sequence opt3 from neuraminidase__InfluenzaA__ABP49407
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugagcgaacugggaguucccuuucauuugggcaccaaacaggugugcauugcuuggaguuccucuagcugucacgaugguaaggccuggcuccaugucugcgugacaggggacgauaagaacgcaaccgccuccuucaucuacaauggaagacugguagacucaaucguuaguuggagcaaagagauucugaggacgcaggaaucugagugugugugcauaaacggcacuuguacagucgugaugaccgauggcuccgcuucagggaaggcagacacuaaaauccucuuuauugaggaaggaaagaucgugcacacaagcaccuuaagugguucugcccaacacgucgaggaaugcuccugcuauccucgguacccaggcguucgcugugugugcagagauaauuggaaggggagcaacaggccgauaguagacauuaacaucaaagacuacucgaucgugucuuccuaugucuguucaggacuggugggcgauacgccccggaagaaugacaguagcuccucuagccauugccuugauccuaacaaugaggaaggugggcacggaguuaaaggcugggcuuucgacgauggcaacgacguguggauggggcgcaccauuucagagaaguugcgaaguggauacgagacauuuaaagucaucgaagguugguccaauccaaacagcaagcugcagauuaauagacaggugauaguagauaggggcaaccggucuggguauucaggaaucuucaguguugagggcaaaauuuguaucaaucguugcuuuuacguggaacuaauccgcgguagaaaggaggaaacugagguccucuggaccagcaacuccauuguggucuucugugggacaucuggcacuuauggaaccggcucguggcccgacggggccgauauaaaucugaugccuaucuga

SEQ ID NO: 137823 - RNA, 1410 nt, Artificial Sequence; identical to SEQ ID NO: 136746
  derived and/or modified sequence opt3 from neuraminidase__InfluenzaA__ABP49418

SEQ ID NO: 137824 - RNA, 1410 nt, Artificial Sequence; identical to SEQ ID NO: 136746
  derived and/or modified sequence opt3 from neuraminidase__InfluenzaA__ABP49429

SEQ ID NO: 137825 - RNA, 1410 nt, Artificial Sequence
  derived and/or modified sequence opt3 from neuraminidase__InfluenzaA__ABP49440
augaaccccaaucagaagaucauuaccauaggcagcgugucccugacaaucgccacugucugcuuccucauucaaaucgcuauucuugcaacgaccguuacacugcacuuuaaacagcaugagugugacucuccugccucaaaccaggugaugccaugcgaaccgaucauaaucgagagaaauauuacugaaaucguauacuugaacaauaccacaauugagaaggaaaucugucccgagguggucgaguauaggaacuggaguaaaccucagugccaaauaaccggguucgcgccauuuagcaaggauaauuccauucgguuaucugcuggaggugacaucugggugacucgcgaacccuacguuucgugugauccuggcaaaugcuaucaguucgcccuggggcagggaacaacccuagacaacaagcacucaaauggcacgauucaugaucgaaucccacaccguacucuccugaugaacgagcuuggugugcccuuucaucuggggaccaagcaggucuguguggcauggagcaguuccucuugccacgacggaaaagccugguugcacguauguguuacaggcgaugacagaaaugcuacugccagcuucaucuacgauggcaggcucguggacuccauugggucauggagucaaaacauacugcggacccaggaaagcgagugcgucuguaucaauggaacaugcaccguggugaugacggaugguucugcauccggccgcgcugacacuaggauucuguuuaucaaggaggggaaaauaguccauauuucaccucucagcggaagugcccagcacaucgaagagugcucuuguuauccaagauacccggauguucggugcaucugucgcgacaacuggaagggcuccaaucgacccgugauugacaucaacauggaagauuauagcauugacucgucuuacguaugcuccgguuuagugggggauacaccuagaaacgacgauucaaguagcaauuccaacuguagggacccaaauaacgagcggggaaaucccggcgucaaaggcugggcguucgauaacggggacgauguguggaugggacguaccauaucuaaggacagccgcucagguuacgaaacuuuuaagguuaucggcggguggaguacaccuaauuccaaaagccaggcaaacagacaagugauugucgauaagaauaacuggucuggauauucaggcaucuucaguguggaggguaaaagcugcaucaauagguguuuuuacguagagcugauucgggggcgaccacaggaaacccgcguuugguggacguccaacucuauaguggucuucugcggcaccucgggaacauauggcacugggagcuggcccgacggagccaauaucaacuuuaugccgauuuga

SEQ ID NO: 137826 - RNA, 1413 nt, Artificial Sequence; identical to SEQ ID NO: 136967
  derived and/or modified sequence opt3 from neuraminidase__InfluenzaA__ABP49451

SEQ ID NO: 137827 - RNA, 1410 nt, Artificial Sequence
  derived and/or modified sequence opt3 from neuraminidase__InfluenzaA__ABP49462
augaaccccaaucagaagaucauuaccauaggcagcgugucccugacaaucgccacugucugcuucauuaugcaaaucgcuauucucgcaacgaccguuacacuucacuuuaaacagcaugagugugacucuccugccucaaaccaggugaugccaugcgaaccgaucauaaucgagagaaauauuacugaaaucguauaccugaacaauaccacaauugagaaggaaaucugucccgaggcgguggaguauaggaacuggaguaaaccucagugccaaauaaccggguucgcuccauuuagcaaggauaauuccauucgguugucugccggaggugacaucugggucacucgcgaacccuacgugucgugugauccuggcaaaugcuaucaguucgcauuagggcagggaacaacccuggacaacaagcacucaaauggcacgauucaugaucgaaucccacaccguacucuacucaugaacgagcuggguguucccuuucaucuugggaccaaacaggugugugucgccuggagcaguuccucuugccacgacggaaaggcuuggcugcacguguguguaacaggcgaugacagaaaugcaacugccagcuucaucuacgauggcagguugguugacuccauugggucauggagucaaaacauacuccggacccaggaaagcgagugcguguguaucaauggaacaugcaccgucgugaugacggaugguucugcuuccggccgcgccgacacuaggauucuguuuaucaaggaggggaaaauagugcauauuucaccucugagcggaagugcgcagcacaucgaagagugcucuuguuauccaagauacccggauguccggugcaucugucgcgacaacuggaagggcuccaaucgacccguuauugacaucaacauggaagauuauagcauugacucgucuuacgugugcuccggucucguaggggauacaccuagaaacgacgauucaaguagcaauuccaacuguagggacccaaauaacgagcggggaaaucccggcgugaaaggcugggcauucgauaacggggacgaugucuggaugggacguaccauaaauaaggacucucgcagcgguuacgaaacuuuuaaggugaucggcggguggucaacaccuaacaguaaaucccagguuaauagacaagugauugucgauaacaauaacuggagcggauauucuggcaucuucucaguggaggguaagaguugcaucaauagguguuuuuacguagaguuaauucgggggcgaccacaggaaacccgcguuugguggacgagcaacuccauaguggucuucugcggcaccucuggaacauauggcacugggucguggcccgacggagccaauaucaacuuuaugccgauuuga

SEQ ID NO: 137828 - RNA, 1410 nt, Artificial Sequence; identical to SEQ ID NO: 137776
  derived and/or modified sequence opt3 from neuraminidase__InfluenzaA__ABP49473

SEQ ID NO: 137829 - RNA, 1410 nt, Artificial Sequence
  derived and/or modified sequence opt3 from neuraminidase__InfluenzaA__ABP49495
augaaccccaaucagaagaucauuaccauaggcagcgugucccugacaaucgccacuauuugcuuccucaugcaaaucgcuauucuugucacgaccguuacacugcacuuuaaacaguacgagugugacucuccugcaaacaaucaggugaugccaugcgaaccgaucauaaucgagagaaacauuacugaaaucguauauuugaccaauacaaccauugagaaggaaaucugucccaaauuaguggaguacaggaacuggucaaagccucagugcaaaauaacuggguucgccccauuuaguaaggauaauagcauucggcuguccgcgggaggugacaucugggucacacgcgagcccuaugugucuugugauccuggcaagugcuaccaauucgcucuagggcagggaaccacgcucgacaacaaacauucgaaugauacuauucacgaccgaaccccacaucguacacugcuuaugaacgaacugggcguucccuuucacuuggguacuagacagguguguaucgccuggucaagcaguuccugccaugaugggaaggcauggcuccacgucugugugaccggauaugacaaaaaugccacagcuucuuucaucuacgauggcaggcugguagacagcauuggcuccuggucacagaacauacugcggacccaagagagugaaugcguuuguaucaaugggacgugcacuguggucaugacagauggaagcgcaucuggucgcgccgacaccaagauucucuuuaucgaggagggcaaaauagugcacacuuccccuuuaucagggagcgcucagcauguggaagagugcaguuguuauccaagauacccgggagucaggugcauuugucgggauaacuggcgcggcucuaaucgacccguuguggacaucaacguaaaggacuacuccaucgauagcucguaugugugcucuggucuggucggggacacaccuagaaacaaugauagguccucaaguagcuacugucggaacccaaauaacgaaaagggaacccacggcgugaaaggcugggccuucgacgaugggaaugacguuuggaugggacguacgauuuccgaggauucucgcagcgguuaugaaaccuuuaaggugaucggcggguggucaacacccaacaguaaacuucagauuaauagacaggucauaguggacuccgauaacaggagcggauacucuggcaucuucucaguagaggguaagaguugcauuaaucgguguuuuuauguugaguugauccgagggcgcgaacaagagacuagagugugguggaccagcaacuccaucgucguguucugcggcacaucuggaacuuacggcaccgggucguggccugacggagcggauauuaaucugaugccaauauga

SEQ ID NO: 137830 - RNA, 1410 nt, Artificial Sequence; identical to SEQ ID NO: 136119
  derived and/or modified sequence opt3 from neuraminidase__InfluenzaA__ABP49506

SEQ ID NO: 137831 - RNA, 1410 nt, Artificial Sequence; identical to SEQ ID NO: 136111
  derived and/or modified sequence opt3 from neuraminidase__InfluenzaA__ABP49517

SEQ ID NO: 137832 - RNA, 1413 nt, Artificial Sequence
  derived and/or modified sequence opt3 from neuraminidase__InfluenzaA__ABQ01314
augaaccccaaucagaagaucauuaccauaggcagcaucugcauggccauugggacaaucucccugauucuccaaaucggaaacauaaucucuauuugggugucacacaguauccagacugguagccagaaucauacgggcauuuguaaccagagaaucauaaccuacgagaauaacacaugggucaaucaaacuuauguuaacauuuccaauaccaacgugguagcugggaaagacacaaccucuaugauccuugcaggaaauucgucacugugcccuauuaggggcugggccaucuacagcaaggauaacaguauccggauugguuccaaaggggacguguucgucauacgcgaaccauuuaucucuuguagccacuuggagugccgaacuuucuuuuuaacacagggagcgcugcuaaaugauaagcauuccaacggcaccgugaaagaccguucaccguauagagcucucaugaguugucccauuggcgaagccccuagcccauacaauucuagguucgaguccguugcauggucagccagcgcuugccacgaugggaugggauggcugacgaucgguauaaguggccccgacgauggggcaguggccguccuuaaguauaacggaauuaucacugaaaucauuaagucuuggcggaaacagauccugcgcacccaggaguccgagugugugugcguaaacggcagcuguuuuacaauuaugacugacgguccuucggaugggccagcuucuuacagaauauucaagaucgaaaaaggaaagauuaccaaauccaucgaguuggacgcccccaauucacauuaugaagagugcaguuguuacccugauacaggcaagguuaugugcgugugcagggacaacuggcacggcagcaaucggccaugggucuccuuuaaccaaaaucucgauuaccagaucggguauauuuguucuggaguguucggugacaacccgcgccccaaggacggcaaagggagcugcgauccugugaaugucgacggagcggauggcguuaaggguuuuucauaccgauaugggaacggcguguggauaggaagaaccaaaaguaauuccagcaggaagggcuucgagaugaucugggacccaaacggguggacggauacugacggaaauuuucugguaaaacaggauguggucgcaaugacagacuggucugguuacucaggcaguuucgugcagcaccccgaacugaccgggcucgauuguaugcggccuugcuuuuggguugaguuaauucguggacgcccaagagaaaagacuacaaucuggaccagcggcuccucuauuucguucuguggugugaacagcgacacggucaauugguccuggcccgauggggccgagcugccguucaccaucgacaaauga

SEQ ID NO: 137833 - RNA, 1413 nt, Artificial Sequence
  derived and/or modified sequence opt3 from neuraminidase__InfluenzaA__ABQ01325
augaaccccaaucagaagaucauuaccauaggcagcaucugcauggccauugggaucauuucccugauccuccaaauaggaaacaucauuucuaucugggugucacacaguauucagacagguagccagaaucauacuggcaucuguaaccagagaauaauuacguacgaaaauuccaccugggucaaccaaacauauguuaauaucucuaacacuaaugugguagcugggaaagacaccacaucgaugacccuugcaggaaacucaagccugugcccuauuaggggcugggccaucuacaguaaggauaauuccauccggauugguucuaaaggggacguguucgucauacgcgaaccauuuaucagcuguucccacuuggagugccgaacuuucuuuuuaacacagggagcgcugcuaaacgauaagcauucaaauggcaccgugaaagaccguaguccguauagagcucucaugagcugucccauuggcgaagccccuucuccauacaacuccagguucgagucaguugcauggagcgccagugcuugccacgaugggaugggauggcugacgaucgguauaucuggccccgacgauggggcaguggccguccuuaaguauaauggaauuaucacugaaaccaucaaguccuggcggaaacagauucugcgcacacaggagagcgagugugugugcguaaacggcucguguuuuacuaucaugaccgacgguccuucugaugggcaggcuuccuacagaauuuucaagauagaaaaaggaaagaucacaaaaucaauugaguuggacgccccaaacagucauuaugaagagugcagcuguuaccccgauaccggcacgguuaugugcgugugcagggacaauuggcacggcuccaaccggccuugggucucuuuuaaucaaaaccucgauuaccagaucggguauaucuguagcggaguguucggugacaauccacgcccgaaggacggcaaggggucaugcgaucccgugaacgucgacggagcggauggcguuaaagguuuuaguuaccgauaugggaauggcguguggauuggaagaacuaaguccaacagcucuaggaaaggcuucgagaugauaugggacccuaauggguggacagauaccgacucaaacuuucugguaaagcaggauguggucgcaaugacugacuggaguggauacagcgguuccuucgugcaacacccagaacugacaggccucgauuguaugcggcccugcuuuuggguugaguuaauccgugggcgcccuagagagaaaaccacgauuuggaccucuggaucgagcaucuccuucuguggcgucaauucagacacagugaacuggaguuggccagauggugccgagcugcccuucacuauugacaaguga

SEQ ID NO: 137834 - RNA, 1410 nt, Artificial Sequence; identical to SEQ ID NO: 136746
  derived and/or modified sequence opt3 from neuraminidase__InfluenzaA__ABQ01336

SEQ ID NO: 137835 - RNA, 1410 nt, Artificial Sequence; identical to SEQ ID NO: 136746
  derived and/or modified sequence opt3 from neuraminidase__InfluenzaA__ABQ01347

SEQ ID NO: 137836 - RNA, 1410 nt, Artificial Sequence
  derived and/or modified sequence opt3 from neuraminidase__InfluenzaA__ABQ01358
augaaccccaaucagaagaucauuaccauaggcagcgugucccugacaaucgccacugucugcuuccucaugcaaauugcuauccuugcaacgaccguuacacugcacuuuaaacagcaugaguguaacucuccugccucaaaucaggugaugccaugcgaaccgauuaucauagagagaaacaucacugaaauuguauacuugaauaacaccacaaucgagaaggaaauuugucccgagguggucgaguauaggaauuggaguaaaccucagugccaaaucaccggguucgcgccauuuagcaaggacaacuccauacgguuaucugcuggaggugauauuugggugacucgcgaacccuacguuucgugugacccuggcaaaugcuaucaguucgcccuggggcagggaacaacccuagauaauaagcacucaaacggcacgauccaugaccguauuccacaccgaacucuccugaugaaugagcuuggugugcccuuucaucuggggaccaagcaggucuguguggcauggagcaguuccucuugccacgauggaaaagccugguugcacguauguguuacaggcgacgauagaaacgcuacugccagcuucaucuacgacggcaggcucgaagauuccaucgggucauggagucaaaauauucugcggacccaggagagcgagugcguguguauaaacggaacaugcaccgucgugaugacggacgguaaugcaucuggccgcgcugauacuagaauccuguuuauuaaggaagggaaaaucgugcauauauccccucucucaggaagcgcccagcacauugaggaaugcaguuguuauccaagguacccggacguccggugcaucugucgcgauaacuggaagggcucuaaccgacccguuuuagacaucuccauggaggacuauagcauugauucgucuuacgugugcuccggucugguaggggacacaccuagaaaugaugacucaaguagcaacuccaauuguagggauccaaacaaugaacggggaaaccccggcgugaaaggcugggcguucgacaauggggaugacgucuggaugggacguaccaucucuaaggaucuucgcagcgguuacgagacuuuuaaggugauuggcggguggucaacaccuaacaguaaaucccagguuaauagacaagugauagucgacaacaauaacuggagcggauauucuggcaucuucucaguggaggguaagaguugcauuaauagguguuuuuacguagaauugauccgggggcgaagccaggagacccgcguuugguggacguccaacucuaucguggucuucugcggcaccucgggaacauauggcacugggagcuggccagauggagcaaauauuaacuuuaugcccauauga

SEQ ID NO: 137837 - RNA, 1410 nt, Artificial Sequence
  derived and/or modified sequence opt3 from neuraminidase__InfluenzaA__ABQ01369
augaaccccaaucagaagaucauuaccauaggcagcgugucccugacaaucgccacuauuugcuucgucaugcaaaucgcuauucucguuacgaccgugacacuucacuuuaaacaguacgagugugacucuccugcaaacaaucagguaaugccaugcgaaccgaucauaaucgagagaaacauuacugaaaucguguaucugaccaauacaaccauugagaaggaaaucugucccaaauuggucgaguacaggaacuggucaaagccucagugcaaaauaacuggguucgccccauuuaguaaggauaauagcauucgguuauccgcgggaggugacaucugggugacacgcgagcccuauguuucuugugauccuggcaagugcuaccaauucgcucuggggcagggaaccacgcuagacaacaaacauucgaaugauacuauucacgaccgaaccccacaucguacacuccugaugaacgaacuuggcgugcccuuucaccuggguacuagacaggucuguaucgccuggucaagcaguuccugccaugaugggaaggcaugguugcacguguguguaaccggauaugacaaaaaugccacagcuucuuucaucuacgauggcaggcucguugacagcauuggcuccuggucacagaacauacugcggacccaagagagugaaugcguguguaucaaugggacgugcacugucgugaugacagauggaagcgcaucuggucgcgccgacaccaagauucuguuuaucgaggagggcaaaauagugcacacuuccccucucucagggagcgcucagcaugucgaagagugcaguuguuauccaagauacccgggaguuaggugcauuugucgggauaacuggaagggcucuaaucgccccgugguagacaucaacgugaaggacuacuccaucgauagcucguaugucugcucugguuuagugggggacacaccucgaaagaacgauagauccucaaguagcuacuguaggaauccaaacaaugaaaaaggaacccacggcguuaaaggcugggccuucgacgaugggaacgacguguggaugggacggacgauuuccgaggauucucguagcgguuaugaaaccuuuaaggucaucggcggguggucaacacccaauaguaaacugcagauuaaccgccaggugauaguagacuccgauaauagaagcggauacucuggcaucuucucaguugaggguaagaguugcauuaacagguguuuuuauguggagcuuauccgggggcgagaacaagagacucgcgucugguggaccagcaauuccaucguggucuucugcggcacaucuggaacuuacggcaccgggucguggccugacggagcggauauuaacuugaugccaauauga

SEQ ID NO: 137838 - RNA, 1410 nt, Artificial Sequence
  derived and/or modified sequence opt3 from neuraminidase__InfluenzaA__ABQ44386
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacguaaaagacuacagcauugugucgucuuaugucugcuccggucuugugggggacacgccccggaagaaugauucaaguagcuccucucauuguuuggacccuaacaaugaggaaggaggccacggcguuaaagggugggccuucgaugacggaaacgauguguggaugggucgcaccaucagcgagaagcugcgaucaggcuacgagaccuuuaaagucaucgaaggguggaguaagccaaauuccaaacuacagauuaacagacaggugaucguagacaggggaaaucggagcggcuauucugguauuuucucaguugagaguaagagcugcauaaaccguuguuuuuacguggaacucauccgcgggagaaagcaggagaaugaaguccuguggacauccaacucuauuguggucuucugcggcacuucgggaaccuauggcacagggagcuggcccgauggagcggacaucaaucuuaugccuaucuga

SEQ ID NO: 137839 - RNA, 1410 nt, Artificial Sequence; identical to SEQ ID NO: 136730
  derived and/or modified sequence opt3 from neuraminidase__InfluenzaA__ABQ44408

SEQ ID NO: 137840 - RNA, 1413 nt, Artificial Sequence
  derived and/or modified sequence opt3 from neuraminidase__InfluenzaA__ABQ44419
augaaccccaaucagaagaucauuaccauaggcagcaucugcauggccauugggaucauuucccugauccuccaaauaggaaacaucgugucuauuuggaucucacacaguauucagaaugguagccagaacuacacaggcaucuguaaucagagaauaauuacuuaugagaacuccacgugggucaaucaaaccuacguuaacaucaauaacacaaaugugguagcugggcaggacacuaccucuguggcacuugccggaaacucgucacugugcccuauuagcggcugggcgaucuauaguaaagauaauuccaucaggauugguucuaagggggacgucuucgugauacgggaaccauuuaucagcuguucccauuuggagugccgcacauucuuuuuaacccagggagcucugcuaaacgauaaacacucaaauggcacuguuaaggaccgaaguccguaccgugcccucaugagcugucccauuggcgaagcaccuucuccauauaacuccagauucgagucaguggccuggagcgcuagugcaugccaugaugggaugggauggcugacaaucgguauaucuggccccgacgauggggccgucgcugugcuuaaauacaacggaauuaucaccgaaacgaucaaguccuggaggaagcggauucugcgcacucaggagagcgaguguguaugcguuaauggcucguguuuuaccaucaugacagacgguccuaacaaugggccagccucuuauaaaauuuucaagauagaaaaaggaaagaucacuaaauccauugaguuggaugcgcccaacucacacuacgaagagugcaguuguuacccugacgcaggcaccgugaugugcgucugcagagauaauuggcauggcagcaacaggccauggguguccuuuaaucaaaaccucgacuaucagaucggguacaucuguucuggaguguucggugauaauccgcggcccaaggacggcaaggggagcugcggaccugucacaguugacggcgccgauggugugaaaggguuuucauaucgcuacggcaacggaguauggauuggccgaaccaagaguaauuccagcagaaggggguucgagaugauaugggacccaaacggauggacggauacugacucuaaauuucuggugaagcaggaugucguggcuaugacagacuggucagguuauaguggcagcuucguucagcaccccgaacugaccgggcucgauuguaugcggccuugcuuuuggguggaguuaauccguggacgcccaagagaaaauacuacaauuuggaccuccgguucuucgaucagcuucuguggcgucaacggggacacggccaauugguccuggcccgauggcgcagagcugccguucaccauugacaaauga

SEQ ID NO: 137841 - RNA, 1410 nt, Artificial Sequence; identical to SEQ ID NO: 136362
  derived and/or modified sequence opt3 from neuraminidase__InfluenzaA__ABQ44430

SEQ ID NO: 137842 - RNA, 1410 nt, Artificial Sequence; identical to SEQ ID NO: 137792
  derived and/or modified sequence opt3 from neuraminidase__InfluenzaA__ABQ44441

SEQ ID NO: 137843 - RNA, 1410 nt, Artificial Sequence; identical to SEQ ID NO: 137776
  derived and/or modified sequence opt3 from neuraminidase__InfluenzaA__ABQ44463

SEQ ID NO: 137844 - RNA, 1413 nt, Artificial Sequence
  derived and/or modified sequence opt3 from neuraminidase__InfluenzaA__ABQ44474
augaaccccaaucagaagaucauuaccauaggcagcaucugcaugacaauugggacuaucucccugauucuccaaaucggaaacauaaucucuauuugggugucacacaguauccagacggguagccagaaucauaccggcauuuguaaccagagaaucauaacauacgagaauaacacuugggucaaucaaaccuauguuaacauuuccaauacaaacgugguagccgggaaagacaccacuucuaugauccuugcuggaaauucgucacugugcccuauuaggggcugggcaaucuacagcaaggauaacaguauccggauugguuccaaaggggacguguucgucauacgcgaaccauuuaucucuuguagccacuuggagugccgaacauucuuuuuaacccagggagcccugcuaaaugauaagcauuccaacggcacggugaaagaccguucaccguauagagcgcucaugaguugucccauuggcgaagcuccuagcccauacaauucuagguucgaguccguugccuggucagcaagcgccugccacgaugggaugggauggcugacuaucgguauaaguggccccgacgauggggcuguggcaguccuuaaguauaacggaauuaucaccgaaaucauuaagucuuggcggaaacagauccugcgcacacaggaguccgagugugugugcguaaacggcagcuguuuuacuauuaugaccgacgguccuucggaugggccagccucuuacagaauauucaagaucgaaaaaggaaagauuacaaaauccaucgaguuggacgcucccaauucacauuaugaagagugcaguuguuacccugauaccggcaagguuaugugcgugugcagggacaacuggcacggcagcaaucggccaugggucuccuuuaaccaaaaucucgauuaccagaucggguauauuuguucuggaguguucggugacaacccgcgccccaaggacggcaaagggagcugcgauccugugaaugucgacggagccgauggcguuaaggguuuuucauaccgauaugggaacggcguguggauaggaagaacgaaaaguaauuccagcaggaagggcuucgagaugaucugggacccaaacggguggacugauacagacggaaauuuucugguaaaacaggauguggucgcgaugaccgacuggucugguuacucaggcaguuucgugcagcaccccgaacugacugggcucgauuguaugcggccuugcuuuuggguugaguuaauucguggacgcccaagagaaaagacaaccaucuggacgagcggcuccucuauuucguucuguggugugaacagcgacaccgucaauugguccuggcccgauggggcagagcugccguucacaaucgacaaauga

SEQ ID NO: 137845 - RNA, 1410 nt, Artificial Sequence; identical to SEQ ID NO: 136111
  derived and/or modified sequence opt3 from neuraminidase__InfluenzaA__ABR15800

SEQ ID NO: 137846 - RNA, 1413 nt, Artificial Sequence; identical to SEQ ID NO: 137832
  derived and/or modified sequence opt3 from neuraminidase__InfluenzaA__ABR15811

SEQ ID NO: 137847 - RNA, 1413 nt, Artificial Sequence; identical to SEQ ID NO: 136844
  derived and/or modified sequence opt3 from neuraminidase__InfluenzaA__ABR15910

SEQ ID NO: 137848 - RNA, 1410 nt, Artificial Sequence; identical to SEQ ID NO: 136170
  derived and/or modified sequence opt3 from neuraminidase__InfluenzaA__ABR15932

SEQ ID NO: 137849 - RNA, 1410 nt, Artificial Sequence
  derived and/or modified sequence opt3 from neuraminidase__InfluenzaA__ABR15943
augaaccccaaucagaagaucauuaccauaggcagcgugucccugacaaucgccacuauuugcuuccucaugcaaaucgcuauucuugucacgaccguuacacugcacuuuagacaguacgaguguaacucuccuccaaauaaccaggugauguugugcgaaccgacuaucauagagaggaauaucaccgaaauuguauauuuaacaaacaccacuaucgagaaagaaauuugucccaagcuggcagaguaccggaauuggucaaaaccucagugcaacaucacaggguucgccccauuuaguaaggacaauagcauacgccuauccgcgggaggugauauuugggugacccgagagcccuaugucucuugugacccugauaaaugcuaccaauucgcucucggccaggggacgacucugaacaauggacauucgaacgacaccgugcacgaucguacaccauauagaacucuucugaugaaugaauugggcguucccuuucaucucgguacccgacagguguguaucgccuggucaagcaguuccugccacgacgggaaggcauggcugcaugucugugugacaggagaugacgagaacgccaccgcuucuuucauuuacaauggccggcugguagauagcaucggcuccuggucaaagaaaauccuccgcacgcaggaaagugagugcguuuguauuaacgggacuugcacaguggucaugaccgacggaagcgcaucugguaaggccgauacuaaaauauuauuuaucgaggaaggcaagauugugcacaucuccacacugucagggagcgcucaacacguggaggaaugcaguuguuauccuagauacccaggagucaggugcguuugucgggacaacuggaaaggcucuaaucgcccgauaguggauauuaacguaaaggacuacuccaucgugagcucguaugucugcucuggucuugugggggacacccccaggaagaaugauuccuucucaaguagccauuguuuggacccuaacaaugaggaaggaggccacggcguuaaagggugggccuuugaugacggaaacgauguguggauggguagaacgaucuccgagaagcugaggucuggcuacgagaccuucaaagucauugaaggguggagcaagccaaauucaaaacuacagacaaaccgucaggugaucguagagcggggaaaucgcaguggcuauuccgguauuuuuagcguugaagggaagucuugcauaaacagauguuucuacguggagcucaucaggggccggaaagaagagacugaggucugguggaccucaaauaguauuguggucuuuugcggaacaagcggcacuuaugggaccggauccuggcccgacggugcggauaucaaccugaugccuaucuga

SEQ ID NO: 137850 - RNA, 1410 nt, Artificial Sequence
  derived and/or modified sequence opt3 from neuraminidase__InfluenzaA__ABR15954
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccaggagucagaugcguuuguagggacaacuggaagggcucuaaucggccgauaguggauauuaacguaaaggacuacuccaucgugagcucguaugucugcucuggucuugugggggacacccccaggaaaaauaacuccuucucaaguagccauuguuuggauccuaauaacgaggaaggaggccacggcguuaaggggugggccuuugacgauggaaaugacguguggaugggucgaacgaucuccgagaaacugagaucuggcuacgagaccuucaaggucauugaaggguggagcaaaccaaacucaaagcuacagacaaaucgccaggugaucguagagcggggaaaccguaguggcuauuccgguauuuuuagcguugaagggaaaucuugcauaaaucgcuguuucuacguggagcucaucagaggcaggaaggaagagacugaggucugguggaccucaaacaguauuguggucuuuugcggaacaagcggcacuuaugggaccggauccuggcccgauggugcggacaucaaucugaugccuaucuga

SEQ ID NO: 137851 - RNA, 1410 nt, Artificial Sequence; identical to SEQ ID NO: 136170
  derived and/or modified sequence opt3 from neuraminidase__InfluenzaA__ABR15965

SEQ ID NO: 137852 - RNA, 1410 nt, Artificial Sequence
  derived and/or modified sequence opt3 from neuraminidase__InfluenzaA__ABR22243
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccccucugucagggagcgcucaacacguggaggaaugcaguuguuauccacgguacccgggaguccgcugcguuuguagagacaacuggaagggcucuaauaggcccaucguggauauaaacguaaaagacuacuccauugugagcucguaugucugcucuggucuugugggggacaccccucggaagacggauuccucaaguagcucccauuguuuggacccaaauaacgaggaaggaggccacggcguuaaagggugggccuucgaugacggaaaugauguguggaugggucgcaccaucucugaaaagagccgaucaggcuacgagacauuuaaagucaucgagggguggaguaagcccaacuccaaacugcagauuaauagacaggugaucguagacaggggaaaccggagcggcuauucugguauuuucucaguugaggggaagaguugcauaaaucguuguuuuuacguggaacuaauccgcggcagaaagcaggagacugaaguccucuggaccagcaacuccauuguggucuucugcggaacaucuggcacuuaugggaccggaucguggccugauggugcggaccugaaucuuaugccaaucuga

SEQ ID NO: 137853 - RNA, 1410 nt, Artificial Sequence; identical to SEQ ID NO: 136746
  derived and/or modified sequence opt3 from neuraminidase__InfluenzaA__ABR28518

SEQ ID NO: 137854 - RNA, 1410 nt, Artificial Sequence; identical to SEQ ID NO: 136592
  derived and/or modified sequence opt3 from neuraminidase__InfluenzaA__ABR28595

SEQ ID NO: 137855 - RNA, 1413 nt, Artificial Sequence
  derived and/or modified sequence opt3 from neuraminidase__InfluenzaA__ABR28771
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagagucgggagcucaaugcaccuaacuuucacuaugaagaguguagcugcuacccagacaccggcacggugaugugugucugccgcgauaauuggcacggcuccaacagacccugggugucuuucaaucagaaccuggacuaccagauaggguauaucugcagcggaguguuuggugauaauccuaggccaaaagacggcgaggggucauguaacccggucacuguugauggagccgacggcgugaaggguuucaguuacaaauaugggaauggcguauggauuggacggacaaaguccaaccgccugcgaaaaggcuuugaaaugaucugggaccccaauggguggaccgauacugacagcaacuucucugugaagcaagaugucguggcuaucacagacuggucaggauacagugguagcuuuguucagcauccugagcucaccggcuuagauugcauuagaccauguuucuggguggaacuggucagggggcuuccccgggagaauacgaccauauggacauccggaucuucgaucagcuucugcggcgugaacuccgacacugccaacuggucauggccugauggugcagaauugccauuuaccauugacaaguga

SEQ ID NO: 137856 - RNA, 1413 nt, Artificial Sequence
  derived and/or modified sequence opt3 from neuraminidase__InfluenzaA__ABR28782
augaaccccaaucagaagaucauuaccauaggcagcaucuccauugccaucgggauucugucucucaugcuucaaaucggaaacauaaucucaauuugggcuagucacagcauccagacagguucccagaaucauacuggcauuugcaaccagagaaucauaacguacgagaauagcaccugggugaaccacacauaugucaauauuaacaauacuaacguuguggcagggaaagacaagaccucgguaacacuggccggaaauucaucuuuguguaguaucuccggcugggcgauuuacaccaaagauaacucuaucaggaucgguagcaagggggacguguucgucauucgggaaccuuuuauauccugcucacauuuagagugucgcacuuucuuucugacacaaggagcucuacucaaugauaaacacaguaacggcaccgugaaggaccgaagcccauaucgugcccugaugucuugcccgcuuggcgaagcacccuccccuuacaauucaaaguucgagagcguugccuggagugcuucugcaugucaugaugggaugggauggcugacgaucgguauuuccggcccagacaacggggccguggcugucuugaaauauaacggaaucauaacugaaaccauuaagagcuggaaaaagagaauccucaggacacaggagucggagugcguguguguaaauggcucuugcuuuacuaucaugaccgauggucccuccaacggggccgcgucauacaaaauuuucaagaucgaaaagggaaaaguuacaaagaguauugagcugaaugcaccuaacuuucacuaugaagaguguagcugcuacccagacaccggcacggugaugugugucugccgggauaauuggcacggcuccaaccgccccugggugucuuucaaucagaaccuggacuaccagauaggguauaucugcagcggaguguuuggugauaauccuagaccaaaagacggcgaggggucauguaacccggucacuguugauggagccgacggcgugaaggguuucaguuacaaauaugggaauggcguauggauuggaaggacaaaguccaaccggcuccgcaaaggcuuugaaaugaucugggaccccaauggguggaccgauacugacagcaacuucucugugaagcaagaugucguggcuaucacagacuggucaggauacagugguagcuuuguucagcauccugaguuaaccggccuggauugcauucgaccauguuucuggguggaacuugucagaggguugcccagggagaauacgaccauauggacauccggaucuucgaucagcuucugcggcgugaacuccgacacugccaacuggucauggccugauggugcagaacugccauuuaccauugacaaguga

SEQ ID NO: 137857 - RNA, 1410 nt, Artificial Sequence; identical to SEQ ID NO: 136860
  derived and/or modified sequence opt3 from neuraminidase__InfluenzaA__ABR28793

SEQ ID NO: 137858 - RNA, 1413 nt, Artificial Sequence; identical to SEQ ID NO: 136844
  derived and/or modified sequence opt3 from neuraminidase__InfluenzaA__ABR28804

SEQ ID NO: 137859 - RNA, 1410 nt, Artificial Sequence; identical to SEQ ID NO: 136746
  derived and/or modified sequence opt3 from neuraminidase__InfluenzaA__ABR28815

SEQ ID NO: 137860 - RNA, 1410 nt, Artificial Sequence; identical to SEQ ID NO: 136170
  derived and/or modified sequence opt3 from neuraminidase__InfluenzaA__ABR28826

SEQ ID NO: 137861 - RNA, 1413 nt, Artificial Sequence; identical to SEQ ID NO: 136412
  derived and/or modified sequence opt3 from neuraminidase__InfluenzaA__ABR28837

SEQ ID NO: 137862 - RNA, 1413 nt, Artificial Sequence
  derived and/or modified sequence opt3 from neuraminidase__InfluenzaA__ABR28848
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucguagggaaagacaagaccucggugacacuugcaggaaauucaagccuguguaguauuuccggcugggccaucuacaccaaagauaacucuaucaggauugguagcaagggggacgucuucgugauacgggagccuuuuaucuccugcucacauuuggagugucgcacuuucuuuuuaacacaaggagcgcugcuaaaugauaaacacaguaacggcaccguuaaggaccgaagcccauaucgugcucucaugucuugcccgcugggcgaagcccccuccccuuacaauucaaaguucgagagcguggcauggagugccucugcuugucaugaugggaugggauggcuuacgauugguaucuccggcccagacaacggggcagucgccgugcugaaauauaacggaauaauuacugaaaccaucaagagcuggaaaaagcagaucuugagaacacaggagucggagugcguauguguuaauggcucuugcuuuacuauuaugaccgauggucccuccaacggggcugccucauacaaaaucuucaagauugaaaagggaaaaauaacaaagaguaucgagcucaaugcgccuaacuuucacuaugaagaguguagcugcuacccagacaccggcacggugaugugugucugcagggauaauuggcacggcuccaaccggcccugggugucuuucaaucagaaccuggacuaccaaauuggguauaucugcagcggaguguuuggugauaauccucgcccaaaagacggcgaggggucauguaacccggucacuguugauggagcaaauggcgugaaggguuucaguuacaaauaugggaacggcguauggaucggaagaacaaaguccaauaggcugcggaaaggcuuugaaauggugugggaccccaacggguggaccgacacugauagcgacuucucugucaagcaggaugugguugccauuacagacuggucaggauacagugguagcuuugugcagcauccugagcucaccggcuuaaauugcauacgcccauguuucugggucgaacuggugcgagggcuucccaaggagaacacgaccaucuggacauccggaucuucgauuagcuucugcggcguaaacuccgauacugcuaauuggucauggccugacggugccgaauugccauuuaccaucgauaaauga

SEQ ID NO: 137863 - RNA, 1410 nt, Artificial Sequence
  derived and/or modified sequence opt3 from neuraminidase__InfluenzaA__ABR28859
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacggccgaacaccauaucguacucuucugaugaaugaauuggguguucccuuucaucucgggaccagacagguguguaucgccuggucaagcaguuccugccacgauggaaaggcauggcugcaugucugugugacaggcgacgaugagaacgccaccgcuucuuucauuuacaauggcaggcugguagacagcaucggguccuggaguaaaaagauccuccggacgcaggaaucagagugcguuuguauuaacggaacuugcacaguggucaugaccgaugguagcgcaucuggcaaagccgacacuaagauauuauuuaucgaggaagggaaaauugugcacaucuccacacugucaggaagcgcucaacacguggaggaaugcaguuguuauccucgcuacccaggcgucagaugcguuuguagggauaacuggaaggguucuaaucggccgauaguggacauuaacguaaaggauuacuccaucgugagcucguaugucugcucugggcuugugggagacacccccaggaaaaaugacuccuucucaaguagccauuguuuggauccuaacaaugaggaaggcggccacgggguuaagggaugggccuuugacgaugguaacgacguguggaugggccgaacgaucuccgagaaacugagaucuggguacgagaccuucaaggucauugaaggauggagcaaaccaaauucaaagcuacagaucaaccgccaggugauuguagagcggggcaaucguagugguuauuccgggauauuuagcguugaaggcaaaucuugcaucaaccgcuguuucuacguggagcucauuagaggaaggaaggaagagacagaggucugguggacuucaaauaguaucguggucuuuugcggcaccagcgggacauauggaacugguuccuggcccgauggcgcggacaucaaccugaugccuauuuga

SEQ ID NO: 137864 - RNA, 1410 nt, Artificial Sequence
  derived and/or modified sequence opt3 from neuraminidase__InfluenzaA__ABR28870
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaucauagagagaaauaucaccgaaacaguauauuuaaccaacacuacaauugagaaggaaaucugucccaaacuggcagaguacaggaauuggucaaagccucagugcaacauuaccggguucgccccauuuaguaaagacaauagcauccggcuauccgcgggaggugauauaugggugacgcgcgagcccuaugucucuugugacccugauaagugcuaccaauucgcucucggccaggggacuacccugaacaauggacauucgaacgacacagugcacgaucgaacuccauaucguacccuucugaugaaugaauugggcguucccuuucaucucgguacaagacagguguguauugccuggucaagcaguuccugccacgacgggaaggcauggcugcaugucugugugaccggagaugacgagaacgccacggcuucuuucaucuacaauggcaggcugguagauagcauuggcuccuggaguaaaaagauccuccggacucaggaaucagagugcguuuguaucaacgggacaugcaccguggucaugacugacggaagcgcaucugguaaagccgauacaaagauuuuauuuauagaggaaggcaaaaucgugcacauuuccacccugucagggagcgcucaacacguggaggaaugcaguuguuauccucgcuacccaggagucagaugcguuuguagggacaacuggaagggcucuaaucggccgaucguggauauaaacguaaaggacuacuccauugugagcucguaugucugcucuggucuugugggggacacgccccgcaaaaaugauuccuucucaaguagccauuguuuggacccuaacaaugaggaaggaggccacggcguuaaggggugggccuuugaugacggaaacgauguguggaugggucgaaccaucuccgagaaacugagaucuggcuacgagacauucaaggucaucgaaggguggagcaaaccaaauucaaagcuacagauuaacaggcaagugaucguagagcggggaaaucguaguggcuauuccgguauuuuuagcguugaagggaaaucuugcauaaaccgcuguuucuacguggagcucaucagaggcaggaaggaagagacugaggucugguggaccucaaauaguauuguggucuuuugcggaacaagcggcacuuaugggaccggauccuggcccgacggugcggauaucaaccugaugccuaucuga

SEQ ID NO: 137865 - RNA, 1410 nt, Artificial Sequence
  derived and/or modified sequence opt3 from neuraminidase__InfluenzaA__ABR28881
augaaccccaaucagaagaucauuaccauaggcagcgugucccugacaaucgccacugucugcuuccucaugcaaauugcuauccuuguuacgaccgugacacugcacuuuaaacaguacgaguguaacucuccuccaaauaaccagguaauguugugcgaaccgacuauuaucgagagaaauauaaccgaaaucguguauuuaacaaacaccacuauugagaaggaaaucugucccaaacuggcagaguacaggaauuggucaaagccucagugcaacauuacaggguucgccccauuuaguaaagacaauagcauccggcuauccgcgggaggugauauaugggucacccgcgagcccuaugugucuugugacccugauaagugcuaccaauucgcucucggccaggggacgacucugaacaauggacauucgaacgacaccguucacgaucgaacaccauaucguacucuucugaugaaugaauugggcgugcccuuucaucucgguaccagacaggucuguauugccuggucaagcaguuccugccacgacgggaaggcauggcugcauguguguguaacaggagaugacgagaacgccaccgcuucuuucaucuacaauggcaggcugguugauagcauuggcuccuggaguaaaaagauccuccggacgcaggaaucagagugcguguguaucaacgggacuugcacagucgugaugaccgacggaagcgcaucugguaaagccgauacuaagauuuuauuuauagaggaaggcaaaaucgugcacauuuccacacugucagggagcgcucaacacgucgaggaaugcaguuguuauccucgcuacccaggaguuagaugcguguguagggacaacuggaagggcucuaaucggccgaucguagauauaaacgugaaggacuacuccauugucagcucguaugugugcucuggucuuguuggggacacgccccgcaaaaaugauuccuucucaaguagccauuguuuggacccuaacaaugaggaaggaggccacggcgugaaggggugggccuuugaugacggaaacgaugucuggaugggucgaaccaucuccgagaaacugagaucuggcuacgagaccuucaaggugaucgaaggguggagcaaaccaaauucaaagcuacagacaaacaggcagguaauuguugagcggggaaaucguaguggcuauuccgguaucuuuagcguggaagggaaaucuugcauuaaccgcuguuucuacgucgagcucauaagaggcaggaaggaagagacugaggugugguggaccucaaauaguaucgucguguuuugcggaacaagcggcacuuaugggaccggauccuggcccgacggugcggauauuaaccugaugccuaucuga

SEQ ID NO: 137866 - RNA, 1410 nt, Artificial Sequence; identical to SEQ ID NO: 136730
  derived and/or modified sequence opt3 from neuraminidase__InfluenzaA__ABR28892

SEQ ID NO: 137867 - RNA, 1413 nt, Artificial Sequence; identical to SEQ ID NO: 136402
  derived and/or modified sequence opt3 from neuraminidase__InfluenzaA__ABR28903

SEQ ID NO: 137868 - RNA, 1410 nt, Artificial Sequence
  derived and/or modified sequence opt3 from neuraminidase__InfluenzaA__ABR28925
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagaggugcugaggacgcaggaaagcgagugugucugcauuaauggcacuuguacaguggugaugaccgauggcucugcuuccgggaaggcagacacuaaaauacucuuuaucgaggaaggaaagauuguccacacaucaaccuuaagcgguagugcccaacacguugaggaaugcucuugcuauccucgguacccaggcgugcgcuguguaugcagagauaacuggaagggguccaacaggccgaucguggacauaaauauuaaagacuacagcaucgucucgucuuauguguguuccggacugguuggcgauacgccccggaagaacgacucaaguagcuccucucauugccuugauccuaauaacgaggaaggugggcacggagugaaaggcugggcuuucgacgauggcaaugacgucuggauggggcgcaccaucagcgagaaguugcgaucaggauacgagacauuuaaagugauugaagguuggaguaacccaaauuccaagcugcagaucaacagacagguaauuguugauaggggcaaucggagcggguauucuggaauauucucaguggagggcaaaaguuguaucaaccguugcuuuuacgucgaacuaauucgcgguagaaaggaggaaacugaggugcucuggaccagcaauuccaucgucguguucugugggacaucuggcacuuauggaaccggcucguggcccgacggggccgauaucaaccugaugccuauuuga

SEQ ID NO: 137869 - RNA, 1410 nt, Artificial Sequence
  derived and/or modified sequence opt3 from neuraminidase__InfluenzaA__ABR88082
auggaccccaaccagaagaucauuaccauaggcagcgugucccugacaaucucuacuauuugcuucuuuaugcaaacggccauccucauuaccacagucacucuucacuucaaacaguacgaguuuaauucaccuccaaacaaucagguuaugcugugugaaccgaccaucauagagagaaacaucacagaaauuguguauuugaccaauacuaucauugagaaggaaaucugccccaaauuagcugaguacaggaacuggaguaagccucagugugauauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccguugugucauggaguaaagacauccugaggacgcaggagagcgaaugugucugcauuaacggcacuuguacaguggugaugaccgauggcucugcuuccgggaaggcagacacuaaaauacucuuuaucgaggagggaaagauuguccacacaucaaccuuaagcgguagugcccaacacguugaagagugcucuugcuauccucgguacccaggcgugcgcuguguaugcagagacaauuggaagggguccaacaggccgaucguggauauaaacauuaaaaauuacagcaucgucucgucuuauguguguuccggacugguuggcgacacgccccggaagaccgauucaaguagcuccucucauugccuugacccuaacaaugaagagggugggcacggagugaaaggcugggcuuucgaugacggcaacgaugucuggauggggcgcacaaucagcgaaaaguugcgacugggauacgagacuuuuaaagugauugaggguuggucaaauccaaacaguaagcuacagaucaauagacagguaauuguugacaggggcaaccgguccggguauagcggaauauucucuguggaaggcaaaucauguaucaaucguugcuuuuacgucgagcucauucgcgguagaaaggaagagaccgaagugcuguggacaaguaacagcaucgucguguucugugggacuuccggcaccuauggaacaggcucuuggcccgauggggccgacaucaaucuuaugccuauuuga

SEQ ID NO: 137870 - RNA, 1413 nt, Artificial Sequence
  derived and/or modified sequence opt3 from neuraminidase__InfluenzaA__ABS00324
augaaccccaaucagaagaucauuaccauaggcagcaucugcauggccauugggaucauuucccugauccuccaaauaggaaacaucgugucuauuuggaucucacacaguauucagacagguagccagaauuacacuggcaucuguaaccagagaauaauuacguaugaaaauuccaccugggucaaccaaacauacguuaauaucaacaauacuaacgugguagcugggcaggacaccacaucuguggcacuugccggaaauucgucacugugcccuauuagcggcugggcgaucuauaguaaagauaacuccaucaggauugguucuaagggggacgucuucgugauacgggagccauuuaucagcuguucccauuuggagugccgcaccuucuuuuuaacucagggagcucugcuaaaugauaaacacucaaacggcacaguuaaggaccgaaguccguaccgugcccucaugagcugucccauuggcgaagcaccuucuccauauaauuccagauucgagucaguggccuggagcgcuagugcaugccaugaugggaugggauggcugaccaucgguauaucuggccccgacgauggggccgucgcugugcuuaaauacaacggaauuaucacggaaacuaucaaguccuggaggaagcggauucugcgcacccaggagagcgaguguguaugcguuaacggcucguguuuuacaaucaugacugacgguccuaauaacgggccagccucuuauaaaauuuucaagauagaaaaaggaaagaucaccaaauccauugaguuggaugcgcccaauucacacuacgaagagugcaguuguuacccugacgcaggcacagugaugugcgucugcagagauaacuggaggggcagcaaucggccauggguguccuuuaaccaaucucucgacuaucagaucggguacaucuguagcggaguguucggugauaauccgcgccccaaggacggcaaggggucaugcgacccugucaccguugauggagccgacggcgugaaagguuuuaguuaucgauacgggaacggcguauggauuggaagaacgaaguccaauagcucuaggcggggcuucgagaugauaugggauccaaacggguggacugacacagauucaaaauuucuggugaagcaggacgucguggcuaugaccgauuggaguggauauagcgguuccuucguucagcaucccgaacugacuggccucgacuguaugcguccuugcuuuuggguggaguuaauccgcgggagaccaagggaaaauacaaccauuuggacgucuggaucgagcaucuccuucuguggcgucaacggugauaccgccaauuggucauggcccgacgggagugagcugccguucacaauugauaaauga

SEQ ID NO: 137871 - RNA, 1410 nt, Artificial Sequence; identical to SEQ ID NO: 136130
  derived and/or modified sequence opt3 from neuraminidase__InfluenzaA__ABS49902

SEQ ID NO: 137872 - RNA, 1410 nt, Artificial Sequence
  derived and/or modified sequence opt3 from neuraminidase__InfluenzaA__ABS49913
augaaccccaaucagaagaucauuaccauaggcagcgugucccugacaaucgccacugucugcuuccucaugcaaauugcuauccuuguuacgaccgugacacugcacuuuagacaguacgagugugacucuccuacuaacaaucagguaaugccaugcgaaccgauuaucauagagaggaacaucaccgaaauuguguauuugaauaacacaaccaucgagaaagaaauuugucccaaguuagucgaguaccggaauuggucaaaaccucagugcaagaucacuggguucgcaccauuuaguaaagauaacagcauacgccuguccgccggaggugacauuugggugacacgagagcccuauguuucuugugauccuggcaagugcuaccaauucgcgcuagggcagggaaccacgcucgacaauaagcauucgaacgauacuauccacgaccguauuccacauagaacccugcuuaugaaugaacugggcgugcccuuucacuuggguacaaggcaggucuguaucgcuuggucaagcaguuccugccaugaugggaaagccuggcuccacguguguguaacuggagacgauaagaacgcaaccgccucuuucaucuaugacggccggcugguugauagcauuggcuccuggucacagaauauacugcgcacacaagagagugaaugcguguguaucaacgggaccugcacggucgugaugacugacggaagcgcuucugguagagcagauacaaggauucucuuuaucgaggagggcaaaauagugcacauuuccccuuuaucagggagcgcccagcaugucgaagagugcaguuguuacccacgguauccgggaguucgcugcaucugucgagacaauuggaagggcucuaacagacccgugguagacaucaacguggaagauuacuccauugacagcucguacgucugcucuggucuggugggggauaccccuaggaauaacgaccgguccucaaauaguaacugucguaauccaaacaaugagcgcggaaaccacggcguuaaaggcugggcuuucgaugacgggaaugauguguggaugggaagaacuaucagcaaggaccuuagguccgguuaugaaacauuuaaggucauuggcggguggucuacccccaacagcaaaucacagauaaaucgacaggugaucguagauagugacaaccgguccggauacagcggcauuuucucuguugaggguaagucaugcaucaaucgcuguuuuuauguggaguugaucagagggagggaacaagagacgcgggucugguggaccaguaacagcauuguggucuucugcggcacauccggaacuuacggcaccgggucuuggccugauggagccgacauaaaucugaugccaaucuga

SEQ ID NO: 137873 - RNA, 1410 nt, Artificial Sequence; identical to SEQ ID NO: 136860
  derived and/or modified sequence opt3 from neuraminidase__InfluenzaA__ABS49968

SEQ ID NO: 137874 - RNA, 1413 nt, Artificial Sequence; identical to SEQ ID NO: 137856
  derived and/or modified sequence opt3 from neuraminidase__InfluenzaA__ABS49979

SEQ ID NO: 137875 - RNA, 1413 nt, Artificial Sequence
  derived and/or modified sequence opt3 from neuraminidase__InfluenzaA__ABS49990
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaauucuugccggaaauucaagccuguguaguaucuccggcugggcgaucuacacaaaagauaacucuauuaggauagguagcaagggggacguguucgucauccgggagccuuuuauuuccugcucacauuuggagugucgcaccuucuuuuuaacucaaggagcucugcuaaaugauaaacacaguaacggcacagugaaggaccgaagcccauaucgugcccucaugucuugcccgcugggcgaagcacccuccccuuacaauucaaaguucgagagcguugccuggagugcuucugcaugucaugaugggaugggauggcuuaccaucgguauauccggcccagacaacggggccguggcuguccugaaauauaacggaauuaucacggaaacuaucaagagcuggaaaaagagaauuuugaggacccaggagucggagugcguguguguaaauggcucuugcuuuacaaucaugacugauggucccuccaacggggccgcgucauacaaaauuuucaagauagaaaagggaaaaguuaccaagaguaucgagcucaaugcaccuaacuuucacuaugaagaguguagcugcuacccagacacaggcaccgugaugugugucugccgggauaauuggcacggcuccaaccgccccugggugucuuucaaucagaaccuggacuaccagauuggguauaucugcagcggaguguuuggugauaauccuagaccaaaagacggcgaggggucauguaacccggucacgguugauggagccgacggcgugaaggguuucaguuacaaauaugggaauggcguauggaucggaaggacuaaguccaaccggcugcgcaaaggcuuugaaaugauuugggaccccaauggguggacagauaccgacagcaacuucucugugaagcaagaugucguggcuauaacugacuggucaggauacagugguagcuuuguucagcauccugagcucacaggcuuagauugcauccgaccauguuucuggguggaacuggucagagggcuucccagggagaauaccacgauuuggaccuccggaucuucgaucagcuucugcggcgugaacuccgacacagccaacuggucauggccugauggugcagaauugccauuuacuauugacaaguga

SEQ ID NO: 137876 - RNA, 1410 nt, Artificial Sequence; identical to SEQ ID NO: 136746
  derived and/or modified sequence opt3 from neuraminidase__InfluenzaA__ABS50001

SEQ ID NO: 137877 - RNA, 1410 nt, Artificial Sequence; identical to SEQ ID NO: 136746
  derived and/or modified sequence opt3 from neuraminidase__InfluenzaA__ABS50012

SEQ ID NO: 137878 - RNA, 1410 nt, Artificial Sequence
  derived and/or modified sequence opt3 from neuraminidase__InfluenzaA__ABS50023
augaaccccaaucagaagaucauuaccauaggcagcgugucccugacaaucgccacuauuugcuuccucaugcaaaucgcuguccuuguuacgaccgugacacugcacuuuaaacaguacgaguguaacccuccaccgaauaaccagguaauguugugcgaacccacuauuaucgagagaaauauaaccgaaaucguguauuuaacaaacaccacuauugagaaggaaaucuguccuaaacuggcagaguacaggaauuggucuaagccacagugcaacauuacaggguucgcccccuuuucaaaagacaauaguauccggcuaagcgcgggaggugauauaugggucacccgcgagccuuauguguccugugacccagauaagugcuaccaauucgcucucggccaggggacgacucugaacaauggacauucuaacgacauuguucacgaucgaacccccuaucguacacuucugaugaaugaauugggcgugccuuuucaucucgguacuaagcaggucuguaucgccuggucgucaagcaguugccacgacgggaaagcauggcugcauguguguguaaccggagaugacgagaacgccacagcuuccuucauuuacaauggcagacugguugauucuaucggcagcugguccaagaaaauccucaggacccaggaaucagagugcguguguauuaacgggacgugcacugucgugaugacagacggaagugcaagcgguaaggccgauaccaaaauauuauuuaucgaggaaggcaagauugugcacacuucucugcuuuccgggucagcucaacacgucgaggaaugcagcuguuauccacgguacccgggaguucgcugcguguguagagacaacuggaagggcaguaauaggcccaucguagauauaaacgugaaagacuacucuauugucuccagcuaugugugcucggguuugguuggggacacaccucggaagaaugauucuuccucaaguagccauugucuggacccaaacaaugaggaaggaggccacggcgugaaagggugggccuucgaugacggaaacgaugucuggaugggucgcaccaucuccgagaagcuacgaucuggcuacgagacguuuaaagugaucgaaggguggagcaagcccaauucaaaacuccagauuaacagacagguaaucguugacaggggaaaucggaguggcuauuccgguauuuucagcguggaggggaagucuugcauaaaccguuguuuuuacgucgaacugauccgcggcagaaagcaggagaccgaagugcuuuggacaucaaauaguauugucguguucugcggaacuagcggcaccuaugggacaggauccuggccugauggugcggacaucaaccugaugccaaucuga

SEQ ID NO: 137879 - RNA, 1410 nt, Artificial Sequence; identical to SEQ ID NO: 136746
  derived and/or modified sequence opt3 from neuraminidase__InfluenzaA__ABS50034

SEQ ID NO: 137880 - RNA, 1410 nt, Artificial Sequence
  derived and/or modified sequence opt3 from neuraminidase__InfluenzaA__ABS50045
augaaccccaaucagaagaucauuaccauaggcagcgugucccugacaaucgccacuauuugcuuccucaugcaaacggcuauccuugucaccacaguuacucugcacuuuaaacaguacgaguguaacucuccuccaaauaaccaggugauguugugcgaaccgaccauuaucgagagaaauauaacagaaaucguauauuuaaccaacacuacaauugagaaggaaaucugucccaaacuggcagaguacaggaauuggucaaagccucagugcaacauuaccggguucgccccauuuaguaaagacaauagcauccggcuauccgcgggaggugauauaugggugacgcgcgagcccuaugucucuugugacccugauaagugcuaccaauucgcucucggccaggggacuacccugaacaauggacauucgaacgacacaauucacgaucgaacuccauaucguacccuucugaugaaugaauugggcgugcccuuucaucucgguacaagacagguuuguaucgccuggucaagcaguuccugccacgacgggaaggcauggcugcaugugugugucaccggagaugacgagaacgccacggcuucuuucauuuacaauggcaggcugguggauagcaucggcuccuggaguaaaaagauccuccggacucaggaaucagagugcguauguauuaacgggacaugcaccguugugaugacugacggaagcgcaucugguaaagccgauacaaagauauuauuuaucgaggaaggcaaaauuguccacaucuccacccugucagggagcgcucaacacguggaggaaugcaguuguuauccucgcuacccaggagugagaugcgucuguagggacaacuggaagggcucuaaucggccgauaguugauauuaacgugaaggacuacuccaucguaagcucguaugugugcucuggucuugucggggacacgccccgcaaaaaugauuccuucucaaguagccauuguuuggacccuaacaaugaggaaggaggccacggcgugaaggggugggccuuugaugacggaaacgauguuuggaugggucgaaccaucuccgagaaacugagaucuggcuacgagacauucaaggugauugaaggguggagcaaaccaaauucaaagcuacagaucaacaggcaggucauuguggagcggggaaaucguaguggcuauuccgguauauuuagcguagaagggaaaucuugcaucaaccgcuguuucuacguugagcucauuagaggcaggaaggaagagacugaggugugguggaccucaaauaguaucgucguguuuugcggaacaagcggcacuuaugggaccggauccuggcccgacggugcggauaucaaccugaugccuauuuga

SEQ ID NO: 137881 - RNA, 1410 nt, Artificial Sequence; identical to SEQ ID NO: 136170
  derived and/or modified sequence opt3 from neuraminidase__InfluenzaA__ABS50056

SEQ ID NO: 137882 - RNA, 1410 nt, Artificial Sequence; identical to SEQ ID NO: 136196
  derived and/or modified sequence opt3 from neuraminidase__InfluenzaA__ABS50067

SEQ ID NO: 137883 - RNA, 1410 nt, Artificial Sequence; identical to SEQ ID NO: 136730
  derived and/or modified sequence opt3 from neuraminidase__InfluenzaA__ABS50078

SEQ ID NO: 137884 - RNA, 1413 nt, Artificial Sequence
  derived and/or modified sequence opt3 from neuraminidase__InfluenzaA__ABS71644
augaagcccaaccagaaaaucauuaccauaggcagcaucuccauugccaucgggauuaucucucugauacuccaaaucggaaauauuaucucaauuugggcuagucacagcauccagacagagucccagaaccauacugguauaugcaaucagagaauuaucacguacgaaaacucuaccugggugaauaacacauaugucaauauuaacaauacuaacguuguggcagagaaggacaaaaccucgguaacacuugccggcaauucaagccuguguaguaucuccgggugggcgaucuacaccaaggauaacucuauuaggauaggaagcaaaggcgacguguucgucauccgggaaccuuuuauuuccugcucacacuuggagugucgcacuuucuuuuuaacacaaggugcucugcuaaaugauaagcauaguaacgggaccgugaaggaccgaagcccauaucgugcccucaugucuugcccgcugggagaagcacccuccccuuacaauucaagauucgagagcguugccuggagugcuucugcaugucacgauggcaugggcuggcuuacgaucgggauauccggaccagacaacggugccguggcuguccugaaauauaacggcauuaucacugagaccaucaagagcuggaaaaagaggauuuugcggacacaggaaucggagugcguguguaugaaugggucuugcuuuacuaucaugaccgauggacccuccaacggcgccgcgucauacaaaauuuucaagauagaaaaggguaaaguaacaaagaccauggagcucaaugcaccuaacuuucauuaugaggaauguaguugcuacccagacacggggacuguuaugugugugugccgcgauaauuggcacggaagcaacagacccugggucuccuucaaucagaaccuggacuaccagaucggcuauauuugcucuggcguguuuggggauaauccuaggccaaaagacggagaggguagcuguaacccggugacagucgauggcgccgacgggguuaagggauucucauacaaauauggcaaugguguguggauggggcggaccaagaguaaccgccugcgaaaaggcuuugaaaugaucugggaccccaauggauggacuaacacagauuccgacuucagcguaaagcaagauguggucgcuaucaccgacuggucuggcuacucagggaguuuugugcagcacccugagcucacgggauuagauugcauuagaccauguuucuggguugaacuggugaggggucuuccccgggagaauaccacaauauggacuagcggcuccucuaucucguucugcggggucaacagcggaaccgccaacugguccuggccugacggcgcagaguugccauuuacaauugauaaguga

SEQ ID NO: 137885 - RNA, 1413 nt, Artificial Sequence
  derived and/or modified sequence opt3 from neuraminidase__InfluenzaA__ABS71646
augaaccccaaucagaagaucauuaccauaggcagcaucuccauugccaucgggauuaucucucugauacuccaaaucggaaacauuaucucaauuugggcuagucacagcauccagacagagucccagaaucauacugguauaugcaaccagagaauuaucacguacgaaaauucuaccugggugaacaauacauaugucaacauuaauaacacuaauguuguggcagagaaagacaagaccucgguaacacuugccggcaacucaagccuguguaguaucuccgggugggcgaucuacaccaaagauaauucuauuaggauaggaagcaagggcgacguguucgucauccgggaaccuuuuauuuccugcucacacuuggagugucgcacuuucuuuuuaacacaaggugcucugcuaaacgauaaacauaguaaugggaccgugaaggaccgaagcccauaucgugcccucaugucuugcccgcugggagaagcacccuccccuuacaacucaagauucgagagcguugccuggagugcuucugcaugucacgauggcaugggcuggcuuacgaucgggauauccggaccagacaacggugccguggcuguccugaaguauaauggcauuaucacugagaccaucaaaagcuggaagaaaaggauuuugcggacacaggaaucggagugcguguguaugaacgggucuugcuuuacuaucaugaccgauggacccuccaauggcgccgcgucauacaagauuuucaaaauagaaaaggguaagguaacaaaaaccauggagcucaacgcaccuaauuuucauuaugaggaauguaguugcuacccagacacggggacuguuaugugugugugccgcgauaacuggcacggaagcaauagacccugggucuccuucaaccagaaucuggacuaccagaucggcuauauuugcucuggcguguuuggggauaacccuaggccaaaggacggagaggguagcuguaauccggugacagucgauggcgccgacgggguuaaaggauucucauacaaguauggcaacgguguguggauggggcggaccaaaaguaaucgccugcgaaagggcuuugaaaugaucugggaccccaacggauggacuaauacagauuccgacuucagcguaaaacaagauguggucgcuaucaccgacuggucuggcuacucagggaguuuugugcagcacccugagcucacgggauuagauugcauuagaccauguuucuggguugaacuggugaggggucuuccccgggagaacaccacaauauggacuagcggcuccucuaucucguucugcggggucaacagcggaaccgccaauugguccuggccugacggcgcagaguugccauuuacaauugauaaguga

SEQ ID NO: 137886 - RNA, 1413 nt, Artificial Sequence
  derived and/or modified sequence opt3 from neuraminidase__InfluenzaA__ABS71647
augaaccccaaucagaagaucauuaccauaggcagcaucuccauugccaucgggauuaucucucugauacuccaaaucggaaacauuaucucaauuugggcuagucacagcauccagacagagucccagaaucauacugguauaugcaaccagagaauuaucacguacgaaaauucuaccugggugaacaauacauaugucaacauuaauaacacuaauguuguggcagagaaagacaagaccucgguaacacuugccggcaacucaagccuguguaguaucuccgggugggcgaucuacaccaaagauaauucuauuaggauaggaagcaagggcgacguguucgucauccgggaaccuuuuauuuccugcucacacuuggagugucgcacuuucuuuuuaacacaaggugcucugcuaaacgauaaacauaguaaugggaccgugaaggaccgaagcccauaucgugcccucaugucuugcccgcugggagaagcacccuccccuuacaacucaagauucgagagcguugccuggagugcuucugcaugucacgauggcaugggcuggcuuacgaucgggauauccggaccagacaacggugccguggcuguccugaaguauaauggcauuaucacugagaccaucaaaagcuggaggaagcggauuuugcgcacacaggaaucggagugcguguguaugaacgggucuugcuuuacuaucaugaccgauggacccuccaauggcgccgcgucauacaaaauuuucaagauagaaaaagguaagguaacaaagaccauggagcucaacgcaccuaauuuucauuaugaggaauguaguugcuacccagacacggggacuguuaugugugugugcagagauaacuggcacggaagcaauaggcccugggucuccuucaaccagaaucuggacuaccagaucggcuauauuugcucuggcguguuuggggauaacccucggccaaaagacggagaggguagcuguaauccggugacagucgauggcgccgacgggguuaagggauucucauacaaauauggcaacgguguguggauggggcgcaccaagaguaaucgacugagaaaaggcuuugaaaugaucugggaccccaacggauggacuaauacagauuccgacuucagcguaaagcaagauguggucgcuaucaccgacuggucuggcuacucagggaguuuugugcagcacccugagcucacgggauuagauugcauuaggccauguuucuggguugaacuggugcggggucuuccccgugagaacaccacaauauggacuagcggcuccucuaucucguucugcggggucaacagcggagccgcaaauugguccuggccugacggcgcugaguugccauuuaccauugauaaauga

SEQ ID NO: 137887 - RNA, 1413 nt, Artificial Sequence
  derived and/or modified sequence opt3 from neuraminidase__InfluenzaA__ABS71648
augaaccccaaucagaagaucauuaccauaggcagcaucuccauugccaucgggauuaucucucugauacuccaaaucggaaacauuaucucaauuugggcuagucacagcauccagacagguaaucagaaccauacuggcauaugcaaucagagaauuaucacguacgagaacuccaccugggugaauaacacauaugucaauauuaacaauacuaacguuguggcagaaaaagacaagaccucuguaacacuugccgggaauaguucacuguguagcaucaguggaugggcgaucuacaccaaagauaacuccauuaggauaggcucuaagggugacguguucgucauccgggagccuuuuauuagcugcucccacuuggaaugucgcacuuucuuuuuaacacaaggggcucugcuaaaugauaaacauucaaacggaaccgugaaggaccgaaguccauaucgugcccucaugagcugcccgcugggcgaggcacccucuccuuacaacuccagauucgaaucaguugccuggagcgcuagugcaugucacgauggcaugggguggcuuacgaucggaauaucugguccagacaauggcgccguggcuguccugaaguauaacgggauuaucacugagaccaucaaauccuggaagaaaaggauuuugcggacacaggagagcgaaugcguguguaugaauggaucgugcuuuacuaucaugaccgauggccccucuaacggugccgcguccuacaagauuuucaaaauagagaaggggaagguaacaaaaaccaucgaacucaaugcaccuaacuuucauuaugaggaguguucaugcuacccagacacgggaacuguuaugugugugugccgcgauaauuggcacggcaguaacagacccugggucagcuucaaucagaaccuggacuaccagauuggcuauaucugcuccgggguguuuggagauaauccuaggccaaaggacggugaaggcucuuguaacccggugacagucgauggggccgacggaguuaaaggcuucagcuacaaguaugguaaugggguguggaucggccggaccaaaucaaaccgccugcgaaagggauuugagaugauuugggaccccaauggcuggacuaacacagauagugacuucuccguaaaacaagauguggucgcuauaaccgacuggagcggguacucuggaucauuugugcagcacccugaacucacggguuuagauugcaucagaccauguuucuggguugagcuggugaggggccuucccaaggaaaacaccacaauuuggacuucggggagcuccaucucuuucugcggagucaauucgggcaccgccaacuggagcuggccugacggugcagaguugccauuuacaauugauaaguga

SEQ ID NO: 137888 - RNA, 1413 nt, Artificial Sequence
  derived and/or modified sequence opt3 from neuraminidase__InfluenzaA__ABS71649
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagagaaagacaagaccucgguaacacuugccggcaauucaagccuguguaguauuuccggaugggcgaucuacaccaaagauaacucuaucaggauuggcagcaagggugacguguucgucauacgggagccuuuuaucuccugcucacauuuggaaugucgcacuuucuuuuuaacacaaggggcucugcuaaaugauaaacacaguaacggaaccgugaaggaccgaagcccauaucgugcccucaugucuugcccgcugggcgaggcacccuccccuuacaauucaaaguucgaaagcguugccuggagugcuucugcaugucaugauggcaugggguggcuuacgauuggaaucuccgguccagacaacggcgccguggcuguccugaaauauaacgggauaauuacuggaaccaucaagagcuggaaaaagcagaucuugagaacacaggagucggagugcguguguaugaauggcucuugcuuuacuauuaugaccgauggucccuccaacagggccgcgucauacaaaaucuucaagauugaaaaggggaaaguaacaaagaguauagagcucaaugcaccuaacuuucacuaugaagaguguagcugcuacccagacaccggaaucguuaugugugugugccgggauaauuggcacggcuccaaccgccccugggucucuuucaaucagaaccuggacuaccaaauuggcuauaucugcagcgggguguuuggagauaauccuagaccaaaagacggugagggcucauguaacccggugacggucgauggggccgacggaguuaagggcuucaguuacaaauaugacaaugguguguggaucgggaggacuaaguccaaccggcugcgcaaaggcuuugaaaugauuugggaucccaauggauggacaaacaccgacagcgauuucucuguaaagcaggacguggucgcuauaacugauuggucaggcuacagugggagcuuugugcagcauccugagcucacaggauuagacugcauccgaccauguuucuggguugaacuggugagaggucuucccagggagaauaccacgauuuggaccuccgggucuucgaucagcuucugcggggucaacuccgauacagccaacuggucauggccugacggagcagaauugccauuuacuauugauaaguga

SEQ ID NO: 137889 - RNA, 1413 nt, Artificial Sequence
  derived and/or modified sequence opt3 from neuraminidase__InfluenzaA__ABS71651
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgagaauaacaccugggugaaucacacauaugucaacaucaauaacacuaauguuguggcagggaaagacaagaccucuguaacacuugccggaaacucgucacuguguagcgugaguggcugggcgauuuacaccaaagauaauuccaucaggaucgguucuaagggggacgucuucgugauucgggaaccuuuuauaagcugcucccauuuggagugucgcacuuucuuuuuaacacaaggagcucugcuaaacgauaaacacucaaauggcaccguuaaggaccgaaguccauaucgugcccucaugagcugcccgcugggcgaagcacccucuccuuacaacuccaaguucgagucaguggccuggagcgcuagugcaugucaugaugggaugggauggcuuacgaucgguauuucuggcccagacaacggggccgucgcugugcugaaauauaauggaaucauaacuggcaccauuaaguccuggaaaaagagaaucuugaggacacaggaaagcgagugcguauguaugaacgguucgugcuuuacuaucaugaccgaugggcccucuaauggagccgcguccuacaaaauuuucaagaucgagaagggcaaaguuacaaagucaauugaacucaacgcaccuaguuuucacuaugaggaauguagcugcuacccagacaccggcacggugaugugugucugccgggauaauuggcacggguccaaccgccccugggugucuuucaaucagaaccuggacuaccagauaggauauaucugcagcgguguguuuggcgauaauccuagaccaaaagacggggagggaucauguaacccggucacuguugauggcgccgacggugugaagggguucaguuacaaauauggcaauggaguauggcugggcaggacaaaguccaaccggcuccgcaaaggguuugagaugauuugggaccccaauggauggaccaacacugauagcgacuucucugugaagcaagaugucguggcuaucacagacuggucagguuacaguggcagcuuuguucagcauccugaauuaaccgggcuggauugcauccgaccauguuucuggguggagcuugucagaggauugcccagggaaaauacgaccauuuggacauccggcagcucgauaucuuucugcggugugaacuccaacacugccaauuggucauggccugacggggcagagcugccauuuaccaucgauaaguga

SEQ ID NO: 137890 - RNA, 1413 nt, Artificial Sequence
  derived and/or modified sequence opt3 from neuraminidase__InfluenzaA__ABS71652
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgagaauaacaccugggugaaucacacauaugucaacaucaauaacacuaauguuguggcagggaaagacaagaccucuguaacacuugccggaaacucgucacuguguagcgugaguggcugggcgauuuacaccaaagauaauuccaucaggaucgguucuaagggggacgucuucgugauucgggaaccuuuuauaagcugcucccauuuggagugucgcacuuucuuuuuaacacaaggagcucugcuaaacgauaaacacucaaauggcaccguuaaggaccgaaguccauaucgugcccucaugagcugcccgcugggcgaagcacccucuccuuacaacuccaaguucgagucaguggccuggagcgcuagugcaugucaugaugggaugggauggcuuacgaucgguauuucuggcccagacaacggggccgucgcugugcugaaauauaauggaaucauaacugaaaccauuaaguccuggaaaaagagaaucuugaggacacaggagagcgagugcguauguaugaacggcucgugcuuuacuaucaugaccgauggucccucuaauggggccgcguccuacaaaauuuucaagaucgaaaagggaaaaguuacaaagucaauugagcucaacgcaccuaguuuucacuaugaagaguguagcugcuacccagacaccggcacggugaugugugucugccgggauaauuggcacggcuccaaccgccccugggugucuuucaaucagaaccuggacuaccagauaggguauaucugcagcggaguguuuggugauaauccuagaccaaaagacggcgaggggucauguaacccggucacuguugauggagccgacggcgugaaggguuucaguuacaaauaugggaauggcguauggauuggaaggacaaaguccaaccggcugcgcaaaggcuuugaaaugaucugggaccccaauggguggaccaacacugauagcgacuucucugugaagcaagaugucguggcuaucacagacuggucaggauacagugguagcuuuguucagcauccugagcucaccggcuuagauugcauucgaccauguuucuggguggaacuggucagagggcuucccagggagaauacgaccauauggacauccggaucuucgaucagcuucugcggcgugaacuccaacacugccaauuggucauggccugacggugcagaauugccauuuaccauugauaaguga

SEQ ID NO: 137891 - RNA, 1413 nt, Artificial Sequence
  derived and/or modified sequence opt3 from neuraminidase__InfluenzaA__ABS71653
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugauuugcccgcugggcgaagcacccucuccuuacaauuccaaguucgagucaguugccuggagcgcuagugcaugucaugaugggaugggauggcuuacgaucgguauaucuggcccagacaacggggccguggcuguccugaaauauaacggaauuaucacugaaaccaucaaguccuggaaaaagagaauuuugaggacacaggagagcgagugcguguguguaaauggcucgugcuuuacuaucaugaccgauggucccucuaacggggccgcguccuacaaaauuuucaagauagaaaagggaaaaguuacaaagucacgggagcucaaugcaccuaacuuucacuaugaagaguguaguugcuacccagacaucggcaccgugaugugugucugccgcgauaauuggcacggcagcaacagacccuggguguccuucaaucagaaccuggacuaccagauuggguauaucugcucuggaguguuuggugauaauccuaggccaaaagacggcaaggggagcuguaacccggucacggccgauggagcugacggcguuaaagguuucucauacaaguaugggaauggcguguggaucggacggacuaaaaguaaccgccugcgaaagggcuuugagaugauuugggaccccaauggguggacagauaccgacuccgauuucagcguaaagcaagacguggucgccauaacugauuggucuggauacucagguaguuuugugcagcauccugaacucacaggcuuagacugcaucagaccauguuucuggguugagcuggugagggggcuuccccgggaaaacaccacgauuuggaccagcggauccucuaucucguucugcggcgucgauagcgacacagcaaauugguccuggccugauggugcugaguugccauuuacuauugacaaauga

SEQ ID NO: 137892 - RNA, 1410 nt, Artificial Sequence
  derived and/or modified sequence opt3 from neuraminidase__InfluenzaA__ABS71655
augaaccccaucaagaaaauuauaaccaucggcagcgugucccugacaauuucuacuaucugcuucuuuaugcagauugccauccucauaacgaccgucacacuucacuucaagcaauacgaguuuaauucaccuccaaacaaucagguuaugcugugugaaccgacuaucauugagagaaacaucaccgaaauuguguauuugacaaauaccacuaucgagaaagaaauaugccccaaguuagcugaguacaggaacuggaguaaaccucaguguaauauuacaggguucgcaccauuuagcaaggacaacuccauccggcugucugccggaggugauauuuggguaacccgcgagcccuaugugucgugcgacccugauaaguguuaccaguucgcgcuaggccaagggacgacucucaauaacguccauucaaaugacaccgugcacgaucgaacaccauaucguacucugcuuaugaacgaacugggaguucccuuucauuugggcaccaaacaggugugcaucgcuuggagcaguuccucuugucacgacgguaaggccuggcuccaugucugcgugacaggggaugacaaaaaugcaaccgccagcuucaucuacaacggaagacugguagauuccauuguuucauggaguaaggagauacugaggacgcaggaaagcgagugugugugcaucaauggcacuuguacagucgugaugaccgacggcucugcuuccgggaaagcagauacuaagauucucuuuaucgaggaaggaaagauagugcacacaucaaccuuaagcgguagugcccagcacgucgaggaaugcucuugcuauccucgguacccaggcguucgcugugugugcagagacaacuggaaaggguccaacaggccgauuguagauaucaauaucaaggacuacagcauugugucgucuuaugucuguuccggacuggugggcgacacgccccggaaaaacgauucaaguagcuccucucauugccuugacccuaauaacgaggaaggugggcacggaguuaagggcugggcuuucgaugacggcaaugauguguggauggggcgcaccaucagcgagaaauugcgaucaggauacgagacauuuaaggucauugaagguuggaguaacccaaauuccaaacugcaaauaaacagacaggugaucguagacaggggcaaucggagcggguauucuggaauuuucucaguugagggcaagaguuguaucaaccguugcuuuuacguggaacuaauccgcgguagaaaggaggaaacugagguccucuggaccagcaauuccauuguggucuucugugggacaucuggcacuuauggaaccggcucguggcccgauggggccgacauaaaccugaugccuaucuga

SEQ ID NO: 137893 - RNA, 1410 nt, Artificial Sequence
  derived and/or modified sequence opt3 from neuraminidase__InfluenzaA__ABS71657
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccgacuauaaucgagagaaacauuaccgaaaucguguauuugacaaauaccacuauugagaaggaaaucugccccaaauuagcugaguacaggaacuggagcaagccucagugugacauaacaggguucgcaccauuuuccaaagauaauucuauucggcugucggccggaggugacaucuggguaacccgcgagcccuaugugucaugcgauccugacaaguguuaccaauucgcgcuaggccaggggacgacucucaacaauguccauagcaacgauaccgugcacgaccgaacaccauaucguacucugcuuaugaaugaacugggaguucccuuucauuugggcaccaaacaggugugcauugcuuggaguuccucuagcugucacgaugguaaggccuggcuccaugucugcgugacaggggacgauaagaacgcaaccgccuccuucaucuacaauggaagacugguagacucaaucguuaguuggagcaaagagauucugaggacgcaggaaucugagugugugugcauaaacggcacuuguacagucgugaugaccgauggcuccgcuucagggaaggcagacacuaaaauccucuuuauugaggaaggaaagaucgugcacacaagcaccuuaagugguucugcccaacacgucgaggaaugcuccugcuauccucgguacccaggcguucgcugugugugcagagauaauuggaaggggagcaacaggccgauaguagacauuaacaucaaagacuacucgaucgugucucgguaugucuguuccggacuggugggcgauacgccccgcaagaaugacucaaguagcuccucucauugccuugauccuaacaaugaggaaggugggcacggaguuaaaggcugggcuuucgacgauggcaacgacgccuggauggggcgaaccauuagcgagaagucaagaaguggauacgagacauuuaaagugaucgaagguugguccaauccaaacagcaaguugcagauuaauaggcaggucauaguggaucggggcaaccguucuggguauucaggaaucuucaguguagagggcaaaagcuguauuaaucgcugcuuuuacguugaacugaucagagguaggaaggaggaaacugaggugcuauggaccuccaacucuaucgucguguucugugggacaucgggcacuuauggaaccggcagcuggcccgacggggcggauauuaaucucaugccuauauga

SEQ ID NO: 137894 - RNA, 1410 nt, Artificial Sequence
  derived and/or modified sequence opt3 from neuraminidase__InfluenzaA__ABS71659
augaaccccaucaagaaaauuauaaccaucggcagcgugucccugacaauuucuacuaucugcuucuuuaugcagauugccauccucauaacgaccgucacacuucacuucaagcaguacgaguuuucaaguccuccaaauaaccagguuaugcugugugaaccgacuaucauugagagaaauaucaccgaaauuguguauuugacaaacaccacuaucgagaaagaaauaugccccaaguuagcugaguacaggaauuggagcaaaccucagugugacauuacaggguucgcaccauuuuccaaggauaacucuauccggcugucggccggaggugacauuuggguaacccgcgagcccuaugugucaugcgauccugacaaguguuaccaguucgcgcuaggccaagggacgacucucaauaacguccauagcaaugauaccgugcacgaccgaacaccauaucguacucugcuuaugaacgaacugggaguucccuuucauuugggcaccaaacaggugugcaucgcuuggaguuccucuagcugucacgaugguaaggccuggcuccaugucugcgugacaggggacgauaaaaaugcaaccgccuccuucaucuacaacggaagacugguagacucaauuguuaguuggagcaaggagauacugaggacgcaggaaucugagugugugugcaucaauggcacuuguacagucgugaugaccgauggcuccgcuucagggaaagcagacacuaagauucucuuuaucgaggaaggaaagauagugcacacaagcaccuuaagugguucugcccagcacgucgaggaaugcuccugcuauccucgguacccaggcguucgcugugugugcagagauaacuggaaagggagcaauaggccgauuguagacaucaacaucaaggacuacucgauugugucucgguaugucuguuccggacuggugggcgauacgccccgcaaaaacgacucaaguagcuccucucauugccuugauccuaauaacgaggaaggugggcacggaguuaagggcugggcuuucgacgauggcaaugacguguggauggggcgaaccaucggagagaaaagcagaucagguuacgagacauuuaaggucauugaaggcuggaguaacccaaauuccaaauugcaaauaaacaggcaagugaucguagaucgggggaaucguagcggauauucuggcauuuucucaguugaggguaagaguuguaucaaccgcugcuuuuacguggaacugaucagagggaggaaggaggaaacugagguccuauggaccagcaauuccauuguggucuucuguggcacaucuggaacuuauggcaccgggucguggcccgacggagccgauauaaaccauaugccuaucuga

SEQ ID NO: 137895 - RNA, 1410 nt, Artificial Sequence
  derived and/or modified sequence opt3 from neuraminidase__InfluenzaA__ABS71660
augaaccccaucaagaaaauuauaaccaucggcagcgugucccugacaauuucuacuaucugcuucuuuaugcagauugccauccucauaacgaccgucacacuucacuucaagcaguacgaguuuucaaguccuccaaauaaccagguuaugcugugugaaccgacuaucauugagagaaauaucaccgaaauuguguauuugacaaacaccacuaucgagaaagaaauaugccccaaguuagcugaguacaggaauuggagcaaaccucagugugacauuacaggguucgcaccauuuuccaaggauaacucuauccggcugucggccggaggugacauuuggguaacccgcgagcccuaugugucaugcgauccugacaaguguuaccaguucgcgcuaggccaagggacgacucucaauaacguccauagcaaugauaccgugcacgaccgaacaccauaucguacucugcuuaugaacgaacugggaguucccuuucauuugggcaccaaacaggugugcaucgcuuggaguuccucuagcugucacgaugguaaggccuggcuccaugucugcgugacaggggacgauaaaaaugcaaccgccuccuucaucuacaacggaagacugguagacucaauuguuaguuggagcaaggagauacugaggacgcaggaaucugagugugugugcaucaauggcacuuguacagucgugaugaccgauggcuccgcuucagggaaagcagacacuaagauucucuuuaucgaggaaggaaagauagugcacacaagcaccuuaagugguucugcccagcacgucgaggaaugcuccugcuauccucgguacccaggcguucgcugugugugcagagauaacuggaaagggagcaauaggccgauuguagacaucaacaucaaggacuacucgauugugucucgguaugucuguuccggacuggugggcgauacgccccgcaaaaacgacucaaguagcuccucucauugccuugauccuaauaacgaggaaggugggcacggaguuaagggcugggcuuucgacgauggcaaugacguguggauggggcgaaccaucagcgagaaaucaagaaguggauacgagacauuuaaggucauugaagguugguccaacccaaauagcaaauugcaaauaaacaggcaagugaucguagaucggggcaaucguucuggguauucaggaauuuucaguguugagggcaagagcuguaucaaccgcugcuuuuacguggaacugaucagagguaggaaggaggaaacugagguccuauggaccuccaauucuauuguggucuucugugggacaucgggcacuuauggaaccggcagcuggcccgacggggccgauauaaaccucaugccuaucuga

SEQ ID NO: 137896 - RNA, 1410 nt, Artificial Sequence
  derived and/or modified sequence opt3 from neuraminidase__InfluenzaA__ABS71661
auguaccccaucaagaaaauuauaaccaucggcagcgugucccugacaauuucuacuaucugcuucuuuaugcagauugccauccucauaacgaccgucacacuucacuucaagcaguaugaguuuucaaguccuccaaacaaucagguuaugcugugugaaccgacuaucauugagagaaacaucaccgaaauuguguacuugacaaauaccacuaucgagaaagaaauaugccccaaguuagcugaguauaggaacuggagcaaaccucagugugacauuacaggguucgcaccauuuuccaaggauaauucuauccggcugucggccggaggugacauuuggguaacccgcgagcccuacgugucaugcgauccugacaaguguuaucaguucgcgcuaggccaagggacgacucucaacaauguccauagcaacgauaccgugcacgaccgaacaccauaccguacucugcuuaugaaugaacugggaguucccuuucauuugggcaccaaacaggugugcaucgcuuggaguuccucuagcugucacgaugguaaggccuggcuccaugucugcgugacaggggacgauaaaaacgcaaccgccuccuucaucuauaauggaagacugguagacucaauuguuaguuggagcaaggagauacugaggacgcaggaaucugagugugugugcaucaacggcacuuguacagucgugaugaccgauggcuccgcuucagggaaagcagacacuaagauucucuuuaucgaggaaggaaagauagugcacacaagcaccuuaagugguucugcccagcacgucgaggaaugcuccugcuacccucgguacccaggcguucgcugugugugcagagauaauuggaaagggagcaacaggccgauuguagacaucaauaucaaggacuauucgauugugucucgguacgucuguuccggacuggugggcgauacgccccgcaaaaacgacucaaguagcuccucucauugccuugauccuaacaaugaggaaggugggcacggaguuaagggcugggcuuucgacgauggcaacgacguguggauggggcgaaccaucagcgagaaaucaagaaguggauaugagacauuuaaggucauugaagguugguccaauccaaacagcaaauugcaaauaaauaggcaagugaucguagaucggggcaaccguucuggguacucaggaauuuucaguguugagggcaagagcuguaucaaucgcugcuuuuauguggaacugaucagagguaggaaggaggaaacugagguccuauggaccuccaacucuauuguggucuucugugggacaucgggcacuuacggaaccggcagcuggcccgacggggccgauauaaaucucaugccuaucuga

SEQ ID NO: 137897 - RNA, 1410 nt, Artificial Sequence
  derived and/or modified sequence opt3 from neuraminidase__InfluenzaA__ABS71662
augaaccccaucaagaaaauuauaaccaucggcagcgugucccugacaauuucuacuaucugcuucuuuaugcagauugccauccucauaacgaccgucacacuucacuucaagcaauacgaguuuaauucaccuccaaacaaucagguuaugcugugugaaccgacuaucauugagagaaacaucaccgaaauuguguauuugacaaauaccacuaucgagaaagaaauaugccccaaguuagcugaguacaggaacuggaguaaaccucagugugacauuacaggguucgcaccauuuagcaaggauaauuccauccggcugucugccggaggugacauuuggguaacccgcgagcccuaugugucgugcgauccugacaaguguuaccaguucgcgcuaggccaagggacgacucucaacaauguccauucaaacgauaccgugcgagaccguacaccauauagaacucugcuuaugaaugaacugggaguucccuuucacuugggcaccaaacaggugugcaucgcuuggagcaguuccucuugucaugaugguaaggccuggcuccacgucugcaucacaggggacgauaaaaacgcaaccgccagcuucauuuacaauggaaggcugguggacuccauaguaucauggaguaaggagauccugcggacgcaggaaagcgaguguguuugcauuaacggcacuuguacaguggucaugaccgauggcucugcuuccgggaaagcagacacuaagauccucuuuauagaggaaggaaagauugugcauacaucaaccuuaagcgguagugcccagcacguggaggaaugcucuugcuauccucgcuacccaggcgucagauguguuugcagggauaauuggaaaggguccaaccggccgaucguggacaucaacauuaaggaccacagcaucguaucgucuuacguguguuccggacuggucggcgauacgccccgcaaaaaugacucaaguagcuccucucauugccuugauccuaacaaugaggaaggugggcacggagugaagggcugggcuuucgacgauggcaacgacguuuggauggggcgaaccauuagcgagaaaucaagauugggauaugagacauuuaaggugauagaagguuggaguaauccaaacuccaaacugcaaaucaauaggcaggucauuguggaucggggcaaccguagcggguacucuggaaucuucucaguagagggcaagaguuguaucaaucgcugcuuuuauguugaacuaauuagagguaggaaggaggaaacugaggugcucuggaccagcaacuccauagucguguucugugggacaucuggcacuuacggaaccggcucguggcccgacggggccgauaucaaucugaugccuauuuga

SEQ ID NO: 137898 - RNA, 1410 nt, Artificial Sequence
  derived and/or modified sequence opt3 from neuraminidase__InfluenzaA__ABS71663
auguaccccaucaagaaaauuauaaccaucggcagcgugucccugacaauuucuacuaucugcuucuuuaugcagauugccauccucauaacgaccgucacacuucacuucaagcaauaugaguuuaacucaccuccaaauaaccagguuaugcugugugaaccgacuaucauugagagaaauaucaccgaaauuguguacuugacaaacaccacuaucgagaaagaaauaugccccaaguuagcugaguauaggaauuggaguaaaccucagugugacauuacaggguucgcaccauuuagcaaggauaacuccauccggcugucugccggaggugacauuuggguaacccgcgagcccuacgugucgugcgauccugacaaguguuaucaguucgcgcuaggccaagggacgacucucaauaacguccauucaaaugauaccgugcgagaccguacaccauacagaacucugcuuaugaacgaacugggaguucccuuucacuugggcaccaaacaggugugcaucgcuuggagcaguuccucuugucaugaugguaaggccuggcuccacgucugcaucacaggggacgaucagaaugcaaccgccagcuucauuuauaacggaaggcugguggacuccauaguaucauggaguaaagagauccugcggacgcaggaaagcgaguguguuugcauuaauggcacuuguacaguggucaugaccgauggcucugcuuccgggaaggcagacacuaaaauccucuuuauagaggaaggaaagauugugcauacaucaaccuuaagcgguagugcccaacacguggaggaaugcucuugcuacccucgcuacccaggcgucagauguguuugcagggauaacuggaagggguccaaucggccgaucguggacaucaacauuaaagaccacagcaucguaucgucuuauguguguuccggacuggucggcgauacgccccgcaagaacgacucaaguagcuccucucauugccuugauccuaauaacgaggaaggugggcacggagugaaaggcugggcuuucgacgauggcaaugacguuuggauggggcgaaccauuagcgagaagucaagauugggauacgagacauuuaaagugauagaagguuggaguaacccaaauuccaagcugcagaugaacaggcaggucaucguggaucggggcaaucguagcggguauucuggaauuuucucaguagagggcaaaaguuguaucaaccgcugcuuuuacguugaacuaaucagagguaggaaggaggaaacugaggugcucuggaccagcaauuccauugucguguucugugggacaucuggcacuuauggaaccggcucguggcccgacggggccgauauaaaccugaugccuaucuga

SEQ ID NO: 137899 - RNA, 1410 nt, Artificial Sequence
  derived and/or modified sequence opt3 from neuraminidase__InfluenzaA__ABU40956
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaauuguuaccaauucgcgcuaggccaggggacgacucucaacaauguccauucaaacgauaccgugcgagaccguacaccauauagaacucugcuuaugaaugaacugggaguucccuuucacuugggcaccaaacaggugugcauugcuuggagcaguuccucuugucaugaugguaaggccuggcuccacgucugcaucacaggggacgauaagaacgcaaccgccagcuucaucuacaauggaaggcugguggacuccauuguaucauggaguaaggagauacugcggacgcaggaaagcgaguguguuugcaucaacggcacuuguacaguggucaugaccgauggcucugcuuccgggaaagcagacacuaagauucucuuuaucgaggaaggaaaaauagugcauacaucaaccuuaagcgguagugcccaacacguggaggaaugcucuugcuauccucgcuacccaggcgucagauguguuugcagggauaacuggaagggguccaaucggccgauuaucgacaucaacauuaaggaccacagcaucgugucgucuuacguauguuccggacuggugggcgauacgccccgcaaaaaugacucaaguagcuccucucauugccuugauccuaacaaugaggaaggugggcacggagucaagggcugggcuuucgacgauggcaacgacguguggauggggcgaaccauuagcgagaaaucaagauugggauaugagacauuuaagguuauagaagguuggaguaauccaaaauccaagcugcagaucaacaggcaagugauugucgaucggggcaaucguagcggguacucuggaaucuucucaguggagggcaaaaguuguaucaaccgcugcuuuuauguagaacuaauuagagguaggaaggaggaaacugagguucucuggaccagcaauuccauaguggucuucugugggacaucuggcacuuacggaaccggcucguggcccgacggggccgauaucaaccugaugccuauuuga

SEQ ID NO: 137900 - RNA, 1410 nt, Artificial Sequence
  derived and/or modified sequence opt3 from neuraminidase__InfluenzaA__ABU50651
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaagggguccaaccggccgauuguggacaucaauaucaaagaccacagcauuguaucgucuuacguguguuccggacuggucggcgauacgccccgcaagaacgacucaaguagcuccucucauugccuugauccuaauaacgaggaaggugggcacggagugaaaggcugggcuuucgacgauggcaaugacguuuggauggggcgaaccaucagcgagaagucaagauugggauaugagacauuuaaagugauugaagguuggaguaacccaaaguccaaacugcagauaaauaggcaggucaucguggaucggggcaaccguagcggguacucuggaauuuucucaguagagggcaagaguuguaucaaucgcugcuuuuauguugaacuaaucagagguaggaaggaggaaacugaggugcucuggaccagcaacuccauugucguguucugugggacaucuggcacuuacggaaccggcucguggcccgacggggccgauauaaaucugaugccuaucuga

SEQ ID NO: 137901 - RNA, 1410 nt, Artificial Sequence
  derived and/or modified sequence opt3 from neuraminidase__InfluenzaA__ABU80180
augaaccccaaucagaagaucauuaccauaggcagcgugucccugacaaucgccacuauuugcuuccucaugcaaaucgcuauucuugucacgaccguuacacugcacuuuaaacaguacgaguguaacucuuucccuaauaaccaggugauguugugcgaaccaacuaucauagagagaaauaucaccgaaauuguauauuuaacaaacaccacuaucgagaaggaaauuuguccgaaacuggcagaguacaggaauuggucaaagccccagugcaacaucacaggguuugccccuuucaguaaagacaauagcauacggcuauccgcgggaggugauauuugggugacccgcgagccauaugucucuugugaccccgauaagugcuaccaauuugcucucggccaggggacgacucugaacaauggacauucgaacgacaccgugcacgaucgaacaccuuaucguacucuucugaugaaugaauugggcguuccauuccaucucgguaccaaacagguguguaucgccuggucaagcaguuccugccacgacgggaaggcauggcugcaugucugugugacaggagaugacgagaacgccaccgcuucuuuuauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauucaucgaggaaggcaagauugugcacacauccucacugagcgggagugcucaacacguggaggaaugcucuuguuauccccgguacccuggaguccgcugcguuuguagagacaacuggaagggcuccaauaggccaaucguggauauaaacguaaaagacuacagcauugugucgucuuaugucugcuccggucuugugggggacaccccgcggaagaaugauucaaguagcuccucucauuguuuggaccccaacaaugaggaaggaggccacggcguuaaagggugggccuuugaugacggaaacgauguguggaugggucgcacgaucagcgagaagcugcgaucaggcuacgagaccuucaaagucaucgaaggguggaguaagccuaauuccaaacuacagauuaacagacaggugaucguagacaggggaaaucggagcggcuauucugguauauuuucaguugaggggaagaguugcauuaaccguuguuucuacguggaacucauccgcggcagaaagcaggagacagaaguccuguggacuagcaauuccauuguggucuuuugcggaaccucuggcacauaugggacuggaucguggccagauggugcggacaucaaccuuaugcccaucuga

SEQ ID NO: 137902 - RNA, 1413 nt, Artificial Sequence; identical to SEQ ID NO: 136844
  derived and/or modified sequence opt3 from neuraminidase__InfluenzaA__ABU80301

SEQ ID NO: 137903 - RNA, 1413 nt, Artificial Sequence
  derived and/or modified sequence opt3 from neuraminidase__InfluenzaA__ABU80312
augaacaccaaucagaagaucauuacaauaggcagcaucuccauugccaucgggauuaucucucugaugcuccaaauaggaaacaucauuucaaucugggcuagucacagcauucagacugguucccagaaucauacgggcaucugcaaccagagaauaauuaccuacgaaaauucuacaugggugaaccacacuuaugucaauaucaacaauaccaacguuguggcagggaaagacaagacaucgguaacccuugccggaaauucaagccuguguaguauuuccggcugggcgaucuacacuaaagauaacucuaucaggauugguagcaagggggacguguucgucaugcgggagcccuuuauauccugcucacauuuggagugucgcacauucuuuuuaacccaaggagcucugcuaaaugauaaacacaguaacggcacggugaaggaccgaagcccuuaucgugcccucaugucuugcccacugggcgaagcaccgucccccuacaauucaaaguucgagagcguugccuggagugcuucugcaugucaugaugggaugggauggcuuacuaucgguauuuccggcccugacaacggggccguggcuguccugaaauauaacggaaucauaaccgaaacaauuaagagcuggaaaaagagaaucuugaggacucaggagucggagugcguguguguaaauggcucuugcuuuaccaucaugacagaugguccauccaacggggccgcgucauacaaaauuuucaagaucgaaaagggaaaaguuaccaagaguauugagcucaaugcacccaacuuucacuaugaagaguguagcugcuacccugacacgggcacugugaugugugucugccgggauaauuggcacggcuccaaccgcccaugggugucuuucaaucagaaccuggacuaccagauaggguauaucugcagcggaguguuuggugauaaucccagaccuaaagacggcgaggggucauguaacccagucacaguugauggagccgacggcgugaaggguuucaguuacaaauaugggaauggcguauggauuggaaggaccaaguccaaccggcugcgcaaaggcuuugaaaugaucugggacccgaauggguggacugauacagacagcaacuucucugugaagcaagaugucguggcuaucaccgacuggucaggauacagugguagcuuuguucagcaucccgagcucacgggcuuagauugcauucgaccuuguuucuggguggaacuggucagagggcuuccaagggagaauaccacaauauggacuuccggaucuucgaucagcuucugcggcgugaacuccgacaccgccaacuggucauggcccgauggugcagaauugccuuuuacaauugacaaguga

SEQ ID NO: 137904 - RNA, 1410 nt, Artificial Sequence; identical to SEQ ID NO: 136746
  derived and/or modified sequence opt3 from neuraminidase__InfluenzaA__ABU80323

SEQ ID NO: 137905 - RNA, 1410 nt, Artificial Sequence
  derived and/or modified sequence opt3 from neuraminidase__InfluenzaA__ABU80334
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagacgcuccggacucaggaaucagagugcguuuguaucaacgggacaugcaccguggucaugacugacggaagcgcaucugguaaagccgauacaaagauuuuauuuauagaggaaggcaaaaucauucacaucuccacccugucagggagcgcucaacacguggaggaaugcaguuguuauccucgcuacccaggagugagaugcgucuguagggacaacuggaagggcucuaaucggccgauaguugauauuaacgugaaggacuacuccaucguaagcucguaugugugcucuggucuugucggggacacgccccgcaaaaaugauuccuucucaaguagccauuguuuggacccuaacaaugaggaaggaggccacggcgugaaggggugggccuuugaugacggaaacgauguuuggaugggucgaaccaucuccgagaaacugagaucuggcuacgagacauucaaggugauugaaggguggagcaaaccaaauucaaagcuacagaucaacaggcaggucauuguggagcggggaaaucguaguggcuauuccgguauauuuagcguagaagggaaaucuugcaucaaccgcuguuucuacguugagcucauuagaggcaggaaggaagagacugaggugugguggaccucaaauaguaucgucguguuuugcggaacaagcggcacuuaugggaccggauccuggcccgacggugcggauaucaaccugaugccuauuuga

SEQ ID NO: 137906 - RNA, 1410 nt, Artificial Sequence; identical to SEQ ID NO: 136170
  derived and/or modified sequence opt3 from neuraminidase__InfluenzaA__ABU92762

SEQ ID NO: 137907 - RNA, 1410 nt, Artificial Sequence
  derived and/or modified sequence opt3 from neuraminidase__InfluenzaA__ABU92764
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauggagagaaauauaaccgaaaucguauauuuaacaaacaccacuauugagaaggaaaucugucccaaacuggcagaguacaggaauuggucaaagccucagugcaacgugacaggguucgccccauuuaguaaagacaauagcauucggcuauccgcgggaggugauaucugggucacccgcgagcccuaugugucuugugacccugauaagugcuaccaauucgcucucggccaggggacgacucugaacaauggacauucgaacgacaccguucacgaucgaacaccauaucguacucuucugaugaaugaauugggcgugcccuuucaucucgguaccagacaggucuguauagccuggucaagcaguuccugccacgacgggaaggcauggcugcauguguguguaacaggagaugacgagaacgccaccgcuucuuucauuuacaauggcaggcugguugauagcaucggcuccuggaguaaaaagauucuccggacgcaggaaucagagugcguguguaucaacgggacuugcacagucgugaugaccgacggaagcgcaucugguaaagccgauacuaagaucuuauuuauugaggaaggcaaaauagugcacaucuccacacugucagggagcgcucaacacgucgaggaaugcaguuguuauccucgcuacccaggaguuagaugcguguguagggacaacuggaagggcucuaaucggccgauuguagauaucaacgugaaggacuacuccauagucagcucguaugugugcucuggucuuguuggggacacgccccgcaaaaaugauuccuucucaaguagccauuguuuggacccuaacaaugaggaaggaggccacggcgugaaggggugggccuuugaugacggaaacgaugucuggaugggucgaaccauuuccgagaaacugagaucuggcuacgagaccuucaaggugaucgaaggguggagcaaaccaaauucaaagcuacagaucaacaggcagguaauuguugagcggggaaaucguaguggcuauuccgguaucuuuagcguggaagggaaaucuugcauuaaccgcuguuucuacgucgagcucauaagaggcaagaaggaagagacagaggugugguggacuucaaauaguaucgucguguuuugcggaaccagcggcacauaugggacuggauccuggcccgacggugcggauauuaaccugaugccuaucuga

SEQ ID NO: 137908 - RNA, 1410 nt, Artificial Sequence; identical to SEQ ID NO: 136170
  derived and/or modified sequence opt3 from neuraminidase__InfluenzaA__ABU92765

SEQ ID NO: 137909 - RNA, 1410 nt, Artificial Sequence; identical to SEQ ID NO: 136170
  derived and/or modified sequence opt3 from neuraminidase__InfluenzaA__ABU92766

SEQ ID NO: 137910 - RNA, 1410 nt, Artificial Sequence; identical to SEQ ID NO: 136170
  derived and/or modified sequence opt3 from neuraminidase__InfluenzaA__ABU92767

SEQ ID NO: 137911 - RNA, 1410 nt, Artificial Sequence; identical to SEQ ID NO: 136170
  derived and/or modified sequence opt3 from neuraminidase__InfluenzaA__ABU92768

SEQ ID NO: 137912 - RNA, 1410 nt, Artificial Sequence; identical to SEQ ID NO: 136077
  derived and/or modified sequence opt3 from neuraminidase__InfluenzaA__ABU92769

SEQ ID NO: 137913 - RNA, 1410 nt, Artificial Sequence; identical to SEQ ID NO: 136269
  derived and/or modified sequence opt3 from neuraminidase__InfluenzaA__ABU92770

SEQ ID NO: 137914 - RNA, 1410 nt, Artificial Sequence
  derived and/or modified sequence opt3 from neuraminidase__InfluenzaA__ABU92771
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccuaacaagugcuaccaauucgcucucggccaggggacgacucugaauaacggacauucgaaugauaccgugcacgaccgaacaccauaucguacucuucugaugaacgaauugggcguucccuuucaucucgguaccaaacagguguguaucgccuggucaagcaguuccugccacgaugggaaggcauggcugcaugucugugugacaggagacgaugagaaugccaccgcuucuuucauuuacaacggcagacugguagacagcaucggcuccuggucaaagaaaauccucaggacgcaggaaagugagugcguuuguauuaacgggacuugcacaguggucaugaccgauggaagcgcaucugguaaggccgacacuaaaauauuauuuaucgaggaaggcaagauugugcacacaucccugcuuucagggagcgcucaacacguggaggaaugcaguuguuauccucgguacccaggaguccgcugcguuuguagagauaauuggaagggcucuaacaggccgaucguggacauaaauguaaaagauuacuccauugugagcucguaugucugcucugguuuggugggggacacuccccggaagaacgacuccucaaguagcucccauugucuggauccuaauaacgaggaaggaggccacggcguuaaagggugggccuucgacgauggaaaugacguguggaugggucgcacgaucucugagaagcuacgaagcggcuacgagaccuuuaaagucaucgaaggguggucaaagccaaacaguaaacuccagauuaauagacaggugaucguagauaggggaaaccgguccggcuauagcgguauuuucucuguugaggggaagucaugcauaaaucguuguuuuuacguggaacugauccgcggcagaaagcaggagacagaaguccuuuggaccaguaacagcauuguggucuucugcggaaccuccggcacauaugggacuggaucuuggcccgacggugcggauaucaaucugaugccuaucuga

SEQ ID NO: 137915 - RNA, 1410 nt, Artificial Sequence
  derived and/or modified sequence opt3 from neuraminidase__InfluenzaA__ABU92772
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaacauccuccggacgcaggaaucagagugcguuuguauuaacgggacuugcacaguggucaugaccgacggaagcgcaucugguaaggccgauacuaaaauauuauuuaucgaggaaggcaagauugugcacaucuccacacugucagggagcgcucaacacguggaggaaugcaguuguuauccucgcuacccaggagucagaugcguuuguagggacaauuggaaaggcucuaaccggccgauaguggauauuaauguaaaggacuacuccaucgugagcucguaugucugcucuggucuugugggggacacccccaggaagaacgauuccuucucaaguagccauuguuuggacccuaauaacgaggaaggaggccacggcguuaaagggugggccuuugaugacggaaaugauguguggaugggucgaacgaucuccgagaagcugagaucuggcuacgagaccuucaaagucauugaaggguggagcaagccaaacucaaaacuacagaucaaucgccaggugauuguagagcggggaaaccguaguggcuauuccgguauauuuagcguugaagggaagucuugcaucaaucgcuguuucuacguggagcucauuagaggcaggaaagaagagacagaggucugguggacuucaaacaguaucguggucuuuugcggaaccagcggcacauaugggacuggauccuggcccgacggugcggauaucaaucugaugccuauuuga

SEQ ID NO: 137916 - RNA, 1410 nt, Artificial Sequence
  derived and/or modified sequence opt3 from neuraminidase__InfluenzaA__ABU92773
augaaccccaaucagaagaucauuaccauaggcagcgugucccugacaaucgccacuauuugcuuccucaugcagaucgcuauucuugucacgaccguuacacugcacuuuaaacaguacgaguguaacucuccuccaaauaaccaggugauguugugcgaaccgacuaucauagagagaaauaucaccgaaacaguauauuuaaccaacacuacaauugagaaggaaaucugucccaaacuggcagaguacaggaauuggucaaagccucagugcaacauuaccggguucgccccauuuaguaaagacaauagcauccggcuauccgcgggaggugauauaugggugacgcgcgagcccuaugucucuugugacccugauaagugcuaccaauucgcucucggccaggggacuacccugaacaauggacauucgaacgacacagugcacgaucgaacuccauaucguacccuucugaugaaugaauugggcguucccuuucaucucgguacaagacagguguguauugccuggucaagcaguuccugccacgacgggaaggcauggcugcaugucugugugaccggagaugacgagaacgccacggcuucuuucaucuacaauggcaggcugguagauagcauuggcuccuggaguaaaaagauccuccggacucaggaaucagagugcguuuguaucaacgggacaugcaccguggucaugacugacggaagcgcaucugguaaagccgauacaaagauuuuauuuauagaggaaggcaaaaucgugcacauuuccacccugucagggagcgcucaacacguggaggaaugcaguuguuauccucgcuacccaggagucagaugcguuuguagggacaacuggaagggcucuaaucggccgaucguggauauaaacguaaaggacuacuccauugugagcucguaugucugcucuggucuugugggggacacgccccgcaaaaaugauuccuucucaaguagccauuguuuggacccuaacaaugaggaaggaggccacggcguuaaggggugggccuuugaugacggaaacgauguguggaugggucgaaccaucuccgagaaacugagaucuggcuacgagacauucaaggucaucgaaggguggagcaaaccaaauucaaagcuacagacuaacaggcaagugauuguagagcggggaaaucguaguggcuauuccgguaucuuuagcguugaagggaaaucuugcauuaaccgcuguuucuacguggagcucauaagaggcaggaaggaagagaccgaggucugguggacaucaaauaguaucguggucuuuugcggaacuagcggcaccuaugggacaggauccuggcccgacggugcggauauuaaccugaugccuaucuga

SEQ ID NO: 137917 - RNA, 1410 nt, Artificial Sequence
  derived and/or modified sequence opt3 from neuraminidase__InfluenzaA__ABU92774
augaaccccaauagaaagaucauuaccauaggcagcgugucccugacaaucgccacuauuugcuuccucaugcagaucgcuauucuugucacgaccguuacacugcacuuuaaacaauacgaguguaacucuccuccaaauaaccaggugauguugugcgaaccgacuaucauagagaggaauaucaccgaaacaguauauuuaaccaacacuacaauugagaaggaaaucugucccaaacuggcagaguaccggaauuggucaaagccucagugcaacauuaccggguucgccccauuuaguaaagacaauagcauccgccuauccgcgggaggugauauaugggugacgcgagagcccuaugucucuugugacccugauaagugcuaccaguucgcucucggccaagggacuacccugaacaauggacauucgaacgacacagugcacgaucguacuccauauagaacccuucugaugaaugaauugggcguucccuuucaucucgguacacgacagguguguauugccuggucaagcaguuccugccacgacgggaaggcauggcugcaugucugugugaccggagaugacgagaacgccacggcuucuuucaucuacaauggccggcugguagauagcauuggcuccuggaguaaaaagauccuccgcacucaggaaucagagugcguuuguaucaacgggacaugcaccguggucaugacugacggaagcgcaucugguaaagccgauacaaagauuuuauuuauagaggaaggcaaaaucgugcacauuuccacccugucagggagcgcucagcacguggaggaaugcaguuguuauccuagauacccaggagucaggugcguuugucgggacaacuggaagggcucuaaucgcccgaucguggauauaaacguaaaggacuacuccauugugagcucguaugucugcucuggucuugugggggacacgcccaggaaaaaugauuccuucucaaguagccauuguuuggacccuaacaaugaggaaggaggccacggcguuaaggggugggccuuugaugacggaaacgauguguggauggguagaaccaucuccgagaaacugaggucuggcuacgagacauucaaggucaucgaaggguggagcaaaccaaauucaaagcuacaaacuaaccgucaggugauuguagagcggggaaaucgcaguggcuauuccgguaucuuuagcguugaagggaaaucuugcauuaacagauguuucuacguggagcucauaaggggccggaaggaagagaccgaggucugguggacaucaaauaguaucguggucuuuugcggaacuagcggcaccuaugggacaggauccuggcccgacggugcggauauuaaccugaugccuaucuga

SEQ ID NO: 137918 - RNA, 1410 nt, Artificial Sequence
  derived and/or modified sequence opt3 from neuraminidase__InfluenzaA__ABU92775
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacaaaaacgccaccgcuucuuucauuuacaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauugugcacaucuccacacugucagggagcgcucaacacguggaagagugcaguuguuauccucgcuacccaggagucagaugcguuuguagggacaacuggaagggcucuaaucggccgauaguggauauuaacguaaaagacuacuccaucgugagcucguaugucugcucuggucuugugggggacacccccaggaagaaugauuccuucucaaguagccauuguuuggacccuaacaaugaagagggaggccacggcguuaaagggugggccuuugaugacggaaacgauguguggaugggucgaacgaucuccgaaaagcugagaucuggcuacgagaccuucaaagucauugagggguggagcaagccaaauucaaaacuacagaucaaccgccaggugauuguagaacggggaaaucguaguggcuauuccgguauauuuagcguugaggggaagucuugcaucaaccgcuguuucuacguggaacucauuagaggcaggaaggaggaaacagaggucugguggacuucaaauaguaucguggucuuuugcggaaccagcggcacauaugggacuggauccuggcccgacggugcggauaucaaccugaugccuauuuga

SEQ ID NO: 137919 - RNA, 1410 nt, Artificial Sequence; identical to SEQ ID NO: 136343
  derived and/or modified sequence opt3 from neuraminidase__InfluenzaA__ABU92777

SEQ ID NO: 137920 - RNA, 1410 nt, Artificial Sequence
  derived and/or modified sequence opt3 from neuraminidase__InfluenzaA__ABU92778
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaguaugccccaaauuagcugaguacaggaauuggaguaagccucaguguaacaucacaggguucgcaccauuuagcaaagacaauuccauacggcugucugccggaggugauauuugggugacccgcgagcccuaugucucgugcgacccugauaaguguuaccaauucgcgcuaggccaggggacgacucucaacaaugugcauucaaacgacaccguucacgaucgaacaccauaucguacucugcuuaugaaugaacugggagugcccuuucauuugggcaccaagcaggucugcaucgcuuggagcaguuccucuugucacgacgguaaagccuggcuccaugugugcguaacaggggaugacaagaacgcaaccgccagcuucauuuacaauggaagacugguugauuccaucgugucauggaguaaagagauccugaggacgcaggaaagcgagugugucugcauuaacggcacuuguacaguggugaugaccgacggcucugcuuccgggaaggcagauacuaaaauacucuuuaucgaggaaggaaagauuguccacacaucaaccuuaagcgguagugcccaacacguugaggaaugcucuugcuauccucgguacccaggcgugcgcuguguaugcagagacaacuggaagggguccaauaggccgaucguggauauaaacauuaaagacuacagcaucgucucgucuuauguguguuccggacugguuggcgacacgccccggaagaaugauucaaguagcuccucucauugccuugacccuaacaaugaggaaggugggcacggagugaaaggcugggcuuucgaugacggcaacgaugucuggauggggcgcaccaucagcgagaaguugcgaucaggauacgagacauuuaaagugauugaagguuggaguaauccaaacuccaagcugcagaucaauagacagguaauuguugacaggggcaaccggagcggguauucuggaauauucucaguggagggcaaaaguuguaucaaucguugcuuuuacgucgaacuaauucgcgguagaaaggaggaaacugaggugcucuggaccagcaacuccaucgucguguucugugggacaucuggcacuuauggaaccggcucguggcccgauggggccgacaucaaucugaugccuauuuga

SEQ ID NO: 137921 - RNA, 1410 nt, Artificial Sequence; identical to SEQ ID NO: 136241
  derived and/or modified sequence opt3 from neuraminidase__InfluenzaA__ABU92779

SEQ ID NO: 137922 - RNA, 1410 nt, Artificial Sequence; identical to SEQ ID NO: 136241
  derived and/or modified sequence opt3 from neuraminidase__InfluenzaA__ABU92780

SEQ ID NO: 137923 - RNA, 1410 nt, Artificial Sequence; identical to SEQ ID NO: 136241
  derived and/or modified sequence opt3 from neuraminidase__InfluenzaA__ABU92781

SEQ ID NO: 137924 - RNA, 1410 nt, Artificial Sequence
  derived and/or modified sequence opt3 from neuraminidase__InfluenzaA__ABU92782
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacaccccgcaagaaugauuccuucucaaguagccacuguuuggacccuaacaaugaagagggaggccauggcguuaaagggugggcguuugaugacggaaacgauguguggaugggucgaaccaucuccgaaaagcugagaucuggcuaugagacguucaaagucauugagggguggagcaagccaaauucaaaacuacagaucaacaggcaagugauuguagaacggggaaaucguaguggcuacuccgguauauuuagcguugaggggaagucuugcaucaaccgcuguuucuauguggaacucauuagaggcaggcgggaggaaaccgaggucugguggacaucaaauaguaucguggucuuuugcggaacuagcggcaccuacgggacaggauccuggcccgacggugcagauaucaaccugaugccuauuuga

SEQ ID NO: 137925 - RNA, 1410 nt, Artificial Sequence; identical to SEQ ID NO: 136241
  derived and/or modified sequence opt3 from neuraminidase__InfluenzaA__ABU92783

SEQ ID NO: 137926 - RNA, 1410 nt, Artificial Sequence; identical to SEQ ID NO: 136241
  derived and/or modified sequence opt3 from neuraminidase__InfluenzaA__ABU92784

SEQ ID NO: 137927 - RNA, 1410 nt, Artificial Sequence; identical to SEQ ID NO: 136241
  derived and/or modified sequence opt3 from neuraminidase__InfluenzaA__ABU92785

SEQ ID NO: 137928 - RNA, 1410 nt, Artificial Sequence; identical to SEQ ID NO: 136241
  derived and/or modified sequence opt3 from neuraminidase__InfluenzaA__ABU92786

SEQ ID NO: 137929 - RNA, 1410 nt, Artificial Sequence
  derived and/or modified sequence opt3 from neuraminidase__InfluenzaA__ABU92787
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgccacccaggagucagaugcguuuguagggacaacuggaagggcucuaaucggccgauaguggauauuaacguaaaagacuauuccaucgugagcucguacgucugcucuggucuugugggggacacaccccgcaagaaugauuccuucucaaguagccauuguuuggacccuaacaaugaagagggaggccacggcguuaaagggugggcguuugaugacggaaacgauguguggaugggucgaaccaucuccgaaaagcugagaucuggcuacgagacguucaaagucauugagggguggagcaagccaaauucaaaacuacagaucaacaggcaagugauuguagaacggggaaaucguaguggcuauuccgguauauuuagcguugaggggaagucuugcaucaaccgcuguuucuacguggaacucauuagaggcaggaaggaggaaaccgaggucugguggacaucaaauaguaucguggucuuuugcggaacuagcggcaccuaugggacaggauccuggcccgacggugcagauaucaaccugaugccuauuuga

SEQ ID NO: 137930 - RNA, 1410 nt, Artificial Sequence
  derived and/or modified sequence opt3 from neuraminidase__InfluenzaA__ABU92789
augaaccccaaucagaagaucauuaccauaggcagcgugucccugacaaucucuacuauuugcuucuuuaugcaaaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaauuagcugaguacaggaauuggucaaagccacaguguaguauaacaggguucgcacccuuuagcaaagacaacuccauucggcugucugccggaggugauaucuggguaacccgcgagccuuaugugucgugcgacccagauaaguguuaccaauucgcgcuaggccaggggacgacucucaauaacguccauucaaaugacaccgugcacgaucgaacacccuaucguacucugcuuaugaacgaacugggaguuccuuuucauuugggcaccaaacaggugugcauugcuuggagcaguuccucuugucacgacgguaaggccuggcuccaugucugcgugacaggggaugacaagaaugcaaccgccagcuucaucuacaacggaagacugguagauuccaucguuucauggaguaaagagauucugaggacgcaggaaagcgagugugugugcauaaauggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccacgguacccgggcguucgcugugugugcagagacaacuggaagggguccaacaggcccauaguagauauuaauaucaaagacuacagcaucgugucgucuuaugucuguuccggacuggugggcgacacgccucggaagaacgauucaaguagcuccucucauugccuugacccaaauaacgaggaaggugggcacggaguuaaaggcugggcuuucgaugacggcaaugauguguggauggggcgcaccauuagcgagaagucacgaaguggauacgagacauuuaaagucaucgaagguugguccaaccccaauagcaaguugcagauuaacagacaggugauaguagacaggggcaaucggucuggguauucaggaaucuucaguguugagggcaaaagcuguauuaaccguugcuuuuacguggaacugauccgcgguagaaaggaggaaacugagguccuauggaccuccaauucuaucguggucuucugugggacaucgggcacuuauggaaccggcagcuggccugauggggccgacauuaaccucaugccaauauga

SEQ ID NO: 137931 - RNA, 1410 nt, Artificial Sequence; identical to SEQ ID NO: 136343
  derived and/or modified sequence opt3 from neuraminidase__InfluenzaA__ABU92790

SEQ ID NO: 137932 - RNA, 1410 nt, Artificial Sequence
  derived and/or modified sequence opt3 from neuraminidase__InfluenzaA__ABU92791
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcacggugucgucuuaugucuguuccggacuggugggcgauacaccccggaaaaacgacucaaguagcuccucucauugccuugauccuaauaacgaagagggugggcacggaguuaagggcugggcuuucgacgauggcaaugacguguggauggggcgcaccaucagcgaaaaauugcgaucaggauacgagacuuuuaaggucauugaggguuggaguaacccaaauuccaaacugcagaucaacagacaggugauuguagauaggggcaaucggagcggguauucuggaauauucucaguugaaggcaagaguuguaucaaccguugcuuuuacguggagcuaauucgcgguagaaaggaagagaccgaaguccucuggacaagcaauuccaucguggucuucugugggacuucuggcaccuauggaacaggcucguggcccgacggggccgauaucaaccugaugccuauuuga

SEQ ID NO: 137933 - RNA, 1410 nt, Artificial Sequence
  derived and/or modified sequence opt3 from neuraminidase__InfluenzaA__ABU92792
augaaccccaaucagaagaucauuaccauaggcagcgugucccugacaaucucuacuauuugcuucuuuaugcaaaucgccauucucaucacgaccgucacacuucacuucaaacaguacguuuuuaacucaccuccaaauaaccaggugaugcugugugagccgacuauaaucgaaagaaauauuaccgagaucguauauuugacaaacaccacuauugaaaaggagaucugccccaaauuagcugaauacaggaauuggaguaagccucagugugacauaacaggguucgcaccauuuagcaaagauaacuccauucggcugucugccggaggugacaucugggugacccgcgagcccuaugucucgugcgauccugacaaguguuaccaauucgcgcuaggccaggggacgacucucaauaacgugcauucaaaugauaccguucacgaccgaacaccauaucguacucugcuuaugaacgagcugggagugcccuuucauuugggcaccaagcaggucugcauugcuuggagcaguuccucuugucacgaugguaaagccuggcuccaugugugcguaacaggggacgauaagaaugcaaccgccagcuucaucuacaacggaagacugguugacuccguggucucauggaguaaagauauccugaggacgcaggaaagcgagugugugugcauuaauggcacuuguacaguggucaugaccgacggcucugcuuccgggaaggcagauacuaaaauacucuuuaucgaagagggaaagauuguucacacaucaaccuuaagcgguagugcccaacacguggaggaaugcucuugcuauccucgguacccaggcguacgcugugugugcagagacaacuggaagggguccaacaggccgaucgucgacauaaauauuaaaaacuacagcaucgugucgucuuauguuuguuccggacuggugggcgauacgccccggaagaccgacucaaguagcuccucucauugccuugauccuaauaacgaggaaggugggcacggagucaaaggcugggcuuucgacgauggcaaugacguguggauggggcgcacaaucagcgagaaguugcgacugggauacgaaacuuuuaaaguaauugaggguuggucaaacccaaauaguaagcuacagaucaacagacagguuauuguggauaggggcaaucgguccggguauagcggaauauucucugucgagggcaaaucauguaucaaccguugcuuuuacguggaacucauucgcgguagaaaggaggaaaccgagguccuguggacaaguaauagcaucgugguuuucugugggacuuccggcaccuauggaacaggcucuuggcccgacggggccgauaucaaccuuaugccuauuuga

SEQ ID NO: 137934 - RNA, 1410 nt, Artificial Sequence; identical to SEQ ID NO: 136823
  derived and/or modified sequence opt3 from neuraminidase__InfluenzaA__ABU92793

SEQ ID NO: 137935 - RNA, 1410 nt, Artificial Sequence; identical to SEQ ID NO: 137930
  derived and/or modified sequence opt3 from neuraminidase__InfluenzaA__ABU92794

SEQ ID NO: 137936 - RNA, 1410 nt, Artificial Sequence; identical to SEQ ID NO: 136241
  derived and/or modified sequence opt3 from neuraminidase__InfluenzaA__ABU92795

SEQ ID NO: 137937 - RNA, 1410 nt, Artificial Sequence; identical to SEQ ID NO: 136241
  derived and/or modified sequence opt3 from neuraminidase__InfluenzaA__ABU92796

SEQ ID NO: 137938 - RNA, 1410 nt, Artificial Sequence
  derived and/or modified sequence opt3 from neuraminidase__InfluenzaA__ABU92797
augaaccccaaucagaagaucauuaccauaggcagcgugucccugacaaucgccgcuauuugcuuccucaugcaaaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagcggauccuccgcacccaggagagugaaugcguuuguauuaacgggacgugcacuguggucaugacagacggaagcgccucugguaaagcugauaccaagauauuauuuaucgaggagggcaaaauugugcacaucuccacucugucagggagcgcccaacauguggaagagugcaguuguuacccuagauauccaggagucaggugcguuugucgggacaacuggaagggcucuaaucgcccgauaguggauauuaacguaaaggacuacuccaucgugagcucguacgucugcucuggucuugugggggacacaccccggaaaaaugauuccuucucaaguagccacuguuuggacccuaacaaugaagagggaggccauggcguuaaggggugggcguuugaugacggaaacgauguguggauggguagaaccaucaaugaaaaacugagguccggcuaugagacguucaaggucauugagggguggucuaaaccaaacagcaagcuacagaucaaucgacaggugauuguagaacguggaaaccgcucaggcuacagugguauauuuuccguugaggggaaaagcugcaucaauagauguuucuauguggaacucauuaggggccggaaggaggaaaccgaggucugguggacaucuaacucaaucguggucuuuugcggaaccaguggcacuuacgggacaggaagcuggcccgacggugcagauaucaaucugaugccuauuuga

SEQ ID NO: 137939 - RNA, 1410 nt, Artificial Sequence; identical to SEQ ID NO: 136241
  derived and/or modified sequence opt3 from neuraminidase__InfluenzaA__ABU92798

SEQ ID NO: 137940 - RNA, 1410 nt, Artificial Sequence; identical to SEQ ID NO: 136241
  derived and/or modified sequence opt3 from neuraminidase__InfluenzaA__ABU92799

SEQ ID NO: 137941 - RNA, 1410 nt, Artificial Sequence; identical to SEQ ID NO: 136241
  derived and/or modified sequence opt3 from neuraminidase__InfluenzaA__ABU92800

SEQ ID NO: 137942 - RNA, 1410 nt, Artificial Sequence
  derived and/or modified sequence opt3 from neuraminidase__InfluenzaA__ABU92801
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguacacuuaaccaacacaaccaucgagaaggaaauuugucccaaacuggccgaguacaggaauuggucaaagccucagugcaacaucacuggguucgcgccauuuaguaaagacaauagcauacggcuauccgcuggaggugauauuugggugacacgcgagcccuaugucucuugugacccugauaagugcuaccaauucgcccucggccaggggaccacgcugaacaauggacauucgaacgacacugugcacgaucgaaccccauaucguacacuucugaugaaugaauugggcguucccuuucaucucgguacuagacagguguguaucgcauggucaagcaguuccugccacgacgggaaggccuggcugcacgucugugugaccggagaugacaaaaacgcuacagcaucuuucauuuacaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcauaucuccacucugucagggagcgcccaacacguggaagagugcaguuguuauccucgcuacccaggagucagaugcguuuguagggacaacuggaagggcucuaaucggccgauaguggauauuaacguaaaagacuauuccaucgugagcucguacgucugcucuggucuugugggggacacaccccgcaagaaugauuccuucucaaguagccauuguuuggacccuaacaaugaagagggaggccacggcguuaaagggugggcguuugaugacggaaacgauguguggaugggucgaaccaucuccgaaaagcugagaucuggcuacgagacguucaaagucauugagggguggagcaagccaaauucaaaacuacagaucaacaggcaagugauuguagaacggggaaaucguaguggcuauuccgguauauuuagcguugaggggaagucuugcaucaaccgcuguuucuacguggaacucauuagaggcaggaaggaggaaaccgaggucugguggacaucaaauaguaucguggucuuuugcggaacuagcggcaccuaugggacaggauccuggcccgacggugcagauaucaaccugaugccuauuuga

SEQ ID NO: 137943 - RNA, 1410 nt, Artificial Sequence; identical to SEQ ID NO: 136241
  derived and/or modified sequence opt3 from neuraminidase__InfluenzaA__ABU92802

SEQ ID NO: 137944 - RNA, 1410 nt, Artificial Sequence; identical to SEQ ID NO: 136241
  derived and/or modified sequence opt3 from neuraminidase__InfluenzaA__ABU92804

SEQ ID NO: 137945 - RNA, 1410 nt, Artificial Sequence
  derived and/or modified sequence opt3 from neuraminidase__InfluenzaA__ABU92805
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaagaaaauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagauuaauagacaggugauaguagacaggggcaaccggagcggguauucuggaaucuucucaguugagggcaaaaguuguauuaaucguugcuuuuacguggaacuaauccgcgguagaaagcaggagacugaaguccucuggaccagcaacuccaucguggucuucugugggacaucuggcacuuauggaaccggcucguggcccgauggggccgacauuaaucugaugccuauauga

SEQ ID NO: 137946 - RNA, 1410 nt, Artificial Sequence; identical to SEQ ID NO: 137945
  derived and/or modified sequence opt3 from neuraminidase__InfluenzaA__ABU92806

SEQ ID NO: 137947 - RNA, 1410 nt, Artificial Sequence
  derived and/or modified sequence opt3 from neuraminidase__InfluenzaA__ABU92808
augaaccccaaucagaagaucauuaccauaggcagcgugucccugacaaucgccacuauuugcuuccucaugcaaaucacgauucuugucaccacaguuacucugcacuuuaaacaguacgaguguaacucuccuccaaauaaccaggugauguugugcgaaccgaccaucauagagagaaauaucacagaaauuguauauuuaaccaacacuacaaucgagaaggaaauuugucccaaacuggcugaguacaggaauuggucaaagccucagugcaacaucaccggguucgcaccauuuaguaaagacaauagcauacggcuauccgccggaggugauauuugggugacgcgcgagcccuaugucucuugugacccugauaagugcuaccaauucgcgcucggccaggggacuacccugaacaauggacauucgaacgacacagugcacgaucgaacuccauaucguacccuucugaugaaugaauugggcguucccuuucaucucgguacaagacagguguguaucgcuuggucaagcaguuccugccacgacgggaaggccuggcugcaugucugugugaccggagaugacaaaaacgcaacggccucuuucauuuacaauggcaggcugguagauagcaucggcuccuggucaaagaaaauccuccggacucaggagagugaaugcguuuguauuaacgggacaugcaccguggucaugacugacggaagcgcuucugguaaggcagauacaaaaauauuauuuaucgaggagggcaagauuauccacauauccacccugucagggagcgcccaacacguggaagagugcaguuguuauccucgcuacccaggagugagaugcgucuguagggacaacuggaagggcucuaaucggccgauuguugauaucaacgugaaagacuacuccaucguaagcucguaugugugcucuggucuugucggggacacgccccgcaagaaugauuccucaaguagcucccauuguuuggacccuaacaaugaagagggaggccacggcgugaaagggugggcuuucgaugacggaaacgauguuuggaugggucgaaccauuucugaaaagcugagaagcggcuacgagacauuuaaagugaucgagggguggucaaagccaaauaguaaacuacagauuaacaggcaggucauaguggaacggggaaaucguuccggcuauagcgguaucuucucuguagaggggaagucaugcauuaaccgcuguuuuuacguugaacucaucagaggcaggaaggaggaaacugaggugugguggaccaguaauagcaucgucguguucugcggaacauccggcacuuaugggaccggaucuuggcccgacggugccgauauuaaccugaugccuauauga

SEQ ID NO: 137948 - RNA, 1410 nt, Artificial Sequence
  derived and/or modified sequence opt3 from neuraminidase__InfluenzaA__ABU92809
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccggucauugccuugacccuaacaaugaggaagggggacacggcguuaaaggcugggcuuucgaugacgggaacgauguguggaugggacgcaccauuucugagaaguugcgaagcgguuacgagacauuuaaagucaucgaaggcuggucaaauccaaacaguaagcugcagauuaauagacaggugauaguagacagggggaaccgguccggauauagcggcaucuucucuguugaggguaaaucauguauuaaucguugcuuuuacguggaacuaauccgcgggagaaaggaggaaacugauguccucuggaccaguaacagcaucguggucuucuguggcacauccggaacuuauggcaccgggucuuggcccgacggagccgauauuaaucugaugccuauauga

SEQ ID NO: 137949 - RNA, 1410 nt, Artificial Sequence
  derived and/or modified sequence opt3 from neuraminidase__InfluenzaA__ABU92810
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacaccccgcaagaaugauuccuucucaaguagccacuguuuggacccuaacaaugaagagggaggccauggcguuaaagggugggcguuugaugacggaaacgauguguggaugggucgaaccaucuccgaaaagcugagaucuggcuaugagacguucaaagucauugagggguggagcaagccaaauucaaaacuacagaucaacaggcaagugauuguagaaggaggcaaucggagugguuacuccgggauauuuagcguugagggcaagucuugcaucaaccguuguuucuauguggaacucauucgcggaagaaaggaggaaaccgaggucugguggacaucaaauaguaucguggucuuuugcggcacuagcgggaccuacggaacagguuccuggcccgacggcgcagauaucaaccugaugccuauuuga

SEQ ID NO: 137950 - RNA, 1410 nt, Artificial Sequence
  derived and/or modified sequence opt3 from neuraminidase__InfluenzaA__ABU92811
augaaccccaaucagaagaucauuaccauaggcagcgugucccugacaaucgccgcuauuugcuuccucaugcaaaucgcaauucuugucacuacgguuacccugcacuuuaaacagcaugaguguaacucuccuccaaauaaccaggugauguugugcgaaccgacaaugaucgagagaaauauaacugaaaucguauacuuaaccaacacaaccauugagaaggaaaucugucccaaacuggccgaguauaggaauuggucaaagccucagugcaacauuacuggguucgcgccauuuaguaaagacaauagcauccggcuauccgcugugggagauauaugggucacacgcgagcccuacgugucuugugacccugauaagugcuaucaauucgcccucggucagggcaccacgcugaacaaugggcacucgaacgacacuguucaugaucgaaccccauaccguacacuucugaugaaugaauugggagugcccuuucaccucggcacuagacaggucuguauugcauggucaagcaguuccugccaugacgguaaggccuggcugcacguguguguaaccggggaugacaaaaacgcuacagcaucuuucaucuauaauggaaggcugguugauagcauuggcuccuggucaaagaaaauccuccggacccaggagagugaaugcguguguaucaacggcacgugcacugucgugaugacagacgggagcgccucuggaaaggcugauaccaaaauuuuauuuauagaggaggguaagaucgugcacauuuccacucugucaggcagcgcccaacaugucgaagagugcaguuguuacccucgcuauccagggguuagaugcguguguagggacaacuggaagggaucuaaucggccgaucguagauauaaacgugaaagacuacuccauugucagcucguacgugugcucuggccuuguuggugacacaccccgcaagaaugauuccuucucaaguagccacuguuuggacccuaacaaugaagaagggggacauggcgugaaaggcugggcguuugaugacgggaacgaugucuggaugggacgaaccaucuccgagaagcugagaucugguuaugagacguucaaagugaucgagggcuggagcaagccaaauucaaaacuacagauuaacaggcagguaaucguugaacgggggaaucguaguggauacuccggcauuuuuagcguggaggguaagucuugcauaaaccgcuguuucuaugucgaacucaucagagggaggaaggaggaaaccgaggugugguggacaucaaauaguauugucguguuuugcggcacuagcggaaccuacggcacaggguccuggcccgacggagcagauaucaaccugaugccuaucuga

SEQ ID NO: 137951 - RNA, 1410 nt, Artificial Sequence; identical to SEQ ID NO: 136241
  derived and/or modified sequence opt3 from neuraminidase__InfluenzaA__ABU92814

SEQ ID NO: 137952 - RNA, 1410 nt, Artificial Sequence; identical to SEQ ID NO: 136730
  derived and/or modified sequence opt3 from neuraminidase__InfluenzaA__ABU92815

SEQ ID NO: 137953 - RNA, 1410 nt, Artificial Sequence; identical to SEQ ID NO: 136241
  derived and/or modified sequence opt3 from neuraminidase__InfluenzaA__ABU92816

SEQ ID NO: 137954 - RNA, 1410 nt, Artificial Sequence
  derived and/or modified sequence opt3 from neuraminidase__InfluenzaA__ABU92817
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacaccccgcaagaaugauuccuucucaaguagccacuguuuggacccuaacaaugaagagggaggccauggcguuaaagggugggcguuugaugacggaaacgauguguggaugggucgaaccaucuccgaaaagcugagaucuggcuaugagacguucaaagucauugagggguggagcaagccaaauucaaaacuacagaucaacaggcaagugauuguagaacggggaaaucguaguggcuacuccgguauauuuagcguugagucuaagucaugcaucaaccgcuguuucuauguggaacucauuagagggaggaaggaggaaaccgaggucugguggacaaguaauagcaucguggucuuuugcggcacuuccggaaccuacggcacagggucuuggcccgacggagcagauaucaaccugaugccuauuuga

SEQ ID NO: 137955 - RNA, 1410 nt, Artificial Sequence; identical to SEQ ID NO: 136241
  derived and/or modified sequence opt3 from neuraminidase__InfluenzaA__ABU92818

SEQ ID NO: 137956 - RNA, 1410 nt, Artificial Sequence; identical to SEQ ID NO: 136241
  derived and/or modified sequence opt3 from neuraminidase__InfluenzaA__ABU92819

SEQ ID NO: 137957 - RNA, 1410 nt, Artificial Sequence; identical to SEQ ID NO: 136241
  derived and/or modified sequence opt3 from neuraminidase__InfluenzaA__ABU92821

SEQ ID NO: 137958 - RNA, 1410 nt, Artificial Sequence; identical to SEQ ID NO: 136241
  derived and/or modified sequence opt3 from neuraminidase__InfluenzaA__ABU92822

SEQ ID NO: 137959 - RNA, 1410 nt, Artificial Sequence; identical to SEQ ID NO: 136153
  derived and/or modified sequence opt3 from neuraminidase__InfluenzaA__ABU92823

SEQ ID NO: 137960 - RNA, 1410 nt, Artificial Sequence
  derived and/or modified sequence opt3 from neuraminidase__InfluenzaA__ABU92824
augaaccccaaucagaagaucauuaccauaggcagcgugucccugacaaucgccgcuauuugcuuccucaugcaaaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacaccccgccgaaaugauuccuucucaaguagccacuguuuggacccuaacaaugaagagggaggccauggcguuaaggggugggcguuugaugacggaaacgauguguggauggguagaaccaucuccgaaaaacugaggucuggcuaugagacguucaaggucauugagggguggagcaaaccaaauucaaagcuacagaucaaccgucaggugauuguagaacggggaaaucgcaguggcuacuccgguauauuuagcguugaggggaaaucuugcaucaacagauguuucuauguggaacucauuaggggccggaaggaggaaaccgaggucugguggacaucaaauaguaucguggucuuuugcggaacuagcggcaccuacgggacaggauccuggcccgacggugcagauaucaaccugaugccuauuuga

SEQ ID NO: 137961 - RNA, 1410 nt, Artificial Sequence
  derived and/or modified sequence opt3 from neuraminidase__InfluenzaA__ABU92825
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccuaauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaaaagauucugaggacgcaggagagcgaaugugugugcauaaacggcacuuguacagucgugaugaccgacggcucugcuuccgggaaagcagauacuaagauccucuuuauugaggagggaaagaucgugcacacaucaaccuuaagcgguagugcccaacacgucgaagagugcucuugcuauccucgguacccaggcguucgcugugugugcagagacaacuggaaaggguccaauaggccgauaguagauauuaacaucaaggacuacagcaucgugucgucuuaugucuguuccggacuggugggcgacacgccccggaaaaaugauucaaguagcuccucucauugccuugacccuaacaaugaagagggugggcacggaguuaagggcugggcuuucgaugacggcaacgauguguggauggggcgcaccauuagcgaaaaaucacgaaguggauacgagacauuuaaggucaucgaggguugguccaauccaaacagcaaauugcagauuaauagacaggugauaguagacaggggcaaccggucuggguauucaggaaucuucaguguugaaggcaagagcuguauuaaucguugcuuuuacguggagcugauccgcgguagaaaggaagagacugaaguccuauggaccuccaacucuaucguggucuucugugggacaucgggcacuuauggaaccggcagcuggcccgauggggccgacauuaaucucaugccuauauga

SEQ ID NO: 137962 - RNA, 1410 nt, Artificial Sequence; identical to SEQ ID NO: 137961
  derived and/or modified sequence opt3 from neuraminidase__InfluenzaA__ABU92826

SEQ ID NO: 137963 - RNA, 1410 nt, Artificial Sequence; identical to SEQ ID NO: 136241
  derived and/or modified sequence opt3 from neuraminidase__InfluenzaA__ABU92827

SEQ ID NO: 137964 - RNA, 1410 nt, Artificial Sequence; identical to SEQ ID NO: 136241
  derived and/or modified sequence opt3 from neuraminidase__InfluenzaA__ABU92828

SEQ ID NO: 137965 - RNA, 1410 nt, Artificial Sequence; identical to SEQ ID NO: 136730
  derived and/or modified sequence opt3 from neuraminidase__InfluenzaA__ABU92829

SEQ ID NO: 137966 - RNA, 1410 nt, Artificial Sequence
  derived and/or modified sequence opt3 from neuraminidase__InfluenzaA__ABU92830
augaaccccaaucagaagaucauuaccauaggcagcgugucccugacaaucgccgcuauuugcuuccucaugcaaaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacaccccgcaagaaugauuccuucucaaguagccgauguuuggacccuaacaaugaagagggaggccacggcguuaaagggugggcguuugaugacggaaacgauguguggauggguagaaccaucuccgaaaagcugaggucuggcuaugagacguucaaagucauugagggguggagcaagccaaauucaaaacuacagaucaaccgucaggugauuguagaacggggaaaucgcaguggcuacuccgguauauuuagcguugaggggaagucuugcaucaacagauguuucuauguggaacucauuaggggccggaaggaggaaaccgaggucugguggacaucaaauaguaucguggucuuuugcggaacuagcggcaccuacgggacaggauccuggcccgacggugcagauaucaaccugaugccuauuuga

SEQ ID NO: 137967 - RNA, 1410 nt, Artificial Sequence; identical to SEQ ID NO: 136241
  derived and/or modified sequence opt3 from neuraminidase__InfluenzaA__ABU92831

SEQ ID NO: 137968 - RNA, 1410 nt, Artificial Sequence; identical to SEQ ID NO: 136241
  derived and/or modified sequence opt3 from neuraminidase__InfluenzaA__ABU92832

SEQ ID NO: 137969 - RNA, 1410 nt, Artificial Sequence; identical to SEQ ID NO: 136241
  derived and/or modified sequence opt3 from neuraminidase__InfluenzaA__ABU92833

SEQ ID NO: 137970 - RNA, 1410 nt, Artificial Sequence
  derived and/or modified sequence opt3 from neuraminidase__InfluenzaA__ABU92834
augaaccccaaucagaagaucauuaccauaggcagcgugucccugacaaucgccgcuauuugcuuccucaugcacaucgcaauucuugucacuacgguuacccugcauuuuaaacagcacgaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaguucgcccucggccaagggaccacgcugaacaauggacauucgaacgacacugugcacgaucgaaccccauaccguacacuucugaugaaugaauugggcguucccuuucaucucgguacuagacagguguguaucgcauggucaagcaguuccugccacgacgggaaggccuggcugcacgucugugugaccggagaugacgagaacgcuacagcaucuuucauuuauaauggcaggcugguagauagcaucggcuccuggaguaaaaagauccuccggacccaggaaucagagugcguuuguauuaacgggacgugcacuguggucaugacagacggaagcgccucugguaaagcugauaccaagauauuauuuaucgaggaaggcaaaauugugcauaucuccacucugucagggagcgcccagcacguggaggaaugcaguuguuacccucgcuauccaggagucagaugcguuuguagggacaacuggaagggcucuaaucggccgauaguggauauuaacguaaaggacuacuccaucgugagcucguacgucugcucuggucuugugggggacacaccccgcaaaaaugauuccuucucaaguagccauuguuuggacccuaacaaugaggaaggaggccacggcguuaaggggugggcguuugaugacggaaacgauguguggaugggucgaaccaucuccgagaaacugagaucuggcuaugagacguucaaggucauugaaggguggagcaaaccaaauucaaagcuacaaaucaacaggcaagugauuguagagcggggaaaucguaguggcuacuccgguauauuuagcguugaagggaaaucuugcaucaaccgcuguuucuauguggagcucauuagaggcaggaaggaagagaccgaggucugguggacaucaaauaguaucguggucuuuugcggaacuagcggcaccuacgggacaggauccuggcccgacggugcagauaucucucugaugccuauuuga

SEQ ID NO: 137971 - RNA, 1410 nt, Artificial Sequence; identical to SEQ ID NO: 136241
  derived and/or modified sequence opt3 from neuraminidase__InfluenzaA__ABU92835

SEQ ID NO: 137972 - RNA, 1410 nt, Artificial Sequence; identical to SEQ ID NO: 136241
  derived and/or modified sequence opt3 from neuraminidase__InfluenzaA__ABU92836

SEQ ID NO: 137973 - RNA, 1410 nt, Artificial Sequence
  derived and/or modified sequence opt3 from neuraminidase__InfluenzaA__ABU92837
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaaaagauucugaggacgcaggagagcgaaugugugugcauaaauggcacuuguacagucgugaugaccgauggcucugcuuccgggaaagcagacacuaagauccucuuuauugaggagggaaagaucgugcacacaucaaccuuaagcgguagugcccaacacgucgaagagugcucuugcuauccucgguacccaggcguucgcugugugugcagagauaacuggaaaggguccaacaggccgauaguagacauuaauaucaaggacuacagcaucgcuucgucuuauguguguuccggacuggucggcgauacgccccggaaaaacgacucaaguagcuccucucauugccuugauccuaauaacgaagagggugggcacggagugaagggcugggccuucgacgauggcaaugacguuuggauggggcgcaccauuagcgaaaaauugcgaucaggauacgagacauuuaaggugaucgaggguuggaguaacccaaauuccaaacugcagauuaacagacaggucauaguggauaggggcaaucggagcggguauucuggaaucuucucaguagaaggcaagaguuguguuaaccguugcuuuuacguggagcuaauucgcgguagaaaggaagagacugaaguccucuggaccagcaauuccaucguggucuucugugggacaucuggcacuuauggaaccggcucguggcccgacggggcggauaucaaccugaugccuauuuga

SEQ ID NO: 137974 - RNA, 1410 nt, Artificial Sequence; identical to SEQ ID NO: 136241
  derived and/or modified sequence opt3 from neuraminidase__InfluenzaA__ABU92838

SEQ ID NO: 137975 - RNA, 1410 nt, Artificial Sequence; identical to SEQ ID NO: 136077
  derived and/or modified sequence opt3 from neuraminidase__InfluenzaA__ABU92839

SEQ ID NO: 137976 - RNA, 1410 nt, Artificial Sequence
  derived and/or modified sequence opt3 from neuraminidase__InfluenzaA__ABU92840
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacaucucccugcuuucagggagcgcucaacacguggaggaaugcaguuguuauccucgguacccaggaguccgcugcguuuguagagacaacuggaagggcucuaauaggccgauaguggauauuaacguaaaagacuacuccaucgugagcucguaugucugcucugguuuggugggggacacaccccggaagaaugauuccucaaguagcucccauugucuggacccuaacaaugaggaaggaggccacggcguuaaagggugggccuucgaugacggaaacgauguguggaugggucgcaccaucucugagaagcuacgaagcggcuacgagacguuuaaagucauugaaggguggucaaagccaaauaguaaacuccagaucaacagacaggugauuguagacagggauaaucgguccggauauagcggcauauucucuguugaggguaagucaugcaucaaccguuguuuuuacguggaacugauucgcgggagaaagcaggagaccgaaguccuuuggacaaguaauagcaucguggucuucugcggcacuuccggaaccuauggcacagggucuuggcccgacggagcggauaucaaccugaugccuauuuga

SEQ ID NO: 137977 - RNA, 1410 nt, Artificial Sequence
  derived and/or modified sequence opt3 from neuraminidase__InfluenzaA__ABU92841
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacaucccugcuuucagggagcgcucaacacguggaggaaugcaguuguuauccucgguacccaggaguccgcugcguuuguagagacaacuggaagggcucuaauaggccgaucguggauauaaacguaaaagacuacuccauugugagcucguaugucugcucugguuuggugggggacacuccccggaagaaugauuccucaaguagcucccauugucuggacccuaacaaugaggaaggaggccacggcguuaaagggugggccuucgaugacggaaacgauguguggaugggucgcacgaucucugagaagcuacgaagcggcuacgagaccuuuaaagucaucgaaggguggucaaagccaaauaguaaacuccagauuaacagacaggugaucguagacagggauaaucgguccggauauagcggcauuuucucuguugaggguaagucaugcauaaaccguuguuuuuacguggaacugauccgcgggagaaagcaggagacagaaguccuuuggaccaguaauagcauuguggucuucugcggcaccuccggaacauauggcacugggucuuggcccgacggagcggauaucaaccugaugccuaucuga

SEQ ID NO: 137978 - RNA, 1410 nt, Artificial Sequence
  derived and/or modified sequence opt3 from neuraminidase__InfluenzaA__ABU92842
augaaccccaaucagaagaucauuaccauaggcagcgugucccugacaaucgccacuauuugcuuccucaugcaaaucgcuauucuugucacgaccguuacacugcacuuuaaacaguacgacuguaacucuccuccaaauaaccaggugauguugugcgagccgacuaucauagaaagaaauaucaccgagauuguauauuuaacaaacaccacuaucgaaaaggagauuugucccaaacuggcagaauacaggaauuggucaaagccucagugcaacaucacaggguucgccccauuuaguaaagauaauagcauacggcuauccgcgggaggugacauuugggugacccgcgagcccuaugucucuugugauccugacaagugcuaccaauucgcucucggccaggggacgacucugaacaauggacauucgaacgauaccgugcacgaccgaacaccauaucguacucuucugaugaaugaguugggcguucccuuucaucucgguaccaaacagguguguaucgccuggucaagcaguuccugccacgaugggaaggcauggcugcaugucugugugacaggagacgaugaaaacgccaccgcuucuuucauuuacaauggcagacugguagacagcaucggcuccuggucaaagaaaauccucaggacgcaggagagugaaugcguuuguauuaacgggacuugcacaguggucaugaccgauggaagcgcaucugguaaggccgacacuaaaauauuauuuaucgaggagggcaagauugugcacacaucccugcuuucagggagcgcucaacacguggaagagugcaguuguuauccucgguacccaggaguccgcugcguuuguagagauaacuggaagggcucuaauaggccgaucguggacauaaacguaaaagacuacuccauugugagcucguaugucugcucugguuuggugggggauacuccccggaagaaugacuccucaaguagcucccauugucuggauccuaacaaugaagagggaggccacggcguuaaagggugggccuucgacgauggaaacgacguguggaugggucgcacgaucucugaaaagcuacgaagcggcuacgagaccuuuaaagucaucgagggguggucaaagccaaauaguaaacuccagauuaacagacaggugaucguagauaggggaaaucgguccggcuauagcgguauuuucucuguugaagggaagucaugcauaaaccguuguuuuuacguggagcugauccgcggcagaaagcaggaaacagagguccuuuggaccaguaauagcauuguggucuucugcggaaccuccggcacauaugggacuggaucuuggcccgacggugcggauaucaaccugaugccuaucuga

SEQ ID NO: 137979 - RNA, 1410 nt, Artificial Sequence; identical to SEQ ID NO: 136077
  derived and/or modified sequence opt3 from neuraminidase__InfluenzaA__ABU92843

SEQ ID NO: 137980 - RNA, 1410 nt, Artificial Sequence; identical to SEQ ID NO: 137765
  derived and/or modified sequence opt3 from neuraminidase__InfluenzaA__ABU92844

SEQ ID NO: 137981 - RNA, 1410 nt, Artificial Sequence; identical to SEQ ID NO: 136077
  derived and/or modified sequence opt3 from neuraminidase__InfluenzaA__ABU92845

SEQ ID NO: 137982 - RNA, 1410 nt, Artificial Sequence; identical to SEQ ID NO: 136077
  derived and/or modified sequence opt3 from neuraminidase__InfluenzaA__ABU92846

SEQ ID NO: 137983 - RNA, 1410 nt, Artificial Sequence; identical to SEQ ID NO: 136077
  derived and/or modified sequence opt3 from neuraminidase__InfluenzaA__ABU92847

SEQ ID NO: 137984 - RNA, 1410 nt, Artificial Sequence; identical to SEQ ID NO: 136077
  derived and/or modified sequence opt3 from neuraminidase__InfluenzaA__ABU92848

SEQ ID NO: 137985 - RNA, 1410 nt, Artificial Sequence; identical to SEQ ID NO: 136730
  derived and/or modified sequence opt3 from neuraminidase__InfluenzaA__ABU92849

SEQ ID NO: 137986 - RNA, 1410 nt, Artificial Sequence
  derived and/or modified sequence opt3 from neuraminidase__InfluenzaA__ABU92850
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuaguagaguacaggaauuggaguaagccucagugugacauaacaggguucgcuccauuuagcaaagauaacuccauucggcugucugcaggaggugacaucugggugacccgcgagcccuaugucucgugcgauccugacaaguguuaccaauucgcccuaggccaggggacgacucucaauaacgugcauucaaaugauaccguucacgaccgaacaccauaucguacucugcuuaugaccgaacugggagugcccuuucauuugggcacaaagcaggucugcauugcguggagcaguuccucuugucacgaugguaaagcauggcuccaugugugcguaaccggggacgauaagaacgccacggcuagcuucaucuacaauggaagacugguugacuccaucgugucauggaguaaaaagauucugaggacucaggagagcgaaugugucugcauaaacggcacauguaccguggugaugacugauggcucugccuccgggaaagcugacacaaagauccucuuuauugaggagggaaagaucguccacaccucaacguuaagcgguagugcacaacacguugaagagugcucuugcuauccucgguacccaggcgugcgcuguguaugcagagauaauuggaaaggguccaacaggccgauaguggacauuaacaucaaggacuacagcaucgucucgucuuauguguguuccggacugguuggcgauacaccccggaaaaaugacucaaguagcuccucucauugccuugauccuaacaaugaagagggugggcacggagugaagggcugggccuucgacgauggcaacgacgucuggauggggcgcaccauuagcgaaaaauugcgaucaggauacgagacuuuuaaggugaucgaggguuggaguaauccaaacuccaaacugcagauuaauagacagguaauaguugauaggggcaaccggagcggguauucuggaaucuucucaguggaaggcaagaguuguauuaaucguugcuuuuacgucgagcuaauccgcgguagaaaggaagagaacgaagugcucuggaccagcaauuccaucgucguguucugugggacaucuggcacuuauggaaccggcucguggcccgacggggcugauauuaaccugaugccuauauga

SEQ ID NO: 137987 - RNA, 1410 nt, Artificial Sequence
  derived and/or modified sequence opt3 from neuraminidase__InfluenzaA__ABU92851
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguagcauaacaggguucgcaccauuuuccaaagacaacucuauucggcugucggccggaggugauaucuggguaacccgcgagcccuaugugucaugcgacccugauaaguguuaccaauucgcgcuaggccaggggacgacucucaauaacguccauagcaaugacaccgugcacgaucgaacaccauaucguacucugcuuaugaacgaacugggaguucccuuucauuugggcaccaaacaggugugcauugcuuggaguuccucuagcugucacgacgguaaggccuggcuccaugucugcgugacaggggaugacaagaaugcaaccgccuccuucaucuacaacggaagacugguagauucaaucguuaguuggagcaaagagauucugaggacgcaggaaucugagugugugugcauaaauggcacuuguacagucgugaugaccgacggcuccgcuucagggaaggcagauacuaaaauccucuuuauugaggaaggaaagaucgugcacacaagcaccuuaagugguucugcccaacacgucgaggaaugcuccugcuauccucgguacccaggcguucgcugugugugcagagacaacuggaaggggagcaacaggccgauaguagauauuaauaucaaagacuacucgaucgugucuuccuaugucuguucaggacuggugggcgacacgccccggaaggaugacaguagcuccucuagccauugccuugauccuaacaaugaggaaggugggcacggaguuaaaggcugggcuuucgacgauggcaacgacguguggauggggcgcaccauuucagagaagagucgauccggauacgagacauuuaaagucaucgaagguuggagcaauccaaacucuaaguugcagauuaauagacaggugauaguagauaggggcaaccggucaggguauaguggaaucuucagcguugagggcaaauccuguauuaaucguugcuuuuacguggaacugauccgcgguagaaaggaggaaacugagguccuauggaccucuaacucgaucguggucuucugugggacaagcggcacuuauggaaccggcuccuggcccgacggggccgauauuaaucucaugccuauauga

SEQ ID NO: 137988 - RNA, 1410 nt, Artificial Sequence; identical to SEQ ID NO: 136241
  derived and/or modified sequence opt3 from neuraminidase__InfluenzaA__ABU92852

SEQ ID NO: 137989 - RNA, 1410 nt, Artificial Sequence
  derived and/or modified sequence opt3 from neuraminidase__InfluenzaA__ABU92853
augaaccccaaucagaagaucauuaccauaggcagcgugucccugacaaucgccgcuauuugcuuccucaugcaaaucgcaauucuugucacuacgguuacccugcacuuuaaacagcaugaguguaacucuccuccaaagaaucaggugauguugugcgaaccgacaaucauagagagaaacaucacugaaauuguauacaugaccaauacaaccaucgagaaagaaauuugucccaaguuagccgaguauaggaacuggucaaaaccucagugcaauaucacuggguucgcgccauuuaguaaggacaacagcauacggcuguccgcuggaggugauauuugggugacacgcgagcccuacgucucuugugacccugauaagugcuaucaauucgcccuaggccaggggaccacgcucaauaacggacacucgaaugacacugugcaugaucgaaccccauaccguacacugcuuaugaacgaacugggcguucccuuucacuuggguacuagacagguguguaucgcauggucaagcaguuccugccaugacgggaaagccuggcuccacgucugugugaccggagaugacaagaaugcuacagcaucuuucauuuauaacggcaggcugguagauagcaucguuuccuggaguaaaaagauccugcggacccaggagucagaaugcguguguauuaauggcacgugcacugucgugaugacagacgggagcgccucuggaaaagcugauaccaagauacucuuuaucgaggaggguaagauugugcacaucuccacuuuaucaggcagcgcccaacaugucgaagagugcaguuguuacccucgcuauccagggguuagaugcguguguagggacaacuggaaaggaucuaaccggccgauaguagauauuaaugugaaggacuacuccaucgucagcucguacgugugcucuggccugguuggugacacaccccgcaaaaacgauuccuucucaaguagccacugucuugacccuaauaacgaagaagggggacauggcgugaagggcugggcguuugaugacgggaaugaugucuggaugggacgaaccaucuccgagaaauugagaucugguuaugagacguucaaggugauugagggcuggagcaaaccaaacucaaagcugcagaucaauaggcagguaauuguugaacgggggaaccguaguggauacuccggcauauuuagcguggaggguaagucuugcaucaaucgcuguuucuaugucgaacuaauuagagggaggaaagaggaaaccgaggugugguggacaucaaacaguaucgucguguuuugcggcacuagcggaaccuacggcacaggguccuggcccgacggagcagauaucaaucucaugccuauuuga

SEQ ID NO: 137990 - RNA, 1410 nt, Artificial Sequence; identical to SEQ ID NO: 136241
  derived and/or modified sequence opt3 from neuraminidase__InfluenzaA__ABU92854

SEQ ID NO: 137991 - RNA, 1410 nt, Artificial Sequence
  derived and/or modified sequence opt3 from neuraminidase__InfluenzaA__ABU92855
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacaccccgcaagaaugauuccuucucaaguagccacuguuuggacccuaacaaugaagagggaggccauggcguuaaagggugggcguuugaugacggaaacgauguguggaugggucgaaccaucuccgaaaagcugagaucuggcuaugagacguucaaagucauugagggguggagcaagccaaauucaaaacuacagaucaacaggcaagugauuauagaacggggaaaucguaguggcuacuccgguaucuuuagcguagaggggaagucuugcauuaaccgcuguuucuauguugaacucaucagaggcaggaaggaggaaaccgaggugugguggacaucaaauaguaucgucguguuuugcggaacuagcggcaccuacgggacaggauccuggcccgacggugcagauauuaaccugaugccuauauga

SEQ ID NO: 137992 - RNA, 1410 nt, Artificial Sequence; identical to SEQ ID NO: 136161
  derived and/or modified sequence opt3 from neuraminidase__InfluenzaA__ABU92856

SEQ ID NO: 137993 - RNA, 1410 nt, Artificial Sequence; identical to SEQ ID NO: 136241
  derived and/or modified sequence opt3 from neuraminidase__InfluenzaA__ABU92857

SEQ ID NO: 137994 - RNA, 1410 nt, Artificial Sequence
  derived and/or modified sequence opt3 from neuraminidase__InfluenzaA__ABU92858
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuauacugugugaaccgacuaucauugagagaaauaucaccgaaauuguguauuugacaaacaccacuaucgagaaggaaauaugccccaaauuagcugaguacaggaauuggaguaagccucagugugacauuacaggguucgcaccauuuagcaaagauaacuccauccggcugucugccggaggugacauuuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcaucgcuuggagcaguuccucuugucacgaugguaaggccuggcuccaugucugcgugacaggggacgauaagaaugcaaccgccagcuucaucuacaacggaagacugguagacuccauuguuucauggaguaaaaagauacugaggacgcaggagagcgaaugugugugcaucaauggcacuuguacagucgugaugaccgauggcucugcuuccgggaaagcagacacuaagauucucuuuaucgaggagggaaagauagugcacacaucaaccuuaagcgguagugcccaacacgucgaagagugcucuugcuauccucgguacccaggcguucgcugugugugcagagauaacuggaaaggguccaacaggccgauuguagacaucaauaucaaggacuacagcauugugucgucuuaugucuguuccggacuggugggcgauacgccccggaaaaacgacucaaguagcuccucucauugccuugauccuaauaacgaagagggugggcacggaguuaagggcugggcuuucgacgauggcaaugacguguggauggggcgcaccaucagcgaaaaauugcgaucaggauacgagacauuuaaggucauugaggguuggaguaacccaaauuccaaacugcagauaaacagacaggugaucguagauaggggcaaucggagcggguauucuggaauuuucucaguugaaggcaagaguuguaucaaccguugcuuuuacguggagcuaauccgcgguagaaaggaagagacugaaguccucuggaccagcaauuccauuguggucuucugugggacaucuggcacuuauggaaccggcucguggcccgacggggccgauauaaaccugaugccuaucuga

SEQ ID NO: 137995 - RNA, 1410 nt, Artificial Sequence
  derived and/or modified sequence opt3 from neuraminidase__InfluenzaA__ABU92859
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccggguauaggaauuggucaaagccucagugcaacaucacuggauucgcgccauuuaguaaagacaauagcauacggcuauccgcugguggcgauauuugggugacacgcgagcccuacgucucuugugacccugauaagugcuaucaauucgcccucgggcagggaaccacgcugaacaauggccacucgaacgacacugugcaugaucgaaccccauaccguacacuucugaugaaugaguuggguguucccuuucaccucgggacuagacagguguguaucgcauggucaagcaguuccugccaugacggaaaggccuggcugcacgucugugugaccggcgaugacaaaaacgcuacagcaucuuucauuuauaauggcaggcugguagauagcaucggguccuggucaaagaaaauccuccggacccaggaaagugagugcguuuguauuaacggaacgugcacuguggucaugacagacgguagcgccucuggcaaggcugauaccaaaauauuauuuaucgaagaggggaagauugugcacaucuccacucugucaggaagcgcccaacauguggaggaaugcaguuguuacccucgcuauccaggcgucagaugcguuuguagggacaacuggaaggguucuaaucggccgauaguggauauuaacguaaaagacuacuccaucgugagcucguacgucugcucugggcuugugggagacacaccccgcaagaaugauuccuucucaaguagccacuguuuggacccuaacaaugaggaaggcggccaugggguuaaaggaugggcguuugaugacgguaacgauguguggaugggccgaaccaucuccgagaagcugagaucuggguaugaaacguucaaagucauugagggauggagcaagccaaauucaaaacuacagaucaacaggcaagugauuguagagcggggcaaucguagugguuacuccgggauauuuagcguugaaggcaagucuugcaucaaccgcuguuucuauguggagcucauuagaggaaggaaggaagagaccgaagucugguggacaucaaauaguaucguggucuuuugcggcacuagcgggaccuacggaacagguuccuggcccgacggcgcagauaucaaccugaugccuauuuga

SEQ ID NO: 137996 - RNA, 1410 nt, Artificial Sequence
  derived and/or modified sequence opt3 from neuraminidase__InfluenzaA__ABU92860
augaaccccaaucagaagaucauuaccauaggcagcgugucccugacaaucgccgcuauuugcuuccucaugcaaaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccugguacaagaaaauccuccggacccaggagucagaaugcguuuguauuaacgggacgugcacuguggucaugacagacggaagugccagcgguaaggcugauaccaaaauauuauuuaucgaggagggcaagauugugcacaucucuacucuguccgggucagcccaacauguggaagagugcagcuguuauccucgcuacccaggagucagaugcguuuguagggacaacuggaagggcaguaaucggccgauaguggauauuaacguaaaagacuacucuaucaucuccagcuaugugugcucgggucuugucggggacacaccccgcaagaaugauucuuucuccucaagucacuguuuggacccuaacaaugaagagggaggccauggcgugaaagggugggcguuugaugacggaaacgauguuuggaugggucgaaccauuagcgaaaagcugagauccggcuacgagacguucaaagugaucgagggguggucuaagccaaauagcaaacuacagauuaacaggcaggucauaguggaacggggaaaucguucaggcuauagugguaucuuuuccguagaggggaagaguugcauuaaccgcuguuucuacguugaacucaucagaggcaggaaggaggaaaccgaggugugguggacaucuaauucaaucgucguguuuugcggaacuagcggcaccuaugggacaggaagcuggcccgacggugcagauauuaaccugaugccuauauga

SEQ ID NO: 137997 - RNA, 1410 nt, Artificial Sequence
  derived and/or modified sequence opt3 from neuraminidase__InfluenzaA__ABU92861
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguauggcauggucaagcaguuccugccaugacgggaaggccuggcugcacgucugugugaccggagaugacaaaaacgcuacagcaucuuucaucuauaauggcaggcugguagauagcauuggcuccuggucaaagaaaauccuccggacccaggagagugaaugcguuuguaucaacgggacgugcacuguggucaugacagacggaagcgccucugguaaggcugauaccaaaauuuuauuuauagaggagggcaagaucgugcacauuuccacucugucagggagcgcccaacauguggaagagugcaguuguuacccucgcuauccaggagucagaugcguuuguagggacaacuggaagggcucuaaucggccgaucguggauauaaacguaaaagacuacuccauugugagcucguacgucugcucuggucuugugggggacacaccccgcaagaaugauuccuucucaaguagccacuguuuggacccuaacaaugaagagggaggccauggcguuaaagggugggcguuugaugacggaaacgauguguggaugggucgaaccaucuccgaaaagcugagaucuggcuaugagacguucaaagucaucgagggguggagcaagccaaauucaaaacuacagauuaacaggcaagugaucguagaacggggaaaucguaguggcuacuccgguauuuuuagcguugaggggaagucuugcauaaaccgcuguuucuauguggaacucaucagaggcaggaaggaggaaaccgaggucugguggacaucaaauaguauuguggucuuuugcggaacuagcggcaccuacgggacaggauccuggcccgacggugcagauaucaaccugaugccuaucuga

SEQ ID NO: 137998 - RNA, 1410 nt, Artificial Sequence
  derived and/or modified sequence opt3 from neuraminidase__InfluenzaA__ABU92862
augaaccccaaucagaagaucauuaccauaggcagcgugucccugacaaucgccgcuauuugcuuccucaugcaaaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuagucgggacaauagcauacgccuauccgcuggaggugauauuugggugacacgagagcccuacgucucuugugacccugauaaaugcuaucaauucgcccucggccaggggaccacgcugaacaauggacacucgaacgacacugugcaugaucguaccccauacagaacacuucugaugaaugaauugggcguucccuuucaccucgguacucgacagguguguaucgcauggucaagcaguuccugccaugacgggaaggccuggcugcacgucugugugaccggagaugacaagaacgcuacagcaucuuucauuuauaauggccggcugguagauagcaucggcuccuggaguaaaaagauccuccgcacccaggagucagaaugcguuuguauuaacgggacgugcacuguggucaugacagacggaagcgccucugguaaagcugauaccaagauauuauuuaucgaggagggcaaaauugugcacaucuccacucugucagggagcgcccaacauguggaagagugcaguuguuacccuagauauccaggagucaggugcguuugucgggacaacuggaagggcucuaaucgcccgauaguggauauuaacguaaaggacuacuccaucgugagcucguacgucugcucuggucuugugggggacacacccaggaaaaaugauuccuucucaaguagccacuguuuggacccuaacaaugaagagggaggccauggcguuaaggggugggcguuugaugacggaaacgauguguggauggguagaaccaucuccgaaaaacugaggucuggcuaugagacguucaaggucauugagggguggagcaaaccaaauucaaagcuacagaucaaccgucaggugauuguagaacggggaaaucgcaguggcuacuccgguauauuuagcguugaggggaaaucuugcaucaacagauguuucuauguggaacucauuaggggccggaaggaggaaaccgaggucugguggacaucaaauaguaucguggucuuuugcggaacuagcggcaccuacgggacaggauccuggcccgacggugcagauaucaaccugaugccuauuuga

SEQ ID NO: 137999 - RNA, 1410 nt, Artificial Sequence; identical to SEQ ID NO: 136241
  derived and/or modified sequence opt3 from neuraminidase__InfluenzaA__ABU92863

SEQ ID NO: 138000 - RNA, 1410 nt, Artificial Sequence
  derived and/or modified sequence opt3 from neuraminidase__InfluenzaA__ABU92865
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgaucuagacaaguguuaccaauucgcgcucggccaggggacgacucugaauaacguccauucaaaugauaccgugcacgaccgaacaccuuaucguacucuucugaugaacgaauugggaguuccauuucaucucggcaccaaacaggugugcauugcuuggagcaguuccucuugucacgaugguaaggccuggcugcaugucugcgugacaggggacgauaagaaugcaaccgccagcuucaucuacaacggaagacugguagacuccaucguuucauggaguaaaaagauucucaggacgcaggagagcgaaugugugugcauaaauggcacuuguacagucgugaugaccgauggcucugcuuccgggaaagcagacacuaagaucuuauuuauugaggagggaaagaucgugcacacaucaacccugagcgguagugcccaacacgucgaagagugcucuugcuauccccgguacccuggcguucgcugugugugcagagauaacuggaaaggguccaacaggccaauaguagacauuaauaucaaggacuacagcaucgugucgucuuaugucuguuccggacuugugggcgauacgccgcggaaaaacgacucaaguagcuccucucauugcuuggaucccaauaacgaagagggugggcacggaguuaagggcugggcuuucgacgauggcaaugacguguggauggggcgcaccauuagcgaaaaacugcgaucaggauacgagacauuuaaggucaucgaggguuggaguaacccuaauuccaaacuacagauuaacagacaggugauaguagauaggggcaaucggagcggguauucuggaaucuucucaguugaaggcaagaguuguauuaaccguugcuuuuacguggagcucauccgcgguagaaaggaagagacugaaguccuguggaccagcaauuccaucguggucuucugugggacaucuggcacuuauggaaccggcucguggccagacggggccgauauuaaccuuaugcccauauga

SEQ ID NO: 138001 - RNA, 1410 nt, Artificial Sequence
  derived and/or modified sequence opt3 from neuraminidase__InfluenzaA__ABU92866
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaguaugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaaugauaccguucacgaccgaacaccauaucguacucugcuuaugaacgaacugggagugcccuuucauuugggcaccaagcaggucugcaucgcuuggagcaguuccucuugucacgaugguaaagccuggcuccaugugugcguaacaggggacgauaagaaugcaaccgccagcuucauuuacaacggaagacugguugacuccaucgugucauggaguaaagagauccugaggacgcaggaaagcgagugugucugcauuaauggcacuuguacaguggugaugaccgauggcucugcuuccgggaaggcagacacuaaaauacucuuuaucgaggaaggaaagauuguccacacaucaaccuuaagcgguagugcccaacacguugaggaaugcucuugcuauccucgguacccaggcgugcgcuguguaugcagagauaacuggaagggguccaacaggccgaucguggacauaaauauuaaagacuacagcaucgucucgucuuauguguguuccggacugguuggcgauacgccccggaagaacgacucaaguagcaauucccauugccuugauccuaacaaugaggaaggugggcacggagugaaaggcugggcuuucgacgauggcaacgacgucuggauggggcgcaccaucucugagaaguugcgaagcggauacgagacauuuaaagugauugaagguuggucaaauccaaacaguaagcugcagaucaauagacagguaauuguugauaggggcaaccgguccggguauagcggaauauucucuguggagggcaaaucauguaucaaucguugcuuuuacgucgaacuaauucgcgguagaaaggaggaaacugaggugcucuggaccaguaacagcaucgucguguucugugggacauccggcacuuauggaaccggcucuuggcccgacggggccgauaucaaucugaugccuauuuga

SEQ ID NO: 138002 - RNA, 1410 nt, Artificial Sequence; identical to SEQ ID NO: 136823
  derived and/or modified sequence opt3 from neuraminidase__InfluenzaA__ABU92867

SEQ ID NO: 138003 - RNA, 1410 nt, Artificial Sequence; identical to SEQ ID NO: 137930
  derived and/or modified sequence opt3 from neuraminidase__InfluenzaA__ABU92868

SEQ ID NO: 138004 - RNA, 1410 nt, Artificial Sequence; identical to SEQ ID NO: 136710
  derived and/or modified sequence opt3 from neuraminidase__InfluenzaA__ABU92869

SEQ ID NO: 138005 - RNA, 1410 nt, Artificial Sequence; identical to SEQ ID NO: 137900
  derived and/or modified sequence opt3 from neuraminidase__InfluenzaA__ABU92870

SEQ ID NO: 138006 - RNA, 1410 nt, Artificial Sequence
  derived and/or modified sequence opt3 from neuraminidase__InfluenzaA__ABU92872
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgcuauccaggagucagaugcguuuguagggacaacuggaagggcucuaaucggccgauaguggauauuaacguaaaagacuacaauaucguguccagcuacgucugcucgggucuugugggggacacaccccgcaagaacgauucuuucuccucaagucacuguuuggacccuaauaacgaagagggaggccauggcguuaaagggugggcguuugaugacggaaaugauguguggaugggucgaaccaucagcgaaaagcugagauccggcuaugagacguucaaagucauugagggguggucuaagccaaacagcaaacuacagaucaauaggcaagugauuguagaacggggaaaccguucaggcuacagugguauauuuuccguugaggggaagaguugcaucaaucgcuguuucuauguggaacucauuagaggcaggaaggaggaaaccgaggucugguggacaucuaacucaaucguggucuuuugcggaacuagcggcaccuacgggacaggaagcuggcccgacggugcagauaucaaucugaugccuauuuga

SEQ ID NO: 138007 - RNA, 1410 nt, Artificial Sequence
  derived and/or modified sequence opt3 from neuraminidase__InfluenzaA__ABU92873
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaagaaaauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagauuaauagacaggugauaguagacaggggcaaccggagcggguauucuggaaucuucucaguugagggcaaaaguuguauuaaucguugcuuuuacguggaacuaauccgcgguagaaagcaggagacugaaguccucuggaccagcaacuccaucguggucuucugugggacaucuggcacuuauggaaccggcucguggcccgauggggccgacauuaauauaaugccuaucuga

SEQ ID NO: 138008 - RNA, 1410 nt, Artificial Sequence; identical to SEQ ID NO: 137945
  derived and/or modified sequence opt3 from neuraminidase__InfluenzaA__ABU92874

SEQ ID NO: 138009 - RNA, 1410 nt, Artificial Sequence; identical to SEQ ID NO: 136241
  derived and/or modified sequence opt3 from neuraminidase__InfluenzaA__ABU92875

SEQ ID NO: 138010 - RNA, 1410 nt, Artificial Sequence; identical to SEQ ID NO: 136241
  derived and/or modified sequence opt3 from neuraminidase__InfluenzaA__ABU92876

SEQ ID NO: 138011 - RNA, 1410 nt, Artificial Sequence; identical to SEQ ID NO: 136161
  derived and/or modified sequence opt3 from neuraminidase__InfluenzaA__ABU92877

SEQ ID NO: 138012 - RNA, 1410 nt, Artificial Sequence; identical to SEQ ID NO: 136241
  derived and/or modified sequence opt3 from neuraminidase__InfluenzaA__ABU92878

SEQ ID NO: 138013 - RNA, 1410 nt, Artificial Sequence
  derived and/or modified sequence opt3 from neuraminidase__InfluenzaA__ABU92879
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacaaaaacgccaccgcuucuuucauuuauaauggcaggcugguagauagcaucggcuccuggucaaagaaaauccuccggacgcaggagagugaaugcguuuguauuaacgggacuugcacaguggucaugaccgacggaagcgcaucugguaaggccgauacuaaaauauuauuuaucgaggagggcaagauugugcacaucuccacacugucagggagcgcucaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacccccaggaagaaugauuccuucucaaguagccacuguuuggacccuaacaaugaagagggaggccauggcguuaaagggugggccuuugaugacggaaacgauguguggaugggucgaacgaucuccgaaaagcugagaucuggcuaugagaccuucaaagucauugagggguggagcaagccaaauucaaaacuacagaucaaccgccaggugauuguagaacggggaaaucguaguggcuacuccgguauauuuagcguugaggggaagucuugcaucaaccgcuguuucuauguggaacucauuagaggcaggaagggagagacagaagucugguggacuucaaauaguaucguggucuuuugcggcaccagcgggacauacggaacugguuccuggcccgacggcgcggauaucaaccugaugccuauuuga

SEQ ID NO: 138014 - RNA, 1410 nt, Artificial Sequence; identical to SEQ ID NO: 138006
  derived and/or modified sequence opt3 from neuraminidase__InfluenzaA__ABU92880

SEQ ID NO: 138015 - RNA, 1410 nt, Artificial Sequence; identical to SEQ ID NO: 136241
  derived and/or modified sequence opt3 from neuraminidase__InfluenzaA__ABU92881

SEQ ID NO: 138016 - RNA, 1410 nt, Artificial Sequence; identical to SEQ ID NO: 136241
  derived and/or modified sequence opt3 from neuraminidase__InfluenzaA__ABU92882

SEQ ID NO: 138017 - RNA, 1410 nt, Artificial Sequence
  derived and/or modified sequence opt3 from neuraminidase__InfluenzaA__ABU92883
augaaccccaaucagaagaucauuaccauaggcagcgugucccugacaaucgccgcuauuugcuuccucaugcaaaucgcaauucuugucacuacgguuacccugcacuuuaaacagcaugaguguaacucuccuccaaagaaucaggugauguugugcgaaccgacaaucauagagagaaacaucacugaaauuguauacuuaaccaauacaaccaucgagaaagaaauuugucccaagcuggccgaguauaggaacuggucaaaaccucagugcaauaucacuggguucgcgccauuuaguaaggacaacagcauacggcuauccgcuggaggugauauuugggugacacgcgagcccuacgucucuugugacccugauaagugcuaucaauucgcccucggccaggggaccacgcugaauaacggacacucgaaugacacugugcaugaucgaaccccauaccguacacuucugaugaacgaauugggcguucccuuucaccucgguacuagacagguguguaucgcauggucaagcaguuccugccaugacgggaaagccuggcugcacgucugugugaccggagaugacaagaaugcuacagcaucuuucauuuauaacggcaggcugguagauagcaucguuuccuggaguaaaaagauccuccggacccaggagucagaaugcguguguauuaauggcacgugcacugucgugaugacagacgggagcgccucuggaaaagcugauaccaagauauuauuuaucgaggaggguaagauugugcacaucuccacucugucaggcagcgcccaacaugucgaagagugcaguuguuacccucgcuauccagggguuagaugcguguguagggacaacuggaaaggaucuaaccggccgauaguagauauuaaugugaaggacuacuccaucgucagcucguacgugugcucuggccuuguuggugacacaccccgcaaaaacgauuccuucucaaguagccacuguuuggacccuaauaacgaagaagggggacauggcgugaagggcugggcguuugaugacgggaaugaugucuggaugggacgaaccaucuccgagaaacugagaucugguuaugagacguucaaggugauugagggcuggagcaaaccaaacucaaagcuacagaucaauaggcagguaauuguugaacgggggaaccguaguggauacuccggcauauuuagcguggaggguaagucuugcaucaaucgcuguuucuaugucgaacucauuagagggaggaaagaggaaaccgaggugugguggacaucaaacaguaucgucguguuuugcggcacuagcggaaccuacggcacaggguccuggcccgacggagcagauaucaaucugaugccuauuuga

SEQ ID NO: 138018 - RNA, 1410 nt, Artificial Sequence; identical to SEQ ID NO: 136241
  derived and/or modified sequence opt3 from neuraminidase__InfluenzaA__ABU92884

SEQ ID NO: 138019 - RNA, 1410 nt, Artificial Sequence; identical to SEQ ID NO: 136241
  derived and/or modified sequence opt3 from neuraminidase__InfluenzaA__ABU92885

SEQ ID NO: 138020 - RNA, 1410 nt, Artificial Sequence; identical to SEQ ID NO: 136730
  derived and/or modified sequence opt3 from neuraminidase__InfluenzaA__ABU92886

SEQ ID NO: 138021 - RNA, 1410 nt, Artificial Sequence; identical to SEQ ID NO: 136241
  derived and/or modified sequence opt3 from neuraminidase__InfluenzaA__ABU92887

SEQ ID NO: 138022 - RNA, 1410 nt, Artificial Sequence
  derived and/or modified sequence opt3 from neuraminidase__InfluenzaA__ABU92888
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccaucguuucauggaguaagaaaauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucauuucgucuuauguguguuccggacuggucggcgacacgccccggaagaaugauucaaguagcuccucucauugccuugacccuaacaaugaggaaggugggcacggagugaaaggcugggcuuucgaugacggcaacgauguuuggauggggcgcaccaucagcgagaaguugcgaucaggauacgagacauuuaaaguggucgaagguuggaguaauccaaacuccaagcugcagauuaauagacaggugauaguagacagggauaaccggagcggcuauucugggaucuucucaguugagggaaaaaguuguauuaaucguugcuuuuacguggaacuaauccgcggcagaaaccaggagacugaaguccucuggaccagcaauuccaucguggucuucugugguacaucugggacuuauggcaccggaucguggcccgacggcgccgauauuaaccugaugccuauauga

SEQ ID NO: 138023 - RNA, 1410 nt, Artificial Sequence; identical to SEQ ID NO: 137945
  derived and/or modified sequence opt3 from neuraminidase__InfluenzaA__ABU92889

SEQ ID NO: 138024 - RNA, 1410 nt, Artificial Sequence
  derived and/or modified sequence opt3 from neuraminidase__InfluenzaA__ABU92890
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacaccccgcaagaaugauuccuucucaaguagccacuguuuggacccuaacaaugaagagggaggccauggcguuaaagggugggcguuugaugacggaaacgauguguggaugggucgaaccaucuccgaaaagcugagaucuggcuaugagacguucaaagucauugagggguggagcaagccaaauucaaaacuacagaucaacaggcaagugauuguagaacggggaaaucguaguggcuacuccgguauauuuagcguugaggggaagucuugcaucaaccgcuguuucuauguggaacucgucagaggcaggaaggaggaaaccgaggugugguggacaucaaauaguauugucguguuuugcggaacuagcggcaccuacgggacaggauccuggcccgacggugcagauaucaaccugaugccuaucuga

SEQ ID NO: 138025 - RNA, 1410 nt, Artificial Sequence; identical to SEQ ID NO: 137961
  derived and/or modified sequence opt3 from neuraminidase__InfluenzaA__ABU92891

SEQ ID NO: 138026 - RNA, 1410 nt, Artificial Sequence
  derived and/or modified sequence opt3 from neuraminidase__InfluenzaA__ABU92892
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggagguaauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaaaagauucugaggacgcaggagagcgaaugugugugcauaaacggcacuuguacagucgugaugaccgacggcucugcuuccgggaaagcagauacuaagauccucuuuauugaggagggaaagaucgugcacacaucaaccuuaagcgguagugcccaacacgucgaagagugcucuugcuauccucgguacccaggcguucgcugugugugcagagacaacuggaaaggguccaauaggccgauaguagauauuaacaucaaggacuacagcaucgugucgucuuaugucuguuccggacuggugggcgacacgccccggaaaaaugauucaaguagcuccucucauugccuugacccuaacaaugaagagggugggcacggaguuaagggcugggcuuucgaugacggcaacgauguguggauggggcgcaccauuagcgaaaaauugcgaucaggauacgagacauuuaaggucaucgaggguuggaguaauccaaacuccaaacugcagauuaauagacaggugauaguagacaggggcaaccggagcggguauucuggaaucuucucaguugaaggcaagaguuguauuaaucguugcuuuuacguggagcuaauccgcgguagaaaggaagagacugaaguccucuggaccagcaacuccaucguggucuucugugggacaucuggcacuuauggaaccggcucguggcccgauggggccgacauuaaucugaugccuauauga

SEQ ID NO: 138027 - RNA, 1410 nt, Artificial Sequence; identical to SEQ ID NO: 136823
  derived and/or modified sequence opt3 from neuraminidase__InfluenzaA__ABU92893

SEQ ID NO: 138028 - RNA, 1410 nt, Artificial Sequence
  derived and/or modified sequence opt3 from neuraminidase__InfluenzaA__ABU92895
augaaccccaaucagaagaucauuaccgugggcagcgucucccugacaauaucuacuaucugcuucuuuaugcaaauugccauccucauuacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaaugauaccguucacgaccgaacaccauaucguacucugcuuaugaacgaacugggagugcccuuucauuugggcaccaagcaggucugcaucgcuuggagcaguuccucuugucacgaugguaaagccuggcuccaugugugcguaacaggggacgauaagaaugcaaccgccagcuucauuuacaacggaagacugguugacuccaucgugucauggaguaaagagauccugaggacgcaggaaagcgagugugucugcauuaauggcacuuguacaguggugaugaccgauggcucugcuuccgggaaggcagacacuaaaauacucuuuaucgaggaaggaaagauuguccacacaucaaccuuaagcgguagugcccaacacguugaggaaugcucuugcuauccucgguacccaggcgugcgcuguguaugcagagauaacuggaagggguccaacaggccgaucguggacauaaauauuaaagacuacagcaucgcuucgucuuaugucuguuccggacuggugggcgauacgccccggaagaacgacucaaguagcuccucucauugccuugauccuaauaacgaggaaggugggcacggaguuaaaggcugggccuucgacgauggcaaugacguguggauggggcgcaccaucagcgagaaguugcgaucaggauacgagacauuuaaagucauugaagguuggaguaacccaaauuccaagcugcagaucaacagacaggugauuguagauaggggcaaucggagcggguauucuggaauauucucaguugagggcaaaaguuguaucaaccguugcuuuuacguggaacuaauucgcgguagaaaggaggaaacugagguccucuggaccagcaauuccaucguggucuucugugggacaucuggcacuuauggaaccggcucguggcccgacggggcggauaucaaccugaugccuauuuga

SEQ ID NO: 138029 - RNA, 1410 nt, Artificial Sequence
  derived and/or modified sequence opt3 from neuraminidase__InfluenzaA__ABU92896
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacagggaaugacaagaacgcaaccgccagcuucaucuacaauggaaggcugguggauuccauuguaucauggaguaaagagauacugcggacgcaggaaagcgaguguguuugcaucaacggcacuuguacaguggucaugaccgacggcucugcuuccgggaaggcagauacuaaaauucucuuuaucgaggaaggaaagauagugcauacaucaaccuuaagcgguagugcccaacacguggaggaaugcucuugcuauccucgcuacccaggcgucagauguguuugcagggacaacuggaagggguccaaucggccgauuguggauaucaacaucaaagaccacagcauuguaucgucuuacguguguuccggacuggucggcgacacgccccgcaagaaugauucaaguagcuccucucauugccuugacccuaacaaugaggaaggugggcacggagugaaaggcugggcuuucgaugaccgaaacgauguuuggaugggcagaaccaucagcgagaagucaagguugggguaugagacauuuaaagugauugaaggauggaguaauccaaacuccaagcugcagauaaaucggcaggucaucguggaccgugguaaccgcagcggcuacucugggauuuucucaguagagggaaaaaguuguaucaauagaugcuuuuauguugaacuaaucaggggccggaaggaggaaacugaggugcucuggaccagcaacuccauugucguguucugugguacaucugggacuuacggcaccggaucguggcccgauggcgccgacauaaaucugaugccuaucuga

SEQ ID NO: 138030 - RNA, 1410 nt, Artificial Sequence
  derived and/or modified sequence opt3 from neuraminidase__InfluenzaA__ABU92897
augaaccccaaucagaagaucauuaccauaggcagcgugucccugacaaucucuacuauuugcuucuuuaugcaaaucgccauucucaucacgaccgucacacuucacuucaaacaguacgagcugaacucaccuccaaauaaccagguuauguugugugaaccgacuauaaucgagagaaauauuaccgaaaucguguauuuaacaaacaccacuauugagaaggaaaucugccccaaacuggcugaguacaggaauuggaguaagccucaguguaacauaacaggguuugcaccauucagcaaagacaauuccauucggcuaucugccggaggugauaucuggguaacccgcgagcccuaugugucgugcgacccugauaaguguuaccaauuugcgcucggccaggggacgacucugaacaauguccauucaaacgacaccgugcacgaucgaacaccauaucguacucuucugaugaaugaauugggaguucccuuccaucucggcaccaaacaggugugcauugcuuggagcaguuccucuugucacgacgguaaggccuggcugcaugucugcgugacaggggaugacaagaacgcaaccgccagcuuuaucuacaauggaagacugguagauuccaucguuucauggaguaaagagauucucaggacgcaggaaagcgagugugugugcauaaacggcacuuguacagucgugaugaccgacggcucugcuuccgggaaggcagauacuaaaaucuuauucauugaggaaggaaagaucgugcacacaucaacccugagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuugugggcgacacgccccggaagaaugauucaaguagcuccucucauugcuuggacccuaacaaugaggaaggugggcacggaguuaaaggcugggcuuuugaugacggcaacgauguguggauggggcgcaccauuagcgagaagucacgaaguggauacgagacauucaaagucaucgaagguugguccaauccaaacagcaagcugcagauuaauagacaggugauaguagacaggggcaaccggucuggguauucaggaaucuuuaguguugagggcaaaagcuguauuaaucguugcuucuacguggaacuaauccgcgguagaaaggaggaaacugagguccucuggaccuccaacucuaucguggucuuuugugggacaucgggcacuuauggaaccggcagcuggcccgauggggccgacauuaaucugaugccuauauga

SEQ ID NO: 138031 - RNA, 1410 nt, Artificial Sequence
  derived and/or modified sequence opt3 from neuraminidase__InfluenzaA__ABU92898
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccguugugucauggaguaaagauauccugaggacgcaggagagcgaaugugucugcauuaauggcacuuguacaguggugaugaccgacggcucugcuuccgggaaggcagauacuaaaauacucuuuaucgaggagggaaagauuguccacacaucaaccuuaagcgguagugcccaacacguugaagagugcucuugcuauccucgguacccaggcgugcgcuguguaugcagagacaacuggaagggguccaacaggccgaucguggacauaaauauuaaaaacuacagcaucgucucgucuuauguguguuccggacugguuggcgauacgccccggaagaccgacucaaguagcuccucucauugccuugauccuaauaacgaagagggugggcacggagugaaaggcugggcuuucgacgauggcaaugacgucuggauggggcgcacaaucagcgaaaaguugcgacugggauacgagacuuuuaaagugauugaggguuggucaaacccaaauaguaagcuacagaucaacagacagguaauuguugauaggggcaaucggaccggguauuccggaauauucagcguggaaggcaaaucuuguaucaaccguugcuuuuacgucgagcucauucgcgguagaaaggaagagacagaagugcuguggacuucaaauaguaucgucguguucugugggaccagcggcacauauggaaccggcuccuggcccgacggggccgauaucaaccuuaugccuauuuga

SEQ ID NO: 138032 - RNA, 1410 nt, Artificial Sequence; identical to SEQ ID NO: 136241
  derived and/or modified sequence opt3 from neuraminidase__InfluenzaA__ABU92899

SEQ ID NO: 138033 - RNA, 1410 nt, Artificial Sequence
  derived and/or modified sequence opt3 from neuraminidase__InfluenzaA__ABU92900
augaaccccaaucagaagaucauuaccauaggcagcgugucccugacaaucgccgcuauuugcuuccucaugcagaucgcaauucuugucacuacgguuacccugcacuuuaaacagcaugaguguaacccuccaccgaauaaccaggugauguugugcgaacccacaaucauagagagaaauaucacugaaauuguauacuuaaccaacacaaccaucgagaaggaaauuuguccuaaacuggccgaguauaggaauuggucuaagccacagugcaacaucacuggguucgcgcccuuuucaaaagacaauaguauacggcuaagcgcuggaggugauauuugggugacacgcgagccuuacgucuccugugacccagauaagugcuaucaauucgcccucggccaggggaccacgcugaacaauggacacucuaacgacacugugcaugaucgaacccccuaccguacacuucugaugaaugaauugggcguuccuuuucaccucgguacuagacagguguguaucgcauggucgucaagcaguugccaugacgggaaggccuggcugcacgucugugugaccggagaugacaaaaacgcuacagcauccuucauuuauaauggcaggcugguagauucuaucggcagcugguccaagaaaauccuccggacccaggagucagaaugcguuuguauuaacgggacgugcacuguggucaugacagacggaagugccagcgguaaggcugauaccaaaauauuauuuaucgaggagggcaagauugugcacaucucuacucuguccgggucagcccaacauguggaagagugcagcuguuacccacgcuauccgggagucagaugcguuuguagggacaacuggaagggcaguaaucggcccauaguggauauuaacguaaaagacuacucuaucguguccagcuacgucugcucgggucuugugggggacacaccucgcaagaaugauucuuucuccucaagucacuguuuggacccaaacaaugaagagggaggccauggcguuaaagggugggcguuugaugacggaaacgauguguggaugggucgaaccaucagcgaaaagcugagauccggcuaugagacguucaaagucauugagggguggucuaagcccaauagcaaacuacagaucaacaggcaagugauuguagaacggggaaaucguucaggcuacagugguauauuuuccguugaggggaagaguugcaucaaccgcuguuucuauguggaacucauuagaggcaggaaggaggaaaccgaggucugguggacaucuaauucaaucguggucuuuugcggaacuagcggcaccuacgggacaggaagcuggccugacggugcagauaucaaccugaugccaauuuga

SEQ ID NO: 138034 - RNA, 1410 nt, Artificial Sequence
  derived and/or modified sequence opt3 from neuraminidase__InfluenzaA__ABU92901
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucuccucauggaguaagaaaauccuccggacccaggagagcgaaugcguuuguauuaacggcacgugcacuguggucaugacagacgggucugccuccggaaaggcugauaccaaaauauuauuuaucgaggaggguaagauugugcacaucucaacucugagcggcagugcccaacauguggaagagugcucuuguuacccucgcuauccaggggucagaugcguuuguagggacaacuggaagggauccaaucggccgauaguggauauuaacguaaaagacuacagcaucgugucgucuuacgucugcuccggccuugugggugacacaccccgcaagaaugauucauucaguagcucccacuguuuggacccuaacaaugaagaagggggacauggcguuaaaggcugggcguuugaugacgggaacgauguguggaugggacgaaccaucucugagaagcugagaagcgguuaugagacguucaaagucauugagggcuggucaaagccaaauaguaaacuacagaucaacaggcaagugauuguagaacgggggaaucguuccggauacagcggcauauuuucuguugaggguaagucaugcaucaaccgcuguuucuauguggaacucauuagagggaggaaggaggaaaccgaggucugguggacaaguaauagcaucguggucuuuugcggcacuuccggaaccuacggcacagggucuuggcccgacggagcagauaucaaccugaugccuauuuga

SEQ ID NO: 138035 - RNA, 1410 nt, Artificial Sequence; identical to SEQ ID NO: 136241
  derived and/or modified sequence opt3 from neuraminidase__InfluenzaA__ABU92902

SEQ ID NO: 138036 - RNA, 1410 nt, Artificial Sequence; identical to SEQ ID NO: 136241
  derived and/or modified sequence opt3 from neuraminidase__InfluenzaA__ABU92903

SEQ ID NO: 138037 - RNA, 1410 nt, Artificial Sequence; identical to SEQ ID NO: 137196
  derived and/or modified sequence opt3 from neuraminidase__InfluenzaA__ABU92904

SEQ ID NO: 138038 - RNA, 1410 nt, Artificial Sequence; identical to SEQ ID NO: 136241
  derived and/or modified sequence opt3 from neuraminidase__InfluenzaA__ABU92905

SEQ ID NO: 138039 - RNA, 1410 nt, Artificial Sequence
  derived and/or modified sequence opt3 from neuraminidase__InfluenzaA__ABU92906
augaaccccaaucagaagaucauuaccauaggcagcgugucccugacaaucgccgcuauuugcuuccucaugcagaucgcaauucuugucacuacgguuacccugcacuuuaaacagcaugaguguaacucuccuccaaauaaccaggugauguugugcgaaccgacaaucauagagagaaauaucacugaaauuguauacuuaaccaacacaaccaucgagaaggaaauuugucccaaacuggccgaguauaggaauuggucaaagccucagugcaacaucacuggguucgcgccauuuaguaaagacaauagcauacggcuauccgcuggaggugauauuugggugacacgcgagcccuacgucucuugugacccugauaagugcuaucaauucgcccucggccaggggaccacgcugaacaauggacacucgaacgacacugugcaugaucgaaccccauaccguacacuucugaugaaugaauugggcguucccuuucaccucgguacuagacagguguguaucgcauggucaagcaguuccugccaugacgggaaggccuggcugcacgucugugugaccggagaugacaaaaacgcuacagcaucuuucauuuauaauggcaggcugguagauagcaucggcuccuggucaaagaaaauccuccggacccaggagagugaaugcguuuguauuaacgggacgugcacuguggucaugacagacggaagcgccucugguaaggcugauaccaaaauauuauuuaucgaggagggcaagauugugcacaucuccacucugucagggagcgcccaacauguggaagagugcaguuguuacccucgcuauccaggagucagaugcguuuguagggacaacuggaagggcucuaaucggccgauaguggauauuaacguaaaagacuacuccaucgugagcucguacgucugcucuggucuugugggggacacaccccgcaagaaugauuccuucucaaguagccacuguuuggacccuaacaaugaagagggaggccauggcguuaaagggugggcguuugaugacggaaacgauguguggaugggucgaaccaucuccgaaaagcugagaucuggcuaugagacguucaaagucauugagggguggagcaagccaaauucaaaacuacagaucaacaggcaagugauuguagaacggggaaaucguaguggcuacuccgguauauuuagcguugaggggaagucuugcaucaaccgcuguuucuauguggaacucauuagaggcaggaaggaggaaaccgaggucugguggacaucaaauaguaucguggucuuuugcggaacuagcggcaccuacgggacaggauccuggcccgacggugcagauaucaaacugaugccuauuuga

SEQ ID NO: 138040 - RNA, 1410 nt, Artificial Sequence
  derived and/or modified sequence opt3 from neuraminidase__InfluenzaA__ABU92907
augaaccccaaucagaagaucauuaccauaggcagcaucucccugacaauugccgcuaucugcuuccucaugcaaauugcaauccuugugacuacggucacccugcacuuuaaacagcaugaguguaacucuccuccaaauaaccagguuauguugugcgaaccgacaauaaucgagagaaauauuacugaaaucguguacuuaaccaacacaaccauugagaaggaaaucugucccaaacuggccgaguauaggaauuggucaaagccucagugcaacauaacuggguucgcgccauuuaguaaagacaauagcauucggcuauccgcuggaggugauaucuggguaacacgcgagcccuacgugucuugugacccugauaagugcuaucaauucgcccucggccaggggaccacgcugaacaauggacacucgaacgacacuguccaugaucgaaccccauaccguacacuucugaugaaugaauugggcgugcccuuucaccucgguacuagacagguuuguauugcauggucaagcaguuccugccaugacgggaaggccuggcugcacgugugugucaccggagaugacaaaaacgcuacagcaucuuucaucuauaauggcaggcugguggauagcaucggcuccuggucaaagaaaauucuccggacccaggagagugaaugcguauguauaaacgggacgugcacuguugugaugacagacggaagcgccucugguaaggcugauaccaaaaucuuauuuauugaggagggcaagaucguccacauauccacucugucagggagcgcccaacauguggaagagugcaguuguuacccucgcuauccaggagugagaugcgucuguagggacaacuggaagggcucuaaucggccgauuguugauaucaacgugaaagacuacuccaucguaagcucguacgugugcucuggucuugucggggacacaccccgcaagaaugauuccuucucaaguagccacuguuuggacccuaacaaugaagagggaggccauggcgugaaagggugggcguuugaugacggaaacgauguuuggaugggucgaaccauuuccgaaaagcugagaucuggcuaugagacguucaaagugaucgagggguggagcaagccaaauucaaaacuacagauuaacaggcaggucauaguggaacggggaaaucguaguggcuacuccgguaucuuuagcguagaggggaagucuugcauuaaccgcuguuucuauguugaacucaucagaggcaggaaggaggaaaccgaggugugguggacaucaaauaguaucgucguguuuugcggaacuagcggcaccuacgggacaggauccuggcccgacggugcagauauuaaccugaugccuauauga

SEQ ID NO: 138041 - RNA, 1410 nt, Artificial Sequence; identical to SEQ ID NO: 136241
  derived and/or modified sequence opt3 from neuraminidase__InfluenzaA__ABU92908

SEQ ID NO: 138042 - RNA, 1410 nt, Artificial Sequence; identical to SEQ ID NO: 136241
  derived and/or modified sequence opt3 from neuraminidase__InfluenzaA__ABU92909

SEQ ID NO: 138043 - RNA, 1410 nt, Artificial Sequence
  derived and/or modified sequence opt3 from neuraminidase__InfluenzaA__ABU92910
augaaccccaaucagaagaucauuaccauaggcagcgugucccugacaaucgccacuauuugcuuccucacgcaaaucgcuauucuuaucaccacagucacucugcacuuuaaacaguacgaguguaacucuccuccaaauaaccagguuauguugugcgaaccgaccauaaucgagagaaauauuacagaaaucguguauuuaaccaacacuacaauugagaaggaaaucugucccaaacuggcagaguacaggaauuggucaaagccucagugcaacauaaccggguucgccccauuuaguaaagacaauagcauucggcuauccgcgggaggugauaucuggguaacgcgcgagcccuaugugucuugugacccugauaagugcuaccaauucgcucucggccaggggacuacccugaacaauggacauucgaacgacacaguccacgaucgaacuccauaucguacccuucugaugaaugaauugggcgugcccuuucaucucgguacaaagcagguuuguauugccuggucaagcaguuccugccacgacgggaaagcauggcugcaugugugugucaccggagaugacaagaacgccacggcuucuuucaucuacaauggcagacugguggauagcaucggcuccuggaguaaaaagauucucaggacucaggagucagaaugcguauguauaaacgggacaugcaccguugugaugacugacggaagcgcaucugguaaagccgauacaaagaucuuauuuauugaggagggcaagaucguccacaccucccugcuuucagggagcgcucaacacguggaagagugcaguuguuauccucgguacccaggagugcgcugcgucuguagagacaacuggaaaggcucuaauaggccgauaguugauauuaacgugcgggacuacuccaucguaagcucguaugugugcucugguuuggucggggacacgccccgcaagaaugauuccucaaguagcucccauugucuggacccuaacaaugaagagggaggccacggcgugaaagggugggccuucgaugacggaaacgauguuuggaugggucgaaccaucucugaaaagcuaagaagcggcuacgagacauuuaaagugauugagggguggucaaagccaaauaguaaacuccagaucaacaggcaggucauuguggacaagggaaaucgguccggcuauagcgguauauucucuguagaagggaagucaugcaucaaccguuguuuuuacguugagcugauucgcggcagaaaucaggaaacugaggugcuuuggaccaguaacagcaucgucguguucugcggaacauccggcacuuaugggaccggaucuuggcccgauggugcggacaucaaucugaugccuauuuga

SEQ ID NO: 138044 - RNA, 1410 nt, Artificial Sequence
  derived and/or modified sequence opt3 from neuraminidase__InfluenzaA__ABU92911
augaaccccaaucagaagaucauuaccauaggcagcgugucccugacaaucgccacuauuugcuuccucacgcaaaucgcuauucuugucaccacaguuacucugcacuuuaaacaguacgaguguaacucuccuccaaauaaccaggugauguugugcgaaccgaccaucauagagagaaauaucacagaaauuguauauuuaaccaacacuacaaucgagaaggaaauuugucccaaacaggcagaguacaggaauuggucaaagccucaaugcaacaucaccggguucgccccauuuaguaaagacaauagcauacggcuguccgcgggaggugauauuugggugacgcgcgagcccuaugucucuugugacccugauaagugcuaccaguucgcucuaggccaggggacuacccucaacaauggacauucgaacgacacagugcacgaucgaacuccauaucguacccugcuuaugaaugaacugggcguucccuuucauuuggguacaaaacagguguguaucgccuggucaagcaguuccugccacgacgggaaagcauggcuccaugucugugugaccggagaugacaagaacgccacggcuucuuucauuuacaauggcagacugguagauagcaucggcuccuggucaaagaagauccugaggacucaagagagugaaugcguuuguauuaacgggacaugcaccguggucaugacugacggaagcgcaucugguaaagccgauacaaagauacucuuuaucaaggagggcaaaauugugcacaccuccuuacugucagggagcgcucagcacguggaggaaugcaguuguuauccucgguacccaggaguccgcugcguuuguagagacaacuggaagggcucuaauaggccgaucguggauauaaacguaaaagacuacuccauugugagcucguaugucugcucuggucuugugggggacacgccccggaagaaugauuccucaaguagcucccauuguuuggacccuaacaaugaggaaggaggccacggcguuaaagggugggccuucgaugacggaaacgauguguggaugggucgcaccaucucugagaagcugcgaagcggcuacgaaacauuuaaagucaucgagggguggucaaagccaaauaguaagcuacagauuaacagacaggugaucguagacagggauaaucgguccggauauagcggcauuuucucuguugaggguaaaucaugcauaaaccguuguuuuuacguggaacucauccgcgggagaaaucaagagacugaaguccuguggaccaguaacagcauuguggucuucugcggcacauccggaacuuauggcaccgggucuuggcccgacggagcggauaucaaucuuaugccuaucuga

SEQ ID NO: 138045 - RNA, 1410 nt, Artificial Sequence
  derived and/or modified sequence opt3 from neuraminidase__InfluenzaA__ABU92913
augaaccccaaucagaagaucauuaccauaggcagcgugucccugacaaucgccacuauuugcuuccucacgcaaaucgcuauucuugucaccacaguuacucugcacuuuaaacaguacgaguguaacucuccuccaaauaaccaggugauguugugcgaaccgaccaucauagagagaaauaucacagaaauuguauauuuaaccaacacuacaaucgagaaggaaauuugucccaaacuggcagaguacaggaauuggucaaagccucagugcaacaucaccggguucgccccauuuaguaaagacaauagcauacggcuauccgcgggaggugauauuugggugacgcgcgagcccuaugucucuugugacccugauaagugcuaccaauucgcucucggccaggggacuacccugaacaauggacauucgaacgacacagugcacgaucgaacuccauaucguacccuucugaugaaugaauugggcguucccuuucaucucgguacaaaacagguguguaucgccuggucaagcaguuccugccacgacgggaaagcauggcugcaugucugugugaccggagaugacaagaacgccacggcuucuuucauuuacaauggcagacugguagauagcaucggcuccuggucaaagaagauccucaggacucaggagagugaaugcguuuguauuaacgggacaugcaccguggucaugacugacggaagcgcaucugguaaagccgauacaaagauauuauuuaucaaggagggcaaaauugugcacaccucccugcuuucagggagcgcucaacacguggaggaaugcaguuguuauccucgguacccaggaguccgcugcguuuguagagacaacuggaagggcucuaauaggccgaucguggauauaaacguaaaagacuacuccauugugagcucguaugucugcucugguuuggugggggacacgccccggaagaaugauuccucaaguagcucccauugucuggacccuaacaaugaggaaggaggccacggcguuaaagggugggccuucgaugacggaaacgauguguggaugggucgcaccaucucugagaagcuacgaagcggcuacgaaacauuuaaagucaucgagggguggucaaagccaaauaguaagcuccagauuaacagacaggugaucguagacagggauaaucgguccggauauagcggcauuuucucuguugaggguaaaucaugcauaaaccguuguuuuuacguggaacugauccgcgggagaaaucaggagacugaaguccuuuggaccaguaacagcauuguggucuucugcggcacauccggaacuuauggcaccgggucuuggcccgacggagcggauaucaaucugaugccuaucuga

SEQ ID NO: 138046 - RNA, 1413 nt, Artificial Sequence
  derived and/or modified sequence opt3 from neuraminidase__InfluenzaA__ABV29560
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacggugaugugugucugccgggauaacuggcacggcucuaaucgccccugggugagcuucaaccagaaucuggacuaccagaucggguauauuugcucaggaguguuuggugauaacccuagaccaaaagacggcaaggggaguuguaauccggucacuguugauggagccgacggcgugaaagguuucuccuacaaguaugggaacggcguauggaucggaaggacaaaaagcaaucggcugcgcaagggcuuugagaugaucugggaccccaacggguggaccgauacugacucugauuucucagugaagcaagacgucguggcuauuacagauuggaguggauacagcgguuccuuuguucagcauccugaacucaccggcuuagacugcauacgaccauguuucuggguggagcuggucagagggcuucccagggaaaauacgaccaucuggacaucuggaucgagcauuuccuucugcggcguggauucagacacugccaacuggaguuggccugauggugcagaguugccauuuaccaucgacaaauga

SEQ ID NO: 138047 - RNA, 1413 nt, Artificial Sequence; identical to SEQ ID NO: 138046
  derived and/or modified sequence opt3 from neuraminidase__InfluenzaA__ABV29571

SEQ ID NO: 138048 - RNA, 1413 nt, Artificial Sequence; identical to SEQ ID NO: 138046
  derived and/or modified sequence opt3 from neuraminidase__InfluenzaA__ABV29582

SEQ ID NO: 138049 - RNA, 1413 nt, Artificial Sequence; identical to SEQ ID NO: 138046
  derived and/or modified sequence opt3 from neuraminidase__InfluenzaA__ABV29615

SEQ ID NO: 138050 - RNA, 1413 nt, Artificial Sequence
  derived and/or modified sequence opt3 from neuraminidase__InfluenzaA__ABV29637
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacgggacagccucauacaaaaucuucaagauugaaaagggaaaaguuaccaagaguauagagcucaaugcgccuaacuuucacuaugaagaguguagcugcuacccagacacgggcacugugaugugugucugccgggauaauuggcacggcuccaaccgccccugggugucuuucaaucagaaccuggacuaccaggugggguauaucugcagcggagucuuuggugauaauccuagaccaaaagacggcaaggggucauguaacccgaugacaguugauggagcagacggcgugaaagguuucaguuacaaguaugggaauggcguauggauuggaaggaccaaauccaacaagcugcggaagggcuuugagaugaucugggaccccaauggguggacugauacagacagcgauuucucugugaaacaagacgucguggccaucucagauuggaguggauacagcgguuccuuuguucagcauccugaacucaccggcuuagacugcauucgcccauguuucuggguggagcugguccgagggcuucccagagaaaacacgaccauauggacaucuggaucgagcaucuccuucugcggcguggauucagacacugcuaauuggaguuggccugauggugccgaguugccauuuaccauugacaaguga

SEQ ID NO: 138051 - RNA, 1413 nt, Artificial Sequence; identical to SEQ ID NO: 138046
  derived and/or modified sequence opt3 from neuraminidase__InfluenzaA__ABV29648

SEQ ID NO: 138052 - RNA, 1413 nt, Artificial Sequence; identical to SEQ ID NO: 138046
  derived and/or modified sequence opt3 from neuraminidase__InfluenzaA__ABV29659

SEQ ID NO: 138053 - RNA, 1413 nt, Artificial Sequence; identical to SEQ ID NO: 138046
  derived and/or modified sequence opt3 from neuraminidase__InfluenzaA__ABV29670

SEQ ID NO: 138054 - RNA, 1413 nt, Artificial Sequence
  derived and/or modified sequence opt3 from neuraminidase__InfluenzaA__ABV29681
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacggugaugugugucugccgggauaacuggcacggcucuaaucgccccugggugagcuucaaccagaaucuggacuaccagaucggguauauuugcucaggaguguuuggugauaacccuagaccaaaagacggcaaggggaguuguaauccggucacuguugauggagccgacggcgugaaagguuucuccuacaaguaugggaacggcguauggaucggaaggacaaaaagcaaucggcugcgcaagggcuuugagaugaucugggaccccaacggguggaccgauacugacucugauuucucagugaagcaagacgucguggcuauuacagauuggaguggauacagcgguuccuuuguucagcauccugaacucaccggcuuagacugcauacgaccauguuucuggguggagcuggucagagggcuucccagggaaaauacgaccaucuggacaucuggaucgagcauuuccuucugcggcaucgauucagacacugccaacuggaguuggccugauggugcagaguugccauuuaccauugacaaauga

SEQ ID NO: 138055 - RNA, 1413 nt, Artificial Sequence; identical to SEQ ID NO: 138046
  derived and/or modified sequence opt3 from neuraminidase__InfluenzaA__ABV29692

SEQ ID NO: 138056 - RNA, 1413 nt, Artificial Sequence; identical to SEQ ID NO: 138046
  derived and/or modified sequence opt3 from neuraminidase__InfluenzaA__ABV29703

SEQ ID NO: 138057 - RNA, 1410 nt, Artificial Sequence
  derived and/or modified sequence opt3 from neuraminidase__InfluenzaA__ABV29714
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccggggaggcagacacuaagauucucuuuaucgaagagggaaaaauagugcauacaucaaccuuaagcgguagugcccaacacguggaagagugcucuugcuauccucgcuacccaggcgucagauguguuugcagggauaacuggaagggguccaaccggccgauuguggacaucaauaucaaggaccacagcauuguaucgucuuacguguguuccggacuggucggcgauacgccccgcaaaaacgacucaaguagcuccucucauugccuugauccuaauaacgaagagggugggcacggagugaagggcugggcuuucgacgauggcaaugacguuuggauggggcgaaccaucagcgagaaaucaagauugggauaugaaacauuuaaggugauugaggguuggaguaacccaaaauccaagcugcagauaaauaggcaggucaucguggaucggggcaaccguagcggguacucuggaauuuucucaguagaaggcaaaaguuguaucaaucgcugcuuuuauguugagcuaaucagagguaggaaggaagagacugaggugcucuggaccagcaacuccauugucguguucugugggacaucuggcacuuacggaaccggcucguggcccgacggggccgauauaaaucugaugccuaucuga

SEQ ID NO: 138058 - RNA, 1410 nt, Artificial Sequence
  derived and/or modified sequence opt3 from neuraminidase__InfluenzaA__ABV29725
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccaggggaugcugugugaaccgaccaucauagagagaaauaucacagaaauuguuuauuugaccaacacuacaaucgagaaggaaauuugccccaaauuagcugaguacaggaauuggaguaagccucagugugacaucaccggauucgcaccauuuagcaaagauaacuccauacggcugucugccgguggcgacauuugggugacgcgcgagcccuauguaucgugcgauccugacaaguguuaccaauucgcgcuagggcagggaacuacccucaauaacgugcauucaaaugauacaguccgagaccguacuccauauagaacccugcuuaugaacgaacugggcgugcccuuucacuuggguacaaagcagguuugcaucgcuuggagcaguuccucuugucaugaugggaaagccuggcuccacgugugcauuaccggagacgauaagaaugcaacggccagcuucaucuacaacggcaggcuggucgacuccaucgugucauggaguaaagagauucugcggacucaggaaagcgaguguguaugcauaaauggcacauguaccguugugaugacugaugggucugcuuccggaaaggcagacacaaaaauccucuuuauugaggaagguaagaucguccauaccucaacguuaagcggcagugcccaacacguggaggaaugcucuugcuucccucgcuauccaggggugagaugugucugcagggauaacuggaagggauccaaccggccgauaguugacauuaauaucaaagaccacagcaucgugucgucuuacguauguuccggccuggugggugauacccccaggaagaacgacucaaguagcuccucucauugccuugauccuaauaacgaggaagggggacacggcgucaaaggcugggcuuuugacgaugggaaugacguguggaugggacgaacaauuagcgagaagucaagauuggguuacgagacuuucaaaguuaucgaaggcuggaguaacccaaaguccaaacugcagauuaaucgccaggugauagucgaucgggggaaccguagcggauauucuggcaucuuuucaguggaggguaagaguuguauuaaucgcugcuucuacguagaacuaaucagagggaggaaggaggaaaccgagguucucuggacaagcaacuccaucguggucuucuguggcacuucuggaaccuauggcacagggucguggcccgacggagccgauauuaaucugaugccuauauga

SEQ ID NO: 138059 - RNA, 1413 nt, Artificial Sequence
  derived and/or modified sequence opt3 from neuraminidase__InfluenzaA__ABV29736
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguugugaccgggaaagacaagacaucgguaacccuugcaggaaauucaagccuguguaguauuuccggcugggccaucuacacuaaagauaacucuaucaggauugguagcaagggggacguguucgucauacgggagccuuuuaucuccugcucacauuuggagugucgcacauucuuuuuaacccaaggagcgcugcuaaaugauaaacacaguaacggcacggugaaggaccgaagcccauaucgugcucucaugucuugcccgcugggcgaagcccccuccccuuacaauucaaaguucgagagcguugcauggagugccucugcuugucaugaugggaugggauggcuuacuauugguaucuccggcccagacaacggggcaguggccguccugaaauauaacggaauaauuaccgaaacaaucaagagcuggaaaaagagaaucuugaggacucaggagucggagugcguguguguaaauggcucuugcuuuaccauuaugacagauggucccuccgacggggcugccucauacaaaaucuucaagauugaaaagggaaaaguuaccaagaguauagagcucaacgcgccuaauuuucacuaugaagaguguagcugcuacccagauacgggcacugugaugugugucugccgggacaacuggcacggcuccaaucgccccugggugucuuucaaccagaaucuggauuaccagaucggguauauuugcagcggaguguuuggugacaacccuagaccaaaagauggcaaggggucauguaauccggucacaguugacggagcagacggcgugaaagguuucaguuacaaguaugggaacggcguauggaucggaaggaccaaauccaauaagcugcggaagggcuuugagaugaucugggaucccaacggguggacugacacagauaaugacuucagcgugaaacaagaugucguggccauuaccgacuggucuggauacucagguaguuuuguucagcauccugaacucacgggcuuagauugcauacgcccauguuucuggguggagcugguccgagggcuucccagagaaaacaccacaaucuggacuagcggauccucuauuucguucugcggcguggacagcgauaccgcuaauugguccuggccugacggugccgaguugccauuuacaaucgauaaguga

SEQ ID NO: 138060 - RNA, 1413 nt, Artificial Sequence
  derived and/or modified sequence opt3 from neuraminidase__InfluenzaA__ABV29747
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacggugaugugugucugccgggauaacuggcacggcucuaaucgccccugggugagcuucaaccagaaucuggacuaccagaucggguauauuugcucaggaguguuuggugauaacccuagaccaaaagacggcaaggggaguuguaauccggucacuguugauggagccgacggcgugaaagguuucuccuacaaguaugggaacggcguauggaucggaaggacaaaaagcaaucggcugcgcaagggcuuugagaugaucugggaccccaacggguggaccgauacugacucugauuucucagugcgacaagacgucguggcuauuacagauuggaguggauacagcgguuccuuuguucagcauccugaacucaccggcuuagacugcauaagaccauguuucuggguggagcuggucagggggcuuccccgggaaaauacgaccaucuggacaucuggaucgagcauuuccuucugcggcguggauucagacacugccaacuggaguuggccugauggugcagaguugccauuuaccaucgacaaguga

SEQ ID NO: 138061 - RNA, 1413 nt, Artificial Sequence; identical to SEQ ID NO: 138046
  derived and/or modified sequence opt3 from neuraminidase__InfluenzaA__ABV29769

SEQ ID NO: 138062 - RNA, 1413 nt, Artificial Sequence
  derived and/or modified sequence opt3 from neuraminidase__InfluenzaA__ABV29780
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguugugaccgggaaagacaagacaucgguaacccuugcaggaaauucaagccuguguaguauuuccggcugggccaucuacacuaaagauaacucuaucaggauugguagcaagggggacguguucgucauacgggagccuuuuaucuccugcucacauuuggagugucgcacauucuuuuuaacccaaggagcgcugcuaaaugauaaacacaguaacggcacggugaaggaccgaagcccauaucgugcucucaugucuugcccgcugggcgaagcccccuccccuuacaauucaaaguucgagagcguugcauggagugccucugcuugucaugaugggaugggauggcuuacuauugguaucuccggcccagacaacggggcaguggccguccugaaauauaacggaauaauuaccgaaacaaucaagagcuggaaaaagagaaucuugaggacucaggagucggagugcguguguguaaauggcucuugcuuuaccauuaugacagauggucccuccgacggggcugccucauacaaaaucuucaagauugaaaagggaaaaguuaccaagaguauagagcucaacgcgccuaauuuucacuaugaagaguguagcugcuacccagauacgggcacugugaugugugucugccgggacaacuggcacggcuccaaucgccccugggugucuuucaaccagaaucuggauuaccagaucggguauauuugcagcggaguguuuggugacaacccuagaccaaaagauggcaaggggucauguaauccggucacaguugacggagcagacggcgugaaagguuucaguuacaaguaugggaacggcguauggaucggaaggaccaaauccagcaagcugcggaagggcuuugagaugaucugggaucccaauggguggacugacacagauaacgacuucucugugaaacaagaugucguggccauuaccgacuggucaggauacagugguagcuuuguucagcauccugaacucacgggcuuagauugcauacgcccauguuucuggguggagcugguccgagggcuucccagagaaaauaccacaaucuggacuuccggaucuucgauuagcuucugcggcguggacuccgauaccgcuaacuggucauggccugacggugccgaguugccauuuacaaucgauaaguga

SEQ ID NO: 138063 - RNA, 1413 nt, Artificial Sequence; identical to SEQ ID NO: 138046
  derived and/or modified sequence opt3 from neuraminidase__InfluenzaA__ABV29791

SEQ ID NO: 138064 - RNA, 1413 nt, Artificial Sequence; identical to SEQ ID NO: 138046
  derived and/or modified sequence opt3 from neuraminidase__InfluenzaA__ABV29802

SEQ ID NO: 138065 - RNA, 1410 nt, Artificial Sequence; identical to SEQ ID NO: 137900
  derived and/or modified sequence opt3 from neuraminidase__InfluenzaA__ABV29824

SEQ ID NO: 138066 - RNA, 1413 nt, Artificial Sequence; identical to SEQ ID NO: 138046
  derived and/or modified sequence opt3 from neuraminidase__InfluenzaA__ABV29835

SEQ ID NO: 138067 - RNA, 1413 nt, Artificial Sequence
  derived and/or modified sequence opt3 from neuraminidase__InfluenzaA__ABV29846
augaaccccaaucagaagaucauuaccauaggcagcaucuccauugccaucgggauuaucucucugaugcuccaaauaggaaacaucauuucaaucugggcuagucacagcauucagaucgguucccagaaucauacaggcauaugcaaccagagaauuaucacuuacgaaaauucuacgugggugaaccacaccuaugucaauauuaacaauacaaacguuguggcagggaaagacaagacuucgguaacccuugccggaaauucaagccuguguaguaucuccggcugggcgaucuacacaaaagauaacucuauuaggauagguagcaagggggacguguucgucauccgggagccuuuuauuuccugcucacauuuggagugucgcaccuucuuuuuaacucaaggagcucugcuaaaugauaaacacaguaacggcacagugaaggaccgaagcccauaucgugcccucaugucuugcccgcugggcgaagcacccuccccuuacaauucaaaguucgagagcguugccuggagugcuucugcaugucaugaugggaugggauggcuuaccaucgguauauccggcccagacaacggggccguggcuguccugaaauauaacggaauuaucacggaaacuaucaagagcuggaaaaagagaauuuugaggacccaggagucggagugcguguguguaaauggcucuugcuuuacaaucaugacugauggucccuccaacggggccgcgucauacaaaauuuucaagauagaaaagggaaaaguuaccaagaguaucgagcucaaugcaccuaacuuucacuaugaagaguguagcugcuacccagacacaggcaccgugaugugugucugccgggauaauuggcacggcuccaaccgccccugggugucuuucaaucagaaccuggacuaccaggugggguauauuugcagcggagucuuuggugauaauccuagaccaaaagacggcaaggggucauguaacccgaugacgguugauggagccgacggcgugaaagguuucaguuacaaguaugggaauggcguauggaucggaaggacuaaauccaacaagcugcggaagggcuuugagaugaucugggaccccaauggguggacagauaccgacagcgauuucucugugaaacaagacgucguggcuauuacugauuggucaggauacagugguagcuuuguucagcauccugaacucacaggcuuagacugcauacgcccauguuucuggguggagcugguccgagggcuucccagagaaaacaccacgaucuggaccuccggaucuucgauuagcuucugcggcguggauuccgacacagccaauuggucauggccugauggugcagaguugccauuuacuaucgacaaguga

SEQ ID NO: 138068 - RNA, 1413 nt, Artificial Sequence
  derived and/or modified sequence opt3 from neuraminidase__InfluenzaA__ABV29879
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucauaauccgggagccuuuuauuucaugcagucauuuggagugucgcacuuucuuuuuaacacaaggagcucugcuaaacgauaaacacagcaauggcaccgucaaggaccgaucuccauaucgugcccucauguccugcccgcugggcgaagcacccucaccuuacaacagcaaguucgagaguguggccuggucugcuuccgcaugucaugaugggaugggauggcuuacgaucgguauaagcggcccagacaauggggccguugcugugcugaaauauaacggaauuaucacugaaaccaucaagucguggaaaaagagaauuuugaggacacaggagucugagugcgucugugugaacggcuccugcuuuacuaucaugaccgauggucccucaaauggggccgcgaguuacaaaauuuucaagauagaaaagggaaaaguaacaaagagcaucgagcucaacgcaccuaauuuucacuaugaagaguguuccugcuacccagacaccggcacgguuaugugugugugccgggauaacuggcacggcucuaaucgccccugggucagcuucaaccagaaucuggacuaccagauuggguauaucugcucaggaguguuuggugauaacccuagaccaaaagacggcaaggggaguuguaauccggugacugucgauggagccgacggcguuaaagguuucuccuacaaguaugggaacggcguguggaucggaaggacaaaaagcaaucggcugcgcaagggcuuugagaugauuugggaccccaacggguggaccgauacugacucugauuucucaguaaagcaagacguggucgcuauaacagauuggaguggauacagcgguuccuuugugcagcauccugaacucaccggcuuagacugcauccgaccauguuucuggguugagcuggugagagggcuucccagggaaaauacgaccauuuggacaucuggaucgagcaucuccuucugcggcgucgauucagacacugccaacuggaguuggccugauggugcagaguugccauuuaccauugacaaauga

SEQ ID NO: 138069 - RNA, 1413 nt, Artificial Sequence; identical to SEQ ID NO: 138046
  derived and/or modified sequence opt3 from neuraminidase__InfluenzaA__ABV29890

SEQ ID NO: 138070 - RNA, 1410 nt, Artificial Sequence; identical to SEQ ID NO: 137900
  derived and/or modified sequence opt3 from neuraminidase__InfluenzaA__ABV29901

SEQ ID NO: 138071 - RNA, 1410 nt, Artificial Sequence
  derived and/or modified sequence opt3 from neuraminidase__InfluenzaA__ABV29912
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagauauucugaggacgcaggagagcgaauguauaugcaucaauggcacuuguacaguggucaugaccgacggcucugcuuccgggaaggcagauacuaaaauucucuuuaucgaggagggaaagauagugcacacaucaaccuuaagcgguagugcccaacacguggaagagugcucuugcuauccucgguacccaggcguccgcuguguuugcagagacaacuggaagggguccaacaggccgauuguggacaucaauaucaaagauuacagcauuguaucgucuuauguguguuccggacuggucggcgacacgccccggaagaacgauucaaguagcuccucucauugccuugacccuaauaacgaagagggugggcacggagugaaaggcugggcuuucgaugacggcaaugauguuuggauggggcgcaccaucagcgaaaaguugcgacugggauacgagacauuuaaagugauugaggguuggucaaacccaaauaguaagcuacagauaaacagacaggucaucguggacaaaggcaauagguccggguauagcggaauuuucucuguagaaggcaagucauguaucaaccggugcuuuuacguugagcucauccguggucgcaaggaagagacugaagugcuguggaccaguaauagcauugucguguucugugggacauccggcacuuauggaaccggcucuuggcccgauggggccgacauaaaccuuaugccuaucuga

SEQ ID NO: 138072 - RNA, 1413 nt, Artificial Sequence
  derived and/or modified sequence opt3 from neuraminidase__InfluenzaA__ABV29923
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccaggugggguauaucugcagcggagucuuuggugauaauccuagaccaaaagacggcaaggggucauguaacccgaugacuguugauggagccgacggcgugaaagguuucaguuacaaguaugggaauggcguauggauuggaaggacaaaauccaacaagcugcggaagggcuuugagaugaucugggaccccaauggguggaccgauacugacagcgauuucucugugaaacaagacgucguggcuaucacagauuggucaggauacagugguagcuuuguucagcauccugaacucaccggcuuagacugcauucgcccauguuucuggguggagcugguccgagggcuucccagagaaaacgccacgauauggaccuccggaucuucgaucagcuucugcggcguggauuccgacacagcaaauuggucauggccugauggugcugaguugccauuuacuauugacaaguga

SEQ ID NO: 138073 - RNA, 1410 nt, Artificial Sequence
  derived and/or modified sequence opt3 from neuraminidase__InfluenzaA__ABV29934
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaagggguccaaccggccgauuguggacaucaauaucaaagaccacagcauuguaucgucuuacguguguuccggacuggucggcgauacgccccgcaagaacgacucaaguagcuccucucauugccuugauccuaauaacgaggaaggugggcacggagugaaaggcugggcuuucgacgauggcaaugacguuuggauggggcgaaccaucagcgagaagucaagauugggauaugagacauuuaaagugauugaagguuggaguaacccaaaguccaaacugcagauaaauaggcaggucaucguggaucggggcaaccguacuggguacagcggaauuuucucuguagagggcaagucauguaucaaucgcugcuuuuauguugaacuaaucagagguaggaaggaggaaaccgaggugcucuggacaaguaacagcauugucguguucugugggacuuccggcaccuacggaacaggcucuuggcccgacggggccgauauaaaucugaugccuaucuga

SEQ ID NO: 138074 - RNA, 1413 nt, Artificial Sequence; identical to SEQ ID NO: 138059
  derived and/or modified sequence opt3 from neuraminidase__InfluenzaA__ABV29945

SEQ ID NO: 138075 - RNA, 1413 nt, Artificial Sequence
  derived and/or modified sequence opt3 from neuraminidase__InfluenzaA__ABV29956
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaagggaauaauuacugaaaccaucaaaucguggaagaaaagaaucuugaggacacaggagucugagugcguguguguaaacggcuccugcuuuacuauuaugaccgauggucccucaaacggggccgcgaguuacaagaucuucaagauugaaaaaggaaagguuacaaaaagcauagagcucaaugcaccuaacuuucacuaugaagaguguuccugcuacccagacaccggcacggugaugugugucugccgggauaauuggcacggcucuaaccgccccugggugagcuucaaucagaaccuggacuaccagaucggguauauuugcucaggaguguuuggugauaauccuagaccaaaggacggcaaagggaguuguaacccggucacuguugauggagccgacggcgugaaggguuucuccuacaaauaugggaauggcguauggaucggaaggacaaagagcaaccggcugcgcaagggcuuugagaugaucugggaccccaauggguggaccgauacugacucugauuucucagugaaacaagacgucguggcuauuacagauuggaguggauacagcgguuccuuuguucagcauccugaacucaccggcuuagacugcauacgaccauguuucuggguggagcuggucagagggcuucccagggaaaacacgaccaucuggacaucuggaucgagcauuuccuucugcggcguggauucagacacugccaauuggaguuggccugauggugcagaguugccauuuaccaucgacaaguga

SEQ ID NO: 138076 - RNA, 1413 nt, Artificial Sequence
  derived and/or modified sequence opt3 from neuraminidase__InfluenzaA__ABV29989
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucaugcgggagccuuuuauaucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgaucgguauuagcggcccagacaauggggccguggcuguccugaaauauaacggaaucauaacugaaaccauuaagucguggaaaaagagaaucuugaggacacaggagucugagugcguguguguaaacggcuccugcuuuacuaucaugaccgauggucccucaaauggggccgcgaguuacaaaauuuucaagaucgaaaagggaaaaguuacaaagagcauugagcucaacgcaccuaauuuucacuaugaagaguguuccugcuacccagacaccggcacggugaugugugucugccgggauaacuggcacggcucuaaucgccccugggugagcuucaaccagaaucuggacuaccagauaggguauaucugcucaggaguguuuggugauaacccuagaccaaaagacggcaaggggaguuguaauccggucacuguugauggagccgacggcgugaaagguuucuccuacaaguaugggaacggcguauggauuggaaggacaaaaagcaaucggcugcgcaagggcuuugagaugaucugggaccccaacggguggaccgauacugacucugauuucucagugaagcaagacgucguggcuaucacagauuggaguggauacagcgguuccuuuguucagcauccugaacucaccggcuuagacugcauucgaccauguuucuggguggagcuggucagagggcuucccagggaaaauacgaccauauggacaucuggaucgagcaucuccuucugcggcguggauucagacacugccaacuggaguuggccugauggugcagaguugccauuuaccauugacaaauga

SEQ ID NO: 138077 - RNA, 1413 nt, Artificial Sequence; identical to SEQ ID NO: 138046
  derived and/or modified sequence opt3 from neuraminidase__InfluenzaA__ABV30000

SEQ ID NO: 138078 - RNA, 1413 nt, Artificial Sequence; identical to SEQ ID NO: 138046
  derived and/or modified sequence opt3 from neuraminidase__InfluenzaA__ABV30011

SEQ ID NO: 138079 - RNA, 1413 nt, Artificial Sequence; identical to SEQ ID NO: 138046
  derived and/or modified sequence opt3 from neuraminidase__InfluenzaA__ABV30022

SEQ ID NO: 138080 - RNA, 1413 nt, Artificial Sequence
  derived and/or modified sequence opt3 from neuraminidase__InfluenzaA__ABV30044
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgggaacacuugccggcaauucaagccuguguaguauuuccgguugggcgaucuacaccaaagauaacucuaucaggauugggagcaagggagacguauucgugauacgggagccuuuuaucuccugcucacauuuggagugucgcacuuucuuuuuaacacaaggcgcucugcuaaaugauaaacacaguaacggcaccgucaaggaccgaagcccauaucgugcccucaugucuugcccgcugggggaagcacccuccccuuacaauucaaaguucgagagcguggccuggagugcuucugcaugucaugauggaauggguuggcuuacgauuggcaucuccgggccagacaacggagccguugcugugcugaaauauaacggcauaauuacugaaaccaucaagagcuggaaaaagagaaucuugaggacacaggagucggagugcgucugugugaaugguucuugcuuuacuauuaugaccgaugggcccuccaacggagccgcgucauacaaaaucuucaagauugaaaagggcaaaguaacaaagaguauagagcucaaugcaccuaacuuucacuaugaagaguguagcugcuacccagacaccggcacgguuaugugugugugccgggauaauuggcacggguccaaccgccccugggucucuuucaaucagaaccuggacuaccaggugggauauaucugcagcgguguguuuggcgauaauccuagaccaaaagacgggaagggaucauguaacccgaugacugucgauggcgccgacgguguuaaaggguucaguuacaaguauggcaauggaguguggauuggcaggacaaaauccaacaagcugcggaagggguuugagaugaucugggaccccaauggauggaccgauacugacagcgauuucucuguaaaacaagacguggucgcuaucacagauuggucagguuacaguggcagcuuugugcagcauccugaacucaccggguuagacugcauucgcccauguuucuggguugagcuggugcgaggacuucccagagaaaacacgaccauauggacauccgguucuucgaucagcuucugcggcgucgauuccgacacugccaauuggucauggccugauggggcagaguugccauuuaccauugacaaguga

SEQ ID NO: 138081 - RNA, 1413 nt, Artificial Sequence
  derived and/or modified sequence opt3 from neuraminidase__InfluenzaA__ABV30055
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccaggugggguauaucugcagcggagucuuuggugauaauccuagaccaaaagacggcaaggggucauguaacccgaugacuguugauggagccgacggcgugaaagguuucaguuacaaguaugggaauggcguauggauuggaaggacaaaauccaacaagcugcggaagggcuuugagaugaucugggaccccaauggguggaccgauacugacagcgauuucucugugaaacaagacgucguggcuaucacagauuggucaggauacagugguagcuuuguucagcauccugaacucaccggcuuagacugcauucgcccauguuucuggguggagcugguccgagggcuucccagagaaaacacgaccauauggacauccggaucuucgaucagcuucugcggcguggauuccgacacugccaauuggucauggccugauggugcagaguugccauuuaccauugacaaguga

SEQ ID NO: 138082 - RNA, 1410 nt, Artificial Sequence
  derived and/or modified sequence opt3 from neuraminidase__InfluenzaA__ABV30077
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaaugauacagugcgagaccguacuccauauagaacccugcuuaugaacgaacugggaguucccuuucacuugggcacaaaacaggugugcaucgcuuggagcaguuccucuugucaugaugguaaggccuggcuccacgucugcauuaccggggacgauaagaaugcaacggccagcuucaucuacaacggaaggcugguggacuccaucguaucauggaguaaagagauucugcggacucaggaaagcgaguguguuugcauaaauggcacauguaccguggucaugacugauggcucugcuuccgggaaggcagacacaaaaauccucuuuauugaggaaggaaagaucgugcauaccucaacguuaagcgguagugcccaacacguggaggaaugcucuugcuauccucgcuacccaggcgucagauguguuugcagggauaacuggaagggguccaaccggccgauaguggacauuaauaucaaagaccacagcaucguaucgucuuacguguguuccggacuggucggcgauacaccccgcaagaacgacucaaguagcuccucucauugccuugauccuaauaacgaggaaggugggcacggagugaaaggcugggcuuucgacgauggcaaugacguuuggauggggcgaaccauuagcgagaagucaagauugggauaugagacuuuuaaagugaucgaagguuggaguaacccaaaguccaaacugcagauuaauaggcaggucauaguggaucggggcaaccguagcggguacucuggaaucuucucaguagagggcaagaguuguauuaaucgcugcuuuuauguugaacuaaucagagguaggaaggaggaaaccgaggugcucuggacaagcaacuccaucgucguguucugugggacuucuggcaccuacggaacaggcucguggcccgacggggccgauauuaaucugaugccuauauga

SEQ ID NO: 138083 - RNA, 1413 nt, Artificial Sequence; identical to SEQ ID NO: 138046
  derived and/or modified sequence opt3 from neuraminidase__InfluenzaA__ABV30088

SEQ ID NO: 138084 - RNA, 1413 nt, Artificial Sequence; identical to SEQ ID NO: 138046
  derived and/or modified sequence opt3 from neuraminidase__InfluenzaA__ABV30099

SEQ ID NO: 138085 - RNA, 1413 nt, Artificial Sequence
  derived and/or modified sequence opt3 from neuraminidase__InfluenzaA__ABV30110
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacuggcaccaucaagucguggaaaaagagaaucuugaggacacaggaaucugagugcguguguguaaacgguuccugcuuuacuauuaugaccgaugggcccucaaauggagccgcgaguuacaaaaucuucaagauugagaagggcaaaguuacaaagagcauagaacucaacgcaccuaauuuucacuaugaggaauguuccugcuacccagacaccggcacggugaugugugucugccgggauaacuggcacgggucuaaucgccccugggugagcuucaaccagaaucuggacuaccagaucggauauauuugcucagguguguuuggcgauaacccuagaccaaaagacgggaagggaaguuguaauccggucacuguugauggcgccgacggugugaaaggguucuccuacaaguauggcaacggaguauggaucggcaggacaaaaagcaaucggcugcgcaagggguuugagaugaucugggaccccaacggauggaccgauacugacucugauuucucagugaagcaagacgucguggcuauuacagauuggagugguuacagcggcuccuuuguucagcauccugagcucaccggguuagacugcauacgaccauguuucuggguggaacuggucagaggacuucccagggagaauacgaccaucuggacaucuggcucgagcauuuccuucugcgguguggauucagacacugccaacuggaguuggccugauggggcagaauugccauuuaccaucgacaaauga

SEQ ID NO: 138086 - RNA, 1413 nt, Artificial Sequence; identical to SEQ ID NO: 138046
  derived and/or modified sequence opt3 from neuraminidase__InfluenzaA__ABV30132

SEQ ID NO: 138087 - RNA, 1413 nt, Artificial Sequence
  derived and/or modified sequence opt3 from neuraminidase__InfluenzaA__ABV30143
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcaaggggucauguaacccggucacuguugauggagccgacggcgugaaagguuucaguuacaaguaugggaauggcguauggaucggaaggacaaaauccaaccggcugcgcaagggcuuugagaugaucugggaccccaauggguggaccaacacugauagcgacuucucugugaagcaagaugucguggcuauuacagacuggucaggauacagugguagcuuuguucagcauccugaacucaccggcuuagauugcauacgaccauguuucuggguggagcuggucagagggcuucccagggaaaauacgaccaucuggacauccggaucuucgauuagcuucugcggcguggacuccgauacugccaacuggucauggccugacggugcagaguugccauuuaccaucgauaaauga

SEQ ID NO: 138088 - RNA, 1413 nt, Artificial Sequence; identical to SEQ ID NO: 138072
  derived and/or modified sequence opt3 from neuraminidase__InfluenzaA__ABV30154

SEQ ID NO: 138089 - RNA, 1413 nt, Artificial Sequence
  derived and/or modified sequence opt3 from neuraminidase__InfluenzaA__ABV30165
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaaccugagcuuguguaguauuuccggcugggcgaucuacaccaaagauaauucuaucaggauugguagcaagggggacguguucgucauacgggagccuuuuaucuccugcucacauuuagagugucgcacuuucuuucugacacaaggagcucuacucaacgauaaacacaguaauggcaccgugaaggaccgaagcccauaucgugcccugaugucuugcccgcuuggcgaagcacccuccccuuacaacucaaaguucgagagcguugccuggagugcuucugcaugucaugaugggaugggauggcugacgauugguaucuccggcccagacaauggggccguggcugucuugaaauauaacggaauaauuacugaaaccaucaagagcuggaaaaagagaauccucaggacacaggagucggagugcguguguguaaacggcucuugcuuuacuauuaugaccgauggucccuccaauggggccgcgucauacaaaaucuucaagauugaaaagggaaaaguuacaaagaguauagagcugaacgcaccuaauuuucacuaugaagaguguagcugcuacccagacaccggcacggugaugugugucugccgggauaacuggcacggcuccaaucgccccugggugucuuucaaccagaaucuggacuaccagaucggguauauuugcagcggaguguuuggugauaacccuagaccaaaagacggcaaggggucauguaauccggucacuguugauggagccgacggcgugaaagguuucaguuacaaguaugggaacggcguauggaucggaaggacaaaauccaaucggcuccgcaagggcuuugagaugaucugggaccccaacggguggaccgauacugacagcgauuucucugugaagcaagacgucguggcuauuacagauuggucaggauacagugguagcuuuguucagcauccugaauuaaccggccuggacugcauacgaccauguuucuggguggagcuugucagaggguugcccagggaaaauacgaccaucuggacauccggaucuucgauuagcuucugcggcguggauuccgacacugccaacuggucauggccugauggugcagagcugccauuuaccaucgacaaauga

SEQ ID NO: 138090 - RNA, 1413 nt, Artificial Sequence; identical to SEQ ID NO: 138046
  derived and/or modified sequence opt3 from neuraminidase__InfluenzaA__ABV30187

SEQ ID NO: 138091 - RNA, 1413 nt, Artificial Sequence; identical to SEQ ID NO: 138046
  derived and/or modified sequence opt3 from neuraminidase__InfluenzaA__ABV30198

SEQ ID NO: 138092 - RNA, 1410 nt, Artificial Sequence; identical to SEQ ID NO: 137900
  derived and/or modified sequence opt3 from neuraminidase__InfluenzaA__ABV30209

SEQ ID NO: 138093 - RNA, 1410 nt, Artificial Sequence; identical to SEQ ID NO: 138082
  derived and/or modified sequence opt3 from neuraminidase__InfluenzaA__ABV30220

SEQ ID NO: 138094 - RNA, 1410 nt, Artificial Sequence; identical to SEQ ID NO: 138082
  derived and/or modified sequence opt3 from neuraminidase__InfluenzaA__ABV30231

SEQ ID NO: 138095 - RNA, 1410 nt, Artificial Sequence
  derived and/or modified sequence opt3 from neuraminidase__InfluenzaA__ABV30264
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccgacuauaaucgagagaaacauuaccgaagugguauauuugacaaauaccacuaucgagaaggaaauuugccccaaauuagcugaguacaggaacuggagcaagccucagugugacaucacaggguucgcaccauuuuccaaagauaauucuauacggcugucggccggaggugacauuugggugacccgcgagcccuaugucucaugcgauccugacaaguguuaccaauucgcgcuaggccaggggacgacucucaacaaugugcauagcaacgauaccguucacgaccgaacaccauaucguacucugcuuaugaaugaacugggagugcccuuucauuugggcaccaagcaggucugcaucgcuuggaguuccucuagcugucacgaugguaaagccuggcuccaugugugcguaacaggggacgauaagaacgcaaccgccuccuucauuuacaauggaagacugguugacucaaucgugaguuggagcaaagagauccugaggacgcaggaaucugagugugucugcauuaacggcacuuguacaguggugaugaccgauggcuccgcuucagggaaggcagacacuaaaauacucuuuaucgaggaaggaaagauuguccacacaagcaccuuaagugguucugcccaacacguugaggaaugcuccugcuauccucgguacccaggcgugcgcuguguaugcagagauaauuggaaggggagcaacaggccgaucguggacauaaacauuaaagacuacucgaucgucucucgguauguguguuccggacugguuggcgauacgccccgcaagaaugacucaaguagcuccucucauugccuugauccuaacaaugaggaaggugggcacggagugaaaggcugggcuuucgacgauggcaacgacgucuggauggggcgaaccaucagcgagaagucaagaaguggauacgagacauuuaaagugauugaagguugguccaauccaaacagcaaguugcagaucaauaggcagguaauuguugaucggggcaaccguucuggguauucaggaauauucaguguggagggcaaaagcuguaucaaucgcugcuuuuacgucgaacugauuagagguaggaaggaggaaacugaggugcuauggaccuccaacucuaucgucguguucugugggacaucgggcacuuauggaaccggcagcuggcccgacggggccgauaucaaucucaugccuauuuga

SEQ ID NO: 138096 - RNA, 1410 nt, Artificial Sequence
  derived and/or modified sequence opt3 from neuraminidase__InfluenzaA__ABV30275
augaaccccaaucagaagaucauuaccauaggcagcgugucccugacaaucucuacuauuugcuucuuuaugcaaacggccauccucauuaccacagucacucuucacuucaaacaguacgaguuuaacucaaccccuaauaaccagguuaugcugugugaaccaacaaucauagagagaaauaucaccgaaauuguguauuugacuaacacaaccaucgagaaggaaauuugcccgaaauuagcugaguacaggaauuggaguaagccccagugugacaucacgggguucgcaccuuuuagcaaagauaacuccauacggcugucugccggaggugacauuuggguaacucgcgagccauaugugucgugcgaucccgacaaguguuaccaauucgcgcuaggccaggggaccacacucaauaacguccauucaaaugauacugugcgagaccguaccccuuauagaacacugcuuaugaacgaacugggaguuccauuucacuugggcaccaaacaggugugcaucgcuuggagcaguuccucuugucaugaugguaaggccuggcuccacgucugcauuacgggggacgauaagaaugcaacugccagcuucaucuacaacggaaggcugguggacuccaucguaucauggaguaaagagauucugcggacacaggaaagcgaguguguuugcauaaauggcaccuguacuguggucaugacagauggcucugcuuccgggaaggcagacaccaaaauccucuuuauugaggaaggaaagaucgugcauacgucaaccuuaagcgguagugcccaacacguggaggaaugcucuugcuauccccgcuacccuggcgucagauguguuugcagggauaacuggaagggguccaaccggccaauaguggacauuaauaucaaagaccacagcaucguaucgucuuacguguguuccggacuggucggcgauacaccgcgcaagaacgacucaaguagcuccucucauugccuugaucccaauaacgaggaaggugggcacggagugaaaggcugggcuuucgacgauggcaaugacguuuggauggggcgaacuauuagcgagaagucaagauugggauaugagaccuuuaaagugaucgaagguuggaguaacccuaaguccaaacugcagauuaauaggcaggucauaguggaucggggcaaccguagcggguacucuggaaucuucucaguagagggcaagaguuguauuaaucgcugcuuuuauguugaacuaaucagagguaggaaggaggaaacagaggugcucuggacuagcaacuccaucgucguguucugugggaccucuggcacauacggaaccggcucguggccagacggggccgauauuaaucugaugcccauauga

SEQ ID NO: 138097 - RNA, 1413 nt, Artificial Sequence; identical to SEQ ID NO: 138087
  derived and/or modified sequence opt3 from neuraminidase__InfluenzaA__ABV30297

SEQ ID NO: 138098 - RNA, 1413 nt, Artificial Sequence
  derived and/or modified sequence opt3 from neuraminidase__InfluenzaA__ABV30308
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcgugugucucaacggcuccugcuuuacuauuaugaccgauggucccucaaauggggccgcgaguuacaaaaucuucaagauugaaaagggaaaaguaacaaagagcauagagcugaacgcaccuaauuuucacuaugaagaguguuccugcuacccagacaccggcacgguuaugugugugugccgggauaacuggcacggcucuaaucgccccugggucagcuucaaccagaaucuggacuaccagaucggguauauuugcucaggaguguuuggugauaacccuagaccaaaagacggcaaggggaguuguaauccggugacugucgauggagccgacggcguuaaagguuucuccuacaaguaugggaacggcguguggaucggaaggacaaaaagcaaucggcuccgcaagggcuuugagaugaucugggaccccaacggguggaccgauacugacucugauuucucaguaaagcaagacguggucgcuauuacagauuggaguggauacagcgguuccuuugugcagcauccugaauuaaccggccuggacugcauacgaccauguuucuggguugagcuugugagaggguugcccagggaaaauacgaccaucuggacaucuggaucgagcauuuccuucugcggcgucgauucagacacugccaacuggaguuggccugauggugcagagcugccauuuaccaucgacaaauga

SEQ ID NO: 138099 - RNA, 1413 nt, Artificial Sequence
  derived and/or modified sequence opt3 from neuraminidase__InfluenzaA__ABV30319
augaaccccaaucagaagaucauuaccauaggcagcaucuccauugccaucgggauuaucucucugaugcuccaaauaggaaacaucgugucaauuugggcuagucacagcauccagacagguucccagaaucauacuggcauuugcaaccagagaaucauaacguacgaaaauucuaccugggucaaccacacauauguuucgauuaauaacacuaaugugguagcagggaaagacaagaccucagugacacuugccggaaacagcagucuguguuccaucucuggcugggcgauuuacaccaaagauaauagcaucaggaucgguuccaagggggacgucuucgugauucgggagccuuuuauaucaugcagucauuuggagugucgcacuuucuuuuuaacacaaggagcucugcuaaacgauaaacacagcaauggcaccguuaaggaccgaucuccauaucgugcccucauguccugcccgcugggcgaagcacccucaccuuacaacagcaaguucgagaguguggccuggucugcuuccgcaugucaugaugggaugggauggcuuacgaucgguauuagcggcccagacaauggggccgucgcugugcugaaauauaacggaaucauaacugaaaccauuaagucguggaaaaagagaaucuugaggacacaggagucugagugcguauguguuaacggcuccugcuuuacuaucaugaccgauggucccucaaauggggccgcgaguuacaaaauuuucaagaucgaaaagggaaaagugacaaagagcauugagcucaacgcaccuaauuuucacuaugaagaguguuccugcuacccagacaccggcacggucaugugugugugccgggauaacuggcacggcucuaaucgccccugggugagcuucaaccagaaucuggacuaccagauaggguauaucugcucaggagucuuuggugauaacccuagaccaaaagacggcaaggggaguuguaauccgguuacuguggauggagccgacggcguaaaagguuucuccuacaaguaugggaacggcguguggauuggaaggacaaaaagcaaucggcugcgcaagggcuuugagaugaucugggaccccaacggguggaccgauacugacucugauuucucagucaagcaagacgugguugcuaucacagauuggaguggauacagcgguuccuuugugcagcauccugaacucaccggcuuagacugcauucgaccauguuucugggucgagcuggugagagggcuucccagggaaaauacgaccauauggacaucuggaucgagcaucuccuucugcggcguagauucagacacugccaacuggaguuggccugauggugcagaguugccauuuaccauugacaaauga

SEQ ID NO: 138100 - RNA, 1413 nt, Artificial Sequence; identical to SEQ ID NO: 138087
  derived and/or modified sequence opt3 from neuraminidase__InfluenzaA__ABV30330

SEQ ID NO: 138101 - RNA, 1413 nt, Artificial Sequence; identical to SEQ ID NO: 138046
  derived and/or modified sequence opt3 from neuraminidase__InfluenzaA__ABV30341

SEQ ID NO: 138102 - RNA, 1413 nt, Artificial Sequence; identical to SEQ ID NO: 138046
  derived and/or modified sequence opt3 from neuraminidase__InfluenzaA__ABV30363

SEQ ID NO: 138103 - RNA, 1413 nt, Artificial Sequence; identical to SEQ ID NO: 138046
  derived and/or modified sequence opt3 from neuraminidase__InfluenzaA__ABV30374

SEQ ID NO: 138104 - RNA, 1410 nt, Artificial Sequence
  derived and/or modified sequence opt3 from neuraminidase__InfluenzaA__ABV30385
augaaccccaaucagaagaucauuaccauaggcagcgugucccugacaaucucuacuauuugcuucuuuaugcagaucgccauucucaucacgaccgucacacuucacuucaaacaguacgaguuuucaccuccaccgaacaaucagguuaugcugugugaacccacuauaaucgagagaaacauuaccgaaaucguguauuugacaaauaccacuauugagaaggaaaucugcccuaaauuagcugaguacaggaacuggaguaagccacagugugacauaacaggguucgcacccuuuagcaaagauaauuccauucggcugucugccggaggugacaucuggguaacccgcgagccuuaugugucgugcgauccagacaaguguuaccaauucgcgcuaggccaggggacgacucucaacaauguccauucaaacgauaccgugcacgaccgaacacccuaucguacucugcuuaugaaugaacugggaguuccuuuucauuugggcaccaaacaggugugcauugcuuggagcaguuccucuugucacgaugguaaggccuggcuccaugucugcgugacaggggacgauaagaacgcaaccgccagcuucaucuacaauggaagacugguagacuccaucguuucauggaguaaagagauucugaggacgcaggaaagcgagugugugugcauaaacggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccacgguacccgggcguucgcugugugugcagagauaauuggaagggguccaacaggcccauaguagacauuaacaucaaagacuacagcaucgugucgcgguaugucuguucuggacuggugggcgauacgccucgcaagaaugacuccucaaguagcucccauugccuugauccaaacaaugaggaaggugggcacggaguuaaaggcugggcuuucgacgauggcaacgacguguggauggggcgaaccauuucugaaaagagcagaucaggauacgagacauuuaaagucaucgaggguuggaguaaucccaacuccaaguugcagauuaauaggcaagugauaguagaucggggcaaccguagcggguauucuggaaucuucucaguugagggcaaaaguuguauuaaucgcugcuuuuacguggaacugaucagagguaggaaggaggaaacugagguccuauggaccagcaacuccaucguggucuucugugggacaucuggcacuuauggaaccggcucguggccugacggggccgauauuaaucucaugccaauauga

SEQ ID NO: 138105 - RNA, 1410 nt, Artificial Sequence
  derived and/or modified sequence opt3 from neuraminidase__InfluenzaA__ABV30396
augaaccccaaucagaagaucauuaccauaggcagcgugucccugacaaucucuacuauuugcuucuuuaugcaaaucgccauucucaucacgaccgucacacuucacuucaaacaguacgaguuuaacucaaguccuaauaaccagguuaugcugugugaaccaacuauaaucgagagaaauauuaccgaaaucguguauuugacaaacaccacuauugagaaggaaaucugcccgaaauuaagcgaguacaggaauugguccaagccccaguguaacauaacaggguucgcuccuuuuucuaaagacaauucgauucggcugucagcaggaggugauaucuggguaacccgcgagccauaugugagcugcgaccccgauaaguguuaccaauucgcccuaggccaggggacgacucucaacaauguccauaguaacgacaccgugcacgaucgaacaccuuaucguacucugcuuaugaaugaacugggaguuccauuucauuugggcaccaaacaggugugcauugcgugguccucuagcuccugucacgacgguaaggcuuggcuccaugucugcgugacaggggaugacaagaacgccaccgcaucauucaucuacaauggaagacugguagauaguaucguuagcuggucuaaagagauucugaggacgcaggaauccgagugugugugcauaaacggcacuuguacagucgugaugaccgacggcucagccagcgggaaggcugauacuaaaauccucuuuauugaggaaggaaagaucgugcacacaaguaccuuaucugguuccgcacaacacgucgaggaaugcagcugcuauccccgguacccuggcguucgcugugugugcagagacaacuggaaggggucgaauaggccaauaguagauauuaacaucaaagacuacucuaucguguccucauaugucuguaguggacuggugggcgacacgccgcggaagaaugauagcuccucuagcucacauugccuugaccccaacaaugaggaaggugggcacggaguuaaaggcugggccuucgaugacggcaacgauguguggauggggcgcaccauuagugagaaguugcgauccggauacgagacauuuaaagucaucgaagguuggagcaauccuaacucuaagcugcagauuaauagacaggugauaguagacaggggcaaccggucaggguauaguggaaucuucagcguugagggcaaauccuguauuaaucguugcuuuuacguggaacuaauccgcgguagaaaggaggaaaacgagguccucuggacuucuaauucgaucguggucuucugugggaccagcggcacauauggaacuggcuccuggccagauggggcugacauuaaccugaugcccauauga

SEQ ID NO: 138106 - RNA, 1410 nt, Artificial Sequence
  derived and/or modified sequence opt3 from neuraminidase__InfluenzaA__ABV30407
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaagggguccaaccggccgauuguggacaucaauaucaaagaccacagcauuguaucgucuuacguguguuccggacuggucggcgauacgccccgcaagaacgacucaaguagcuccggucauugccuugauccuaauaacgaggaagggggacacggcgugaaaggcugggcuuucgacgaugggaaugacguuuggaugggacgaaccaucucugaaaagagcagauuggguuaugagacauuuaaagugauugagggcuggucaaacccaaagaguaaacugcagauaaauaggcaggucaucguggaucgggggaaccguuccggauacagcggcauuuucucuguagaggguaagucauguaucaaucgcugcuuuuauguugaacuaaucagagggaggaaggaggaaacugaggugcucuggaccaguaacagcauugucguguucuguggcacauccggaacuuacggcaccgggucuuggcccgacggagccgauauaaaucugaugccuaucuga

SEQ ID NO: 138107 - RNA, 1410 nt, Artificial Sequence
  derived and/or modified sequence opt3 from neuraminidase__InfluenzaA__ABV30418
augaaccccaaucagaagaucauuaccauaggcagcgugucccugacaaucucuacuauuugcuucuuuaugcagaucgccauucucaucacgaccgucacacuucacuucaaacaguacgaguuuucaagucugccuaacaaucagguuauguugugugaaccaacuauaaucgagagaaacauuaccgaaaucguguauuuaacaaauaccacuauugagaaggaaaucugcccgaaacuggcugaguacaggaacuggagcaagccccagugugacauaacaggguucgcaccuuuuuccaaagauaauucuauucggcuaucggccggaggugacaucuggguaacccgcgagccauaugugucaugcgaucccgacaaguguuaccaauucgcgcucggccaggggacgacucugaacaauguccauagcaacgauaccgugcacgaccgaacaccuuaucguacucuucugaugaaugaauugggaguuccauuucaucucggcaccaaacaggugugcauugcuuggaguuccucuagcugucacgaugguaaggccuggcugcaugucugcgugacaggggacgauaagaacgcaaccgccuccuucaucuacaauggaagacugguagacucaaucguuaguuggagcaaagagauucucaggacgcaggaaucugagugugugugcauaaacggcacuuguacagucgugaugaccgauggcuccgcuucagggaaggcagacacuaaaaucuuauuuauugaggaaggaaagaucgugcacacaagcacccugagugguucugcccaacacgucgaggaaugcuccugcuauccccgguacccuggcguucgcugugugugcagagauaauuggaaggggagcaacaggccaauaguagacauuaacaucaaagacuacucgaucgugucucgguaugucuguuccggacuugugggcgauacgccgcgcaagaaugacucaaguagcuccucucauugcuuggaucccaacaaugaggaaggugggcacggaguuaaaggcugggcuuucgacgauggcaacgacguguggauggggcgaaccauuagcgagaagucaagaaguggauacgagacauuuaaagucaucgaagguugguccaauccuaacagcaagcugcagauuaauaggcaagugauaguagaucggggcaaccguucuggguauucaggaaucuucaguguugagggcaaaagcuguauuaaucgcugcuuuuacguggaacuaaucagagguaggcgggaggaaacugagguccucuggaccuccaacucuaucguggucuucugugggacaucgggcacuuauggaaccggcagcuggccagacggggccgauauuaaucugaugcccauauga

SEQ ID NO: 138108 - RNA, 1410 nt, Artificial Sequence; identical to SEQ ID NO: 138073
  derived and/or modified sequence opt3 from neuraminidase__InfluenzaA__ABV30429

SEQ ID NO: 138109 - RNA, 1410 nt, Artificial Sequence; identical to SEQ ID NO: 138073
  derived and/or modified sequence opt3 from neuraminidase__InfluenzaA__ABV30440

SEQ ID NO: 138110 - RNA, 1410 nt, Artificial Sequence; identical to SEQ ID NO: 138073
  derived and/or modified sequence opt3 from neuraminidase__InfluenzaA__ABV30451

SEQ ID NO: 138111 - RNA, 1413 nt, Artificial Sequence; identical to SEQ ID NO: 138046
  derived and/or modified sequence opt3 from neuraminidase__InfluenzaA__ABV30462

SEQ ID NO: 138112 - RNA, 1410 nt, Artificial Sequence; identical to SEQ ID NO: 138073
  derived and/or modified sequence opt3 from neuraminidase__InfluenzaA__ABV30473

SEQ ID NO: 138113 - RNA, 1410 nt, Artificial Sequence
  derived and/or modified sequence opt3 from neuraminidase__InfluenzaA__ABV30484
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgcgguaugucuguucuggacuggugggcgauacgccccgcaagaacgacuccucaaguaauagccauugccuugauccuaacaaugaggaaggugggcacggaguuaaaggcugggcuuucgacgauggcaacgacguguggauggggcgaaccauuuccgagaagucuagaagcggauacgagacauuuaaagucaucgaagguuggucaaauccaaacaguaaguugcagauuaauaggcaagugauaguagaucggggcaaccguuccggguauagcggaaucuucucuguugagggcaaaucauguauuaaucgcugcuuuuacguggaacugaucagagguaggaaggaggaaacugagguccuauggaccaguaacagcaucguggucuucugugggacauccggcacuuauggaaccggcucuuggcccgacggggccgauauuaaucucaugccuauauga

SEQ ID NO: 138114 - RNA, 1413 nt, Artificial Sequence; identical to SEQ ID NO: 138085
  derived and/or modified sequence opt3 from neuraminidase__InfluenzaA__ABV30495

SEQ ID NO: 138115 - RNA, 1413 nt, Artificial Sequence; identical to SEQ ID NO: 138046
  derived and/or modified sequence opt3 from neuraminidase__InfluenzaA__ABV30506

SEQ ID NO: 138116 - RNA, 1410 nt, Artificial Sequence; identical to SEQ ID NO: 138082
  derived and/or modified sequence opt3 from neuraminidase__InfluenzaA__ABV30517

SEQ ID NO: 138117 - RNA, 1413 nt, Artificial Sequence
  derived and/or modified sequence opt3 from neuraminidase__InfluenzaA__ABV30528
augaacagcaaucagaagaucauuaccauaggcuccaucucuauugccaucgggauuaucucacugaugcuccaaauaggaaacaucauuaguaugugggcuagccacuccauccagacagguucucagaaucauacuggcauuugcaaccagagaaucauaacguacgaaaauucgaccugggugaaccacacauaugucaauauuaacaauacuaacguuguggcagggaaagacaagaccucaguaacacuugccggaaauagcagucuguguuccaucucuggcugggcgauuuacaccaaagauaacagcaucaggaucgguuccaagggggacguguucgucauucgggagcccuuuauaucaugcagucauuuggagugucgcacuuucuuuuuaacacaaggagcucugcuaaaugauaaacacagcaacggcaccgugaaggaccgaucuccuuaucgugcccucauguccugcccacugggcgaagcaccgucacccuacaauagcaaguucgagaguguugccuggucugcuuccgcaugucaugaugggaugggauggcuuacgaucgguauuagcggcccugacaacggggccguggcuguccugaaauauaacggaaucauaacugaaaccauuaagucguggaaaaagagaaucuugaggacacaggagucugagugcguguguguaaauggcuccugcuuuacuaucaugaccgaugguccaucaaacggggccgcgaguuacaaaauuuucaagaucgaaaagggaaaaguuacaaagagcauugagcucaaugcacccaacuuucacuaugaagaguguuccugcuacccugacaccggcacggugaugugugucugccgggauaauuggcacggcucuaaccgcccaugggugagcuucaaucagaaccuggacuaccaggugggguauauaugcucaggagucuuuggugauaaucccagaccuaaagacggcaaggggaguuguaacccaaugacuguugauggagccgacggcgugaaagguuucuccuacaaguaugggaauggcguauggaucggaaggacaaaaagcaacaagcugcggaagggcuuugagaugauuugggacccgaauggguggaccgauacugacucugauuucucagugaaacaagacgucguggcuaucacagauuggaguggauacagcgguuccuuuguucagcaucccgaacucaccggcuuagacugcauccgcccuuguuucuggguggagcugguccgagggcuuccaagagaaaacgccacgauuuggaccucuggaucgagcauauccuucugcggcguggauucagacacagcaaauuggaguuggcccgauggugcugaguugccuuuuacuaucgacaaguga

SEQ ID NO: 138118 - RNA, 1413 nt, Artificial Sequence; identical to SEQ ID NO: 138046
  derived and/or modified sequence opt3 from neuraminidase__InfluenzaA__ABV30539

SEQ ID NO: 138119 - RNA, 1413 nt, Artificial Sequence; identical to SEQ ID NO: 138046
  derived and/or modified sequence opt3 from neuraminidase__InfluenzaA__ABV30561

SEQ ID NO: 138120 - RNA, 1413 nt, Artificial Sequence; identical to SEQ ID NO: 138046
  derived and/or modified sequence opt3 from neuraminidase__InfluenzaA__ABV30572

SEQ ID NO: 138121 - RNA, 1413 nt, Artificial Sequence; identical to SEQ ID NO: 138046
  derived and/or modified sequence opt3 from neuraminidase__InfluenzaA__ABV30583

SEQ ID NO: 138122 - RNA, 1413 nt, Artificial Sequence; identical to SEQ ID NO: 138046
  derived and/or modified sequence opt3 from neuraminidase__InfluenzaA__ABV30594

SEQ ID NO: 138123 - RNA, 1413 nt, Artificial Sequence
  derived and/or modified sequence opt3 from neuraminidase__InfluenzaA__ABV30605
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguugugguagggaaagacaagaccucagugacacuugcaggaaacagcagucuguguuccauuucuggcugggccaucuacaccaaagauaauagcaucaggauugguuccaagggggacgucuucgugauacgggagccuuuuaucucaugcagucauuuggagugucgcacuuucuuuuuaacacaaggagcgcugcuaaacgauaaacacagcaauggcaccguuaaggaccgaucuccauaucgugcucucauguccugcccgcugggcgaagcccccucaccuuacaacagcaaguucgagaguguggcauggucugccuccgcuugucaugaugggaugggauggcuuacgauugguaucagcggcccagacaauggggcagucgccgugcugaaauauaacggaauaauuacugaaaccaucaagucguggaaaaagagaaucuugaggacacaggagucugagugcguauguguuaacggcuccugcuuuacuauuaugaccgauggucccucaaauggggcugccaguuacaaaaucuucaagauugaaaagggaaaagugacaaagagcauagagcucaacgcgccuaauuuucacuaugaagaguguuccugcuacccagacaccggcacggucaugugugugugccgggauaacuggcacggcucuaaucgccccugggugagcuucaaccagaaucuggacuaccagaucggguauauuugcucaggagucuuuggugauaacccuagaccaaaagacggcaaggggaguuguaauccgguuacuguggauggagcagacggcguaaaagguuucuccuacaaguaugggaacggcguguggaucggaaggacaaaaagcaaucggcugcgcaagggcuuugagaugaucugggaccccaacggguggaccgauacugacucugauuucucagucaagcaagacgugguugccauuacagauuggaguggauacagcgguuccuuugugcagcauccugaacucaccggcuuagacugcauacgaccauguuucugggucgagcuggugagagggcuucccagggaaaauacgaccaucuggacaucuggaucgagcauuuccuucugcggcguagauucagacacugcuaacuggaguuggccugauggugccgaguugccauuuaccaucgacaaauga

SEQ ID NO: 138124 - RNA, 1413 nt, Artificial Sequence; identical to SEQ ID NO: 138046
  derived and/or modified sequence opt3 from neuraminidase__InfluenzaA__ABV30616

SEQ ID NO: 138125 - RNA, 1413 nt, Artificial Sequence; identical to SEQ ID NO: 138046
  derived and/or modified sequence opt3 from neuraminidase__InfluenzaA__ABV30627

SEQ ID NO: 138126 - RNA, 1410 nt, Artificial Sequence
  derived and/or modified sequence opt3 from neuraminidase__InfluenzaA__ABV30649
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaacgcagacacuaagauucucuuuaucgaggaaggaaaaauagugcauacaucaaccuuaagcgguagugcccaacacguggaggaaugcucuugcuauccucgcuacccaggcgucagauguguuugcagggauaacuggaagggguccaaucggccgauuguggacaucaacaucaaggaccacagcauuguaucgucuuacguguguuccggacuggucggcgauacgccccgcaaaaaugacucaaguagcuccucucauugccuugauccuaacaaugaggaaggugggcacggagugaagggcugggcuuucgacgauggcaacgacguuuggauggggcgaaccaucagcgagaaaucaagauugggauaugagacauuuaaggugauugaagguuggaguaauccaaaauccaagcugcagauaaacaggcaggucaucguggaucggggcaaucguagcggguacucuggaauuuucucaguagagggcaaaaguuguaucaaccgcugcuuuuauguugaacuaaucagagguaggaaggaggaaacugaggugcucuggaccagcaauuccauugucguguucugugggacaucuggcacuuacggaaccggcucguggcccgacggggccgauauaaaccugaugccuaucuga

SEQ ID NO: 138127 - RNA, 1410 nt, Artificial Sequence; identical to SEQ ID NO: 137900
  derived and/or modified sequence opt3 from neuraminidase__InfluenzaA__ABV30660

SEQ ID NO: 138128 - RNA, 1413 nt, Artificial Sequence
  derived and/or modified sequence opt3 from neuraminidase__InfluenzaA__ABV45852
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccaacaauggggccgcguccuacaaaaucuucaagauugaaaagggaaaaguuacaaagucaauagagcucaacgcaccuaauuuucacuaugaagaguguaguugcuacccagacaccggcacggugaugugugucugccgggauaacuggcacggcagcaaucgccccuggguguccuucaaccagaaucuggacuaccagaucggguauauuugcucuggaguguuuggugauaacccuagaccaaaagacggcgaggggagcuguaauccggucacuguugauggagccgacggcgugaaggguuucucauacaaauaugggaacggcguauggaucggaaggacaaagaguaaucggcugcgcaaaggcuuugaaaugaucugggaccccaacggguggaccgauacugacuccaauuucagcgugaagcaagaugucguggcuauuacagacuggucuggauacucagguaguuuuguucagcauccugagcucaccggcuuagauugcauacgaccauguuucuggguggaacuggucagagggcuucccagggagaacacgaccaucuggacaagcggauccucuauuucguucugcggcgugaacagcgacacugccaauugguccuggccugauggugcagaauugccauuuaccaucgacaaguga

SEQ ID NO: 138129 - RNA, 1410 nt, Artificial Sequence; identical to SEQ ID NO: 137900
  derived and/or modified sequence opt3 from neuraminidase__InfluenzaA__ABV45863

SEQ ID NO: 138130 - RNA, 1413 nt, Artificial Sequence
  derived and/or modified sequence opt3 from neuraminidase__InfluenzaA__ABV45874
augaaccccaaucagaagaucauuaccauaggcagcaucuccauugccaucgggauuaucucucugaugcuccaaauaggaaacaucauuucaaucugggcuaguuacagcauucagacagguucccagaaucacacuggcaucugcaaccagagaauaauuacguaugaaaauucuaccugggugaaccauacauacgucucgaucaauaacacuaauguuguggcagggaaagacaagaccucaguaacacuugccggaaacagcagucuguguuccauuucuggcugggcgaucuauaccaaagauaauagcaucaggauugguuccaagggggacguguucgucauacgggagccuuuuaucucaugcagucacuuggagugucgcacuuucuuuuuaacacaaggagcucugcuaaacgauaaacauagcaauggcaccgugaaggaccgaucuccauaccgugcccucauguccugcccgcugggcgaagcacccucaccuuauaacagcaaguucgagaguguugccuggucugcuuccgcaugucacgaugggaugggauggcuuacgauugguaucagcggcccagacaauggggccguggcuguccugaaauacaacggaauaauuacugaaaccaucaagucguggaaaaagagaaucuugaggacacaggagucugagugcguguguguaaacggcuccugcuuuacuauuaugaccgauggucccucaaauggggccgcgaguuauaaaaucuucaagauugaaaagggaaaaguuacaaagagcauagagcucaacgcaccuaauuuucauuacgaagaguguuccugcuacccagacaccggcacggugaugugugucugccgggauaacuggcacggcucuaaucgccccugggugagcuucaaccagaaucuggacuaucagaucggguacauuugcucaggaguguuuggugauaacccuagaccaaaagacggcaaggggaguuguaauccggucacuguugauggagccgacggcgugaaagguuucuccuauaaguacgggaacggcguauggaucggaaggacaaaaagcaaucggcugcgcaagggcuuugagaugaucugggaccccaacggguggaccgauacugacucugauuucucagugaagcaagacgucguggcuauuacagauuggaguggauauagcgguuccuuuguucagcacccugaacucaccggcuuagacugcauacgaccauguuucuggguggagcuggucagagggcuucccagggaaaauacgaccaucuggacaucuggaucgagcauuuccuucugcggcguggauucagacacugccaacuggaguuggccugauggugcagaguugccauuuaccaucgacaaauga

SEQ ID NO: 138131 - RNA, 1413 nt, Artificial Sequence; identical to SEQ ID NO: 138046
  derived and/or modified sequence opt3 from neuraminidase__InfluenzaA__ABV45885

SEQ ID NO: 138132 - RNA, 1413 nt, Artificial Sequence; identical to SEQ ID NO: 138059
  derived and/or modified sequence opt3 from neuraminidase__InfluenzaA__ABV45896

SEQ ID NO: 138133 - RNA, 1413 nt, Artificial Sequence; identical to SEQ ID NO: 138046
  derived and/or modified sequence opt3 from neuraminidase__InfluenzaA__ABV45918

SEQ ID NO: 138134 - RNA, 1413 nt, Artificial Sequence
  derived and/or modified sequence opt3 from neuraminidase__InfluenzaA__ABV45929
augaaccccaaucagaagaucauuaccauaggcagcaucuccauugccaucgggauuaucucucugaugcuccaaauaggaaacaucauuucaaugugggcuagucacagcauccagacagguucccagaaucauacuggcauuugcaaccagagaaucauaacguacgaaaauucuaccugggugaaccacacauaugucaauauuaacaauacuaacguugugaccgggaaagacaagacaucgguaacccuugcaggaaauucaagccuguguaguaucuccggcugggccauuuacacuaaagauaacucuaucaggaucgguagcaagggggacguguucgucauucgggagccuuuuauauccugcucacauuuggagugucgcacauucuuuuuaacccaaggagcgcugcuaaaugauaaacacaguaacggcacggugaaggaccgaagcccauaucgugcucucaugucuugcccgcugggcgaagcccccuccccuuacaauucaaaguucgagagcguugcauggagugccucugcuugucaugaugggaugggauggcuuacuaucgguauuuccggcccagacaacggggcaguggccguccugaaauauaacggaaucauaaccgaaacaauuaagagcuggaaaaagagaaucuugaggacucaggagucggagugcguguguguaaauggcucuugcuuuaccaucaugacagauggucccuccgacggggcugccucauacaaaauuuucaagaucgaaaagggaaaaguuaccaagaguauugagcucaacgcgccuaauuuucacuaugaagaguguagcugcuacccagauacgggcacugugaugugugucugccgggacaacuggcacggcuccaaucgccccugggugucuuucaaccagaaucuggauuaccagauaggguauaucugcagcggaguguuuggugacaacccuagaccaaaagauggcaaggggucauguaauccggucacaguugacggagcagacggcgugaaagguuucaguuacaaguaugggaacggcguauggauuggaaggaccaaauccaauaagcugcggaagggcuuugagaugaucugggaucccaacggguggacugacacagauaaugacuucagcgugaaacaagaugucguggccaucaccgacuggucuggauacucagguaguuuuguucagcauccugaacucacgggcuuagauugcauucgcccauguuucuggguggagcugguccgagggcuucccagagaaaacgcuaccauauggacaagcggauccucuaucucguucugcggcguggacagcgauacugccaauugguccuggccugacggugcagaguugccauuuaccauugauaaguga

SEQ ID NO: 138135 - RNA, 1413 nt, Artificial Sequence
  derived and/or modified sequence opt3 from neuraminidase__InfluenzaA__ABV45940
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuagguacgaaaauucuacgugggugaaccacaccuaugucaauaucaacaauacaaacguuguggcagggaaagacaagacuucgguaacccuugccggaaauucaagccuguguaguauuuccggcugggcgaucuacacaaaagauaacucuauccggauugguagcaagggggacguguucgucauacgcgagccuuuuaucuccugcucacauuuggagugucgaaccuucuuuuuaacucaaggagcucugcuaaaugauaaacacaguaacggcacagugaaggaccguagcccauauagagcccucaugucuugcccgcugggcgaagcacccuccccuuacaauucaaaguucgagagcguugccuggagugcuucugcaugucaugaugggaugggauggcuuaccauugguaucuccggcccagacaacggggccguggcuguccugaaauauaacggaauaauuacggaaacuaucaagagcuggaaaaagcagaucuugaggacccaggagucggagugcguguguguaaauggcucuugcuuuacaauuaugacugauggucccuccaacggggccgcgucauacaaaaucuucaagauugaaaagggaaaaguuaccaagaguauagagcucaaugcaccuaacuuucacuaugaagaguguagcugcuacccagacacaggcaccgugaugugugucugccgggauaauuggcacggcuccaaccgccccugggugucuuucaaucagagccuggacuaccaagugggguauaucugcucaggagucuuuggugauaacccuagaccaaaagacggcaaggggaguuguaauccgaugacgguugauggagccgacggcgugaaagguuucuccuacaaguaugggaacggcguauggauuggaaggacuaaaagcaauaagcugcggaagggcuuugagaugaucugggaccccaacggguggacagauaccgacucugauuucucagugaaacaggacgucguggcuaucacugauuggaguggauacagcgguuccuuuguucagcauccugaacucacaggcuuagacugcauucgcccauguuucuggguggagcugguccgagggcuucccagagaaaauaccacgauauggaccucuggaucgagcaucuccuucugcggcguggauucagacacagccaacuggaguuggccugauggugcagaguugccauuuacuauugacaaguga

SEQ ID NO: 138136 - RNA, 1413 nt, Artificial Sequence; identical to SEQ ID NO: 138072
  derived and/or modified sequence opt3 from neuraminidase__InfluenzaA__ABV45951

SEQ ID NO: 138137 - RNA, 1410 nt, Artificial Sequence
  derived and/or modified sequence opt3 from neuraminidase__InfluenzaA__ABV45973
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccggggaggcagacacuaagauucucuuuaucgaagagggaaaaauagugcauacaucaaccuuaagcgguagugcccaacacguggaagagugcucuugcuauccucgcuacccaggcgucagauguguuugcagggauaacuggaagggguccaaccggccgauuguggacaucaauaucaaggaccacagcauuguaucgucuuacguguguuccggacuggucggcgauacgccccgcaaaaacgacucaaguagcuccucucauugccuugauccuaauaacgaagagggugggcacggagugaagggcugggcuuucgacgauggcaaugacguuuggauggggcgaaccaucagcgagaaaucaagauugggauaugaaacauuuaaggugauugaggguuggaguaacccaaaauccaagcugcagauaaauaggcaggucaucguggaucggggcaaccguagcggguacucuggaauuuucucaguagaaggcaaaaguuguaucaaucgcugcuuuuauguugagcuaaucagagguaggaaggaagagacugacgugcucuggaccagcaacuccauugucguguucugugggacaucuggcacuuacggaaccggcucguggcccgauggggccgacauaaaucugaugccuaucuga

SEQ ID NO: 138138 - RNA, 1410 nt, Artificial Sequence
  derived and/or modified sequence opt3 from neuraminidase__InfluenzaA__ABV45984
augaaccccaaucagaagaucauuaccauaggcagcgugucccugacaaucucuacuauuugcuucuuuaugcagaucgccauucucgucacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaaugauaccguucgagaccguacaccauauagaacucugcuuaugaacgaacugggagugcccuuucacuugggcaccaagcaggucugcaucgcuuggagcaguuccucuugucaugaugguaaagccuggcuccacgugugcauuacaggggacgauaagaaugcaaccgccagcuucaucuacaacggaaggcugguagacuccaucguuucauggaguaaagagauucugcggacgcaggaaagcgagugugugugcauaaauggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaacuggaagggguccaaccggccgauaguagacauuaauaucaaagaccacagcaucgugucgucuuacgucuguuccggacuggugggcgauacgccccgcaagaacgacucaaguagcuccucucauugccuugauccuaauaacgaggaaggugggcacggaguuaaaggcugggcuuucgacgauggcaaugacguguggauggggcgaaccauuagcgagaagucaagauugggauaugagacauuuaaagucaucgaagguuggaguaacccaaaguccaaacugcagauuaauaggcaagugauaguagaucggggcaaccguagcggguacucuggaaucuucucaguugagggcaagaguuguauuaaucgcugcuuuuauguggaacuaaucagagguaggaaggaggaaacugagguccucuggaccagcaacuccaucguggucuucugugggacaucuggcacuuacggaaccggcucguggcccgacggggccgauauuaaucugaugccuauauga

SEQ ID NO: 138139 - RNA, 1410 nt, Artificial Sequence; identical to SEQ ID NO: 137900
  derived and/or modified sequence opt3 from neuraminidase__InfluenzaA__ABV45995

SEQ ID NO: 138140 - RNA, 1413 nt, Artificial Sequence; identical to SEQ ID NO: 138059
  derived and/or modified sequence opt3 from neuraminidase__InfluenzaA__ABV82554

SEQ ID NO: 138141 - RNA, 1410 nt, Artificial Sequence; identical to SEQ ID NO: 138082
  derived and/or modified sequence opt3 from neuraminidase__InfluenzaA__ABV82565

SEQ ID NO: 138142 - RNA, 1410 nt, Artificial Sequence; identical to SEQ ID NO: 138082
  derived and/or modified sequence opt3 from neuraminidase__InfluenzaA__ABW36171

SEQ ID NO: 138143 - RNA, 1413 nt, Artificial Sequence; identical to SEQ ID NO: 138098
  derived and/or modified sequence opt3 from neuraminidase__InfluenzaA__ABW36193

SEQ ID NO: 138144 - RNA, 1413 nt, Artificial Sequence; identical to SEQ ID NO: 138046
  derived and/or modified sequence opt3 from neuraminidase__InfluenzaA__ABW36204

SEQ ID NO: 138145 - RNA, 1413 nt, Artificial Sequence
  derived and/or modified sequence opt3 from neuraminidase__InfluenzaA__ABW36215
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaaaggauggcuuacgauugguaucuccggcccagacaacggggccguggcuguccugaaguauaacggaauaauuacugaaaccaucaaaagcuggaauaagcagaucuugagaacacaggagucggagugcguguguguaaacggcucuugcuuuacuauuaugaccgauggucccuccaauggggccgcgucauacaaaaucuucaagauugaaaagggaaaaguuacaaagaguauagagcucaacgcaccuaauuuucacuaugaagaguguagcugcuacccagacaccggcacggugaugugugucugcagggauaacuggcacggcuccaaucggcccugggugucuuucaaccagaaucuggacuaccaaaucggguauauuugcagcggaguguuuggugauaacccucgcccaaaagacggcagagggucauguaauccggucacuguugauggagccgacggcgugaaggguuucaguuacaaauaugggaacggcguauggaucggaaggacaaaguccaaucggcugcgcaaaggcuuugagaugaucugggaccccaacggguggaccgauacugacagccauuucucugugaagcaggaugucguggcuauuacagacuggucaggauacagugguagcuuuguucagcacccugaacucaccggcuuagauugcauaaagccauguuucuggguggagcugguccgagggcuucccagagaaaauacgaccaucuggacauccggaucuucgauuagcuucugcggcguggacuccgauacugccaacuggucauggccugacggugcagaguugccauuuaucauugauaaauga

SEQ ID NO: 138146 - RNA, 1413 nt, Artificial Sequence; identical to SEQ ID NO: 138046
  derived and/or modified sequence opt3 from neuraminidase__InfluenzaA__ABW36226

SEQ ID NO: 138147 - RNA, 1413 nt, Artificial Sequence
  derived and/or modified sequence opt3 from neuraminidase__InfluenzaA__ABW36237
augaaccccaaucagaagaucauuaccauaggcagcaucuccauuacaaucgggauuaucucucugaugcuccaaauaggaaacaucauuucaaucugggccagucacagcauucagacugguucccagaaucauacgggcaucugcaaccagagaauaauuaccuacgaaaauucuacaugggugaaccacacuuaugucaauaucaacaauaccaacguuguggcugggaaagacaagacaucgguaacccuugcaggaaauucaagccuguguaguauuuccggcugggccaucuacacuaaagauaacucuaucaggauugguagcaagggggacguguucgucauacgggagccuuuuaucuccugcucacauuuggagugucgcacauucuuuuuaacccaaggagcgcugcuaaaugauaaacacaguaacggcacggugaaggaccgaagcccauaucgugcucucaugucuugcccgcugggcgaagcccccuccccuuacaauucaaaguucgagagcguugcauggagugccucugcuugucaugaugggaugggauggcuuacuauugguaucuccggcccagacaacggggcaguggccguccugaaauauaacggaauaauuaccgaaacaaucaagagcuggaaaaagagaaucuugaggacucaggagucggagugcguguguguaaauggcucuugcuuuaccauuaugacagauggucccuccaacggggcugccucauacaaaaucuucaagauugaaaagggaaaaguuaccaagaguauagagcucaaugcgccuaacuuucacuaugaagaguguagcugcuacccagacacgggcacugugaugugugucugccgggauaauuggcacggcuccaaccgccccugggugucuuucaaucagaaccuggacuaccaggugggguauaucugcagcggagucuuuggugauaauccuagaccaaaagacggcaaggggucauguaacccgaugacaguugauggagcagacggcgugaaagguuucaguuacaaguaugggaauggcguauggauuggaaggaccaaauccaacaagcugcggaagggcuuugagaugaucugggaccccaauggguggacugauacagacagcgauuucucugugaaacaagacgucguggccaucaccgauuggucaggauacagugguagcuuuguucagcauccugaacucacgggcuuagacugcauucgcccauguuucuggguggagcugguccgagggcuucccagagaaaacaccacaauauggacuuccggaucuucgaucagcuucugcggcguggauuccgacaccgcuaauuggucauggccugauggugccgaguugccauuuacaauugacaaguga

SEQ ID NO: 138148 - RNA, 1413 nt, Artificial Sequence; identical to SEQ ID NO: 138046
  derived and/or modified sequence opt3 from neuraminidase__InfluenzaA__ABW36248

SEQ ID NO: 138149 - RNA, 1413 nt, Artificial Sequence
  derived and/or modified sequence opt3 from neuraminidase__InfluenzaA__ABW36259
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcagggaaagacaagaccucgguaacacuugccggaaacucaagccuguguaguauuuccggcugggcgaucuacaccaaagauaauucuaucaggauugguagcaagggggacguguucgucauacgggaaccuuuuaucuccugcucacacuuggagugucgcacuuucuuuuuaacacaaggagcucugcuaaacgauaaacauaguaauggcaccgugaaggaccgaagcccauaucgugcccucaugucuugcccgcugggcgaagcacccuccccuuacaacucaaaguucgagagcguugccuggagugcuucugcaugucacgaugggaugggauggcuuacgauugguaucuccggcccagacaacggggccguggcuguccugaaauauaauggaauaauuacuggcaccaucaagagcuggaaaaagcagaucuugagaacacaggaaucggagugcguguguaugaacgguucuugcuuuacuauuaugaccgaugggcccuccaauagggccgcgucauacaaaaucuucaagauugagaagggaaaaguaacaaagaguauagaacucaacgcaccuaauuuucauuaugaggaauguagcugcuacccagacaccggcaucguuaugugugugugccgggauaacuggcacggcuccaaucgccccugggucucuuucaaccagaaucuggacuaccaaauuggguauaucugcagcggagugcugggugauaacccuagaccagaggacggcgaggggucauguaauccggugacggucgauggagccgacggcguuaaagguuuuaguuacaaguaugacaacgggguguggaucggcaggacuaaauccaaucggcuccgcaagggauucgaaaugauuugggaucccaacggcuggacaaauaccgacagcgauuuuucuguaaaacaggacguggucgcuauaacugauuggucaggguacagugguagcuucgugcagcacccugaguuaacaggacuggacugcauccgaccauguuuuuggguugaacuugugagaggcuugcccagggagaacaccacgauuuggaccuccgggucuucgaucagcuucugcggagucuccucagauacagccaacuggaguuggccugacggcgcagaacugccauucacuauugauaaguga

SEQ ID NO: 138150 - RNA, 1413 nt, Artificial Sequence; identical to SEQ ID NO: 138046
  derived and/or modified sequence opt3 from neuraminidase__InfluenzaA__ABW36281

SEQ ID NO: 138151 - RNA, 1413 nt, Artificial Sequence; identical to SEQ ID NO: 138046
  derived and/or modified sequence opt3 from neuraminidase__InfluenzaA__ABW36292

SEQ ID NO: 138152 - RNA, 1413 nt, Artificial Sequence; identical to SEQ ID NO: 138059
  derived and/or modified sequence opt3 from neuraminidase__InfluenzaA__ABW36303

SEQ ID NO: 138153 - RNA, 1413 nt, Artificial Sequence
  derived and/or modified sequence opt3 from neuraminidase__InfluenzaA__ABW36314
augaaccccaaucagaagaucauuaccauaggcagcaucugcauggccauugggaucauuucccugauccuccaaauaggaaacaucauuucuaucugggugucacacaguauucagacagguagccagaaucauacuggcaucuguaaccagagaauaauuacguacgaaaauuccaccugggucaaccaaacauauguuaauaucucuaacacuaaugugguagcugggaaagacaccacaucgaugacccuugcaggaaacucaagccugugcccuauuaggggcugggccaucuacaguaaggauaauuccauccggauugguucuaaaggggacguguucgucauacgcgaaccauuuaucagcuguucccacuuggagugccgaacuuucuuuuuaacacagggagcgcugcuaaacgauaagcauucaaauggcaccgugaaagaccguaguccguauagagcucucaugagcugucccauuggcgaagccccuucuccauacaacuccagguucgagucaguugcauggagcgccagugcuugccacgaugggaugggauggcugacgaucgguauaucuggccccgacgauggggcaguggccguccuuaaguauaauggaauuaucacugaaaccaucaaguccuggcggaaacagauucugcgcacacaggagagcgagugugugugcguaaacggcucguguuuuacuaucaugaccgacgguccuucugaugggcaggcuuccuacagaauuuucaagauagaaaaaggaaagaucacaaaaucaauugaguuggacgccccaaacuuucauuaugaagagugcaguuguuaccccgauaccggcacgguuaugugcgugugcagggacaauuggcacggcagcaaccggccuugggucuccuucaaucaaaaccucgauuaccagaucggguauaucuguucuggaguguuuggugacaauccacgcccgaaggacggcaaggggagcugcgaucccgugaacgucgacggagcggauggcguuaaagguuucucauaccgauaugggaauggcguguggauuggaagaacuaagaguaacuccagcaggaaaggcuuugagaugauaugggacccuaauggguggacagauaccgacucuaacuuccugguaaagcaggauguggucgcaaugacugacuggucaggauacagugguagcuuugugcaacacccagaacugacaggccucgauuguaugcggcccugcuucuggguugaguuaauccgugggcgcccuagagagaaaaccacgauuuggaccuccggaucuucgaucagcuucuguggcgucaauuccgacacagugaacuggucauggccagauggugccgagcugcccuuuacuauugacaaguga

SEQ ID NO: 138154 - RNA, 1410 nt, Artificial Sequence
  derived and/or modified sequence opt3 from neuraminidase__InfluenzaA__ABW38366
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucgcuucauggaguaaagagauucugaggacgcaggaaagcgaguguguuugcauaaacggcacuuguacaguggucaugaccgacggcucugcauccgggaaggccgauacuaaaauccucuuuauugaggaaggaaagaucgugcacacaucaaccuuaagcgguagugcucaacacguggaggaaugcucuugcuauccucgguacccaggcguccgcuguguuugcagagacaacuggaagggguccaauaggccgauaguggauauuaacaucaaagacuacagcaucguaucgucuuauguguguuccggacuggucggcgacacgccccggaagaaugauucaaguagcuccucucauugccuugacccuaacaaugaggaaggugggcacggagugaaaggcugggccuucgaugacggcaacgauguuuggauggggcgcaccauuagcgagaaguugcgaucaggauacgagacauuuaaagugaucgaagguuggaguaauccaaacuccaagcugcagauuaauagacaggucauaguggacaggggcaaccggagcggguauucuggaaucuucucaguagagggcaaaaguuguauuaaucguugcuuuuacguugaacuaauccgcgguagaaaggaggaaacugaggugcucuggaccagcaacuccaucgucguguucugugggacaucuggcacuuauggaaccggcucguggcccgauggggcggacauuaaucugaugccuauauga

SEQ ID NO: 138155 - RNA, 1413 nt, Artificial Sequence; identical to SEQ ID NO: 138145
  derived and/or modified sequence opt3 from neuraminidase__InfluenzaA__ABW39780

SEQ ID NO: 138156 - RNA, 1413 nt, Artificial Sequence
  derived and/or modified sequence opt3 from neuraminidase__InfluenzaA__ABW39809
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgagaauagcaccugggugaaccacacauaugucucgaucaauaacacuaauguuguggcagggaaagacaagacccuuguaacacuggccggaaacucaucuuuguguaguauuuccggcugggcgaucuacaccaaagauaauucuaucaggauugguagcaagggggacguguucgucauacgggaaccuuuuaucuccugcucacauuuagagugucgcacuuucuuucugacacaaggagcucuacucaacgauaaacacaguaauggcaccgugaaggaccgaagcccauaucgugcccugaugucuugcccgcuuggcgaagcacccuccccuuacaacucaaaguucgagagcguugccuggagugcuucugcaugucaugaugggaugggauggcugacgauugguaucuccggcccagacaauggggccguggcugucuugaaauauaacggaauaauuacugaaaccaucaagagcuggaaaaagagaauccucaggacacaggagucggagugcguguguguaaacggcucuugcuuuacuauuaugaccgauggucccuccaauggggccgcgucauacaaaaucuucaagauugaaaagggaaaaguuacaaagaguauagagcugaacgcaccuaauuuucacuaugaagaguguagcugcuacccagacaccggcacggugaugugugucugccgggauaacuggcacggcuccaaucgccccugggugucuuucaaccagaaucuggacuaccagaucggguauauuugcagcggaguguuuggugauaacccuagaccaaaagacggcaaggggucauguaauccggucacuguugauggagccgacggcgugaaagguuucaguuacaaguaugggaacggcguauggaucggaaggacaaaauccaaucggcuccgcaagggcuuugagaugaucugggaccccaacggguggaccgauacugacagcgauuucucugugaagcaagacgucguggcuauuacagauuggucaggauacagugguagcuuuguucagcauccugaauuaaccggccuggacugcauacgaccauguuucuggguggagcuugucagaggguugcccagggaaaauacgaccaucuggacauccggaucuucgauuagcuucugcggcguggauuccgacacugccaacuggucauggccugauggugcagagcugccauuuaccaucgacaaauga

SEQ ID NO: 138157 - RNA, 1413 nt, Artificial Sequence; identical to SEQ ID NO: 138059
  derived and/or modified sequence opt3 from neuraminidase__InfluenzaA__ABW39820

SEQ ID NO: 138158 - RNA, 1413 nt, Artificial Sequence
  derived and/or modified sequence opt3 from neuraminidase__InfluenzaA__ABW39831
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccccuguaacacuugugggaaauucgucacuguguagcauuaguggcugggccaucuacaccaaagauaacuccaucaggauugguucuaagggggacgucuucgugauacgggagccauuuaucagcugcucccauuuggaguguaaaacuuucuuuuuaacacaaggagcgcugcuaaaugauaagcacucaaacggcaccguuaaggaccgcaguccguaucgagcucucaugagcugcccccugggcgaagccccuucuccauacaauuccaaauucgagucaguggcauggagcgccagugcuugucaugaugggauuggauggcuuacgaucgguauaucuggccccgacaacggggcagucgccgugcugaaguauaacggaauuaucacuggcaccaucaaauccuggaagaaacagauuuugcguacacaggaaagcgagugcguauguaugaaugguucgugcuuuacuaucaugaccgaugggccuucuaacggagcugccuccuacaagauuuucaagauagagaaaggcaagguuacaaaaucaauggaacucaaugcgccaaacuuucacuaugaggaauguaguugcuaccccgacaccggcacggugaugugugucugcagagauaauuggcacgggagcaacaggccuuggguguccuucaaucagaaccuggacuaccaaaucggauauauuugcucugguguguuuggcgauaauccacggccgaaggacggggagggaagcuguaaccccgucacuguugauggcgcaaauggugugaaaggguucucauacaaguauggcaacggaguauggaucggccgcacaaaaaguaauagaaucaggaagggguuugagaugauuugggacccuaacggauggaccaauacugacuccgauuucagcgugaagcaggacauagucgccaucacagauuggucugguuacucaggcaguuuugugcagcauccagaacugaccgggcucgacugcauucggcccuguuucuggguugaguuagugcgcggacugccucgagaaaacacgaccaucuggacaagcggcuccucuauuucguucugcggugucaacggggauaucgcuaauuggagcuggccagacggcgccgagcuucccuuuacuauagauaaauga

SEQ ID NO: 138159 - RNA, 1413 nt, Artificial Sequence; identical to SEQ ID NO: 138072
  derived and/or modified sequence opt3 from neuraminidase__InfluenzaA__ABW39842

SEQ ID NO: 138160 - RNA, 1413 nt, Artificial Sequence; identical to SEQ ID NO: 138046
  derived and/or modified sequence opt3 from neuraminidase__InfluenzaA__ABW39864

SEQ ID NO: 138161 - RNA, 1410 nt, Artificial Sequence; identical to SEQ ID NO: 138082
  derived and/or modified sequence opt3 from neuraminidase__InfluenzaA__ABW39875

SEQ ID NO: 138162 - RNA, 1413 nt, Artificial Sequence
  derived and/or modified sequence opt3 from neuraminidase__InfluenzaA__ABW39886
augaaccccaaucagaagaucauuaccauaggcagcaucuccauugccaucgggauuaucucucugauacuccaaaucggaaacauuaucucaauuugggcuagucacagcauccagacaagaaaucagaaccauacugguauaugcaaucagaggauuaucacguacgagaacuccaccugggugaaucacacauaugucucuauuaacaauacuaacguuguggcaggcaaagacaagaccucgguaacacuugccggaaauucaagccuguguaguaucuccggaugggcgaucuacaccaaagauaacucuauucggauaggcagcaagggugacguguucgucauccgcgaaccuuuuauuuccugcucacauuuggagugucgaacuuucuuuuuaacacaaggggcucugcuaaaugauaaacacaguaacggaaccgugaaggaccguagcccauauagagcccucaugucuugcccgcugggcgaagcacccuccccuuacaauucaaaguucgagagcguugccuggagugcuucugcaugucaugauggcaugggguggcuuacgaucggaauauccgguccagacaacggcgccguggcuguccugaaauauaacgggauuaucacugaaaccaucaagagcuggaaaaagaggauuuugcggacacaggagucggagugcguguguguaaauggaucuugcuuuacuaucaugaccgauggccccuccaacggugccgcgucauacaaaauuuucaagauagaaaaggggaaaguuacaaagaguaucgagcucaaugcaccuaacuuucacuaugaagaguguagcugcuacccagacaccggaacggugaugugugucugccgcgauaauuggcacggcuccaacagacccugggugucuuucaaucagaaccuggacuaccagauuggcuauaucugcagcgggguguuuggagauaauccuaggccaaaagacgguaagggcucauguaacccggucacuguugauggggccgacggagugaaaggcuucaguuacaaguaugguaaugggguauggaucggccggacaaaauccaaccgccugcgaaagggauuugagaugauuugggaccccaauggcuggaccgauacugacagcgauuucucugugaagcaagacgucguggcuauaacagauuggucaggguacagugggagcuuuguucagcauccugaacucaccgguuuagacugcaucagaccauguuucuggguggagcuggucaggggccuuccccgggaaaacacgaccauuuggacauccgggucuucgaucagcuucugcggaguggauuccgacacugccaauuggucauggccugauggcgcagaguugccauuuaccauugacaaauga

SEQ ID NO: 138163 - RNA, 1413 nt, Artificial Sequence; identical to SEQ ID NO: 138046
  derived and/or modified sequence opt3 from neuraminidase__InfluenzaA__ABW39897

SEQ ID NO: 138164 - RNA, 1413 nt, Artificial Sequence
  derived and/or modified sequence opt3 from neuraminidase__InfluenzaA__ABW39908
augaaccccaaucagaagaucauuaccauaggcagcaucuccauugccaucgggauuacaucucugaugcuccaaaucggaaacauaaucucaauuugggcuagucacagcauccagacugguucccagaaucauacgggcauuugcaaccagagaaucauaaccuacgaaaauucuacaugggugaaccacacuuaugucucgauuaauaacaccaauguuguggcagggaaagacaagacaucaguaacccuugccggaaacagcagucuguguuccaucucuggcugggcgauuuacacuaaagauaauagcaucaggaucgguuccaagggggacguguucgucauucgggagccuuuuauaucaugcagucauuuggagugucgcacauucuuuuuaacccaaggagcucugcuaaacgauaaacacagcaauggcacggugaaggaccgaucuccauaucgugcccucauguccugcccgcugggcgaagcacccucaccuuacaacagcaaguucgagaguguugccuggucugcuuccgcaugucaugaugggaugggauggcuuacuaucgguauuagcggcccagacaauggggccguggcuguccugaaauauaacggaaucauaaccgaaacaauuaagucguggaaaaagagaaucuugaggacucaggagucugagugcguguguguaaacggcuccugcuuuaccaucaugacagauggucccucaaauggggccgcgaguuacaaaauuuucaagaucgaaaagggaaaaguuaccaagagcauugagcucaacgcaccuaauuuucacuaugaagaguguuccugcuacccagacacgggcacugugaugugugucugccgggauaacuggcacggcucuaaucgccccugggugagcuucaaccagaaucuggacuaccagauaggguauaucugcucaggaguguuuggugauaacccuagaccaaaagacggcaaggggaguuguaauccggucacaguugauggagccgacggcgugaaagguuucuccuacaaguaugggaacggcguauggauuggaaggaccaaaagcaaucggcugcgcaagggcuuugagaugaucugggaccccaacggguggacugauacagacucugauuucucagugaagcaagacgucguggcuaucaccgauuggaguggauacagcgguuccuuuguucagcauccugaacucacgggcuuagacugcauucgaccauguuucuggguggagcuggucagagggcuucccagggaaaauaccacaauauggacuucuggaucgagcaucuccuucugcggcguggauucagacaccgccaacuggaguuggccugauggugcagaguugccauuuacaauugacaaauga

SEQ ID NO: 138165 - RNA, 1413 nt, Artificial Sequence
  derived and/or modified sequence opt3 from neuraminidase__InfluenzaA__ABW39930
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucagacggggccgcgaguuacaaaaucuucaagauugaaaagggaaaaguuacaaagagcauagagcucaaugcaccuaacuuucacuaugaagaguguuccugcuacccagauaccggcacggugaugugugucugccgggacaauuggcacggcucuaaccgccccugggugagcuucaaucagaaccuggauuaccagaucggguauauuugcucaggaguguuuggugacaauccuagaccaaaagauggcaaggggaguuguaacccggucacuguugacggagccgacggcgugaaagguuucuccuacaaguaugggaauggcguauggaucggaaggacaaaaagcaaccggcugcgcaagggcuuugagaugaucugggaucccaauggguggaccgacacugauucugacuucucagugaagcaagaugucguggcuauuacagacuggaguggauacagcgguuccuuuguucagcauccugaacucaccggcuuagauugcauacgaccauguuucuggguggagcuggucagagggcuucccagggaaaacacgaccaucuggacaucuggaucgagcauuuccuucugcggcguggacucagauacugccaauuggaguuggccugacggugcagaguugccauuuaccaucgauaaauga

SEQ ID NO: 138166 - RNA, 1413 nt, Artificial Sequence
  derived and/or modified sequence opt3 from neuraminidase__InfluenzaA__ABW39952
augaaccccaaucagaagaucauuaccauaggcagcaucuccauuacaaucgggauuaucucucugaugcuccaaauaggaaacaucauuucaaucugggccagucacagcauucagacugguucccagaaucauacgggcaugugcaaccagagaaucauaaccuacgaaaauucuacaugggugaaccacacuuaugucucgauuaauaacaccaauguuguggcugggaaagacaagacaucaguaacccuugcaggaaacagcagucuguguuccaucucuggcugggccauuuacacuaaagauaauagcaucaggaucgguuccaagggggacguguucgucauucgggagccuuuuauaucaugcagucauuuggagugucgcacauucuuuuuaacccaaggagcgcugcuaaacgauaaacacagcaauggcacggugaaggaccgaucuccauaucgugcucucauguccugcccgcugggcgaagcccccucaccuuacaacagcaaguucgagaguguugcauggucugccuccgcuugucaugaugggaugggauggcuuacuaucgguauuagcggcccagacaauggggcaguggccguccugaaauauaacggaaucauaaccgaaacaauuaagucguggaaaaagagaaucuugaggacucaggagucugagugcguguguguaaacggcuccugcuuuaccaucaugacagauggucccucaaauggggcugccaguuacaaaauuuucaagaucgaaaagggaaaaguuaccaagagcauugagcucaacgcgccuaauuuucacuaugaagaguguuccugcuacccagacacgggcacugugaugugugucugccgggauaacuggcacggcucuaaucgccccugggugagcuucaaccagaaucuggacuaccagauaggguauaucugcucaggaguguuuggugauaacccuagaccaaaagacggcaaggggaguuguaauccggucacaguugauggagcagacggcgugaaagguuucuccuacaaguaugggaacggcguauggauuggaaggaccaaaagcaaucggcugcgcaagggcuuugagaugaucugggaccccaacggguggacugauacagacucugauuucucagugaagcaagacgucguggccaucaccgauuggaguggauacagcgguuccuuuguucagcauccugaacucacgggcuuagacugcauucgaccauguuucuggguggagcuggucagagggcuucccagggaaaauaccacaauauggacuucuggaucgagcaucuccuucugcggcguggauucagacaccgcuaacuggaguuggccugauggugccgaguugccauuuacaauugacaaauga

SEQ ID NO: 138167 - RNA, 1413 nt, Artificial Sequence; identical to SEQ ID NO: 138046
  derived and/or modified sequence opt3 from neuraminidase__InfluenzaA__ABW39963

SEQ ID NO: 138168 - RNA, 1413 nt, Artificial Sequence; identical to SEQ ID NO: 138046
  derived and/or modified sequence opt3 from neuraminidase__InfluenzaA__ABW39985

SEQ ID NO: 138169 - RNA, 1413 nt, Artificial Sequence
  derived and/or modified sequence opt3 from neuraminidase__InfluenzaA__ABW39996
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacgggacagccucauacaaaaucuucaagauugaaaagggaaaaguuaccaagaguauagagcucaaugcgccuaacuuucacuaugaagaguguagcugcuacccagacacgggcacugugaugugugucugccgggauaauuggcacggcuccaaccgccccugggugucuuucaaucagaaccuggacuaccaggugggguauaucugcagcggagucuuuggugauaauccuagaccaaaagacggcaaggggucauguaacccgaugacaguugauggagcagacggcgugaaagguuucaguuacaaguaugggaauggcguauggauuggaaggaccaaauccaacaagcugcggaagggcuuugagaugaucugggaccccaauggguggacugauacagacagcgauuucucugugaaacaagacgucguggccaucaccgauuggucaggauacagugguagcuuuguucagcauccugaacucacgggcuuagacugcauucgcccauguuucuggguggagcugguccgagggcuucccagagaaaacaccacaauauggacuuccggaucuucgaucagcuucugcggcguggauuccgacaccgcuaauuggucauggccugauggugccgaguugccauuuacaauugacaaguga

SEQ ID NO: 138170 - RNA, 1413 nt, Artificial Sequence; identical to SEQ ID NO: 138046
  derived and/or modified sequence opt3 from neuraminidase__InfluenzaA__ABW40007

SEQ ID NO: 138171 - RNA, 1413 nt, Artificial Sequence
  derived and/or modified sequence opt3 from neuraminidase__InfluenzaA__ABW40018
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcaaggggucauguaacccggucacuguugauggagccgacggcaucaaagguuucaguuacaaguaugggaauggcguguggaucggaaggacaaaauccaaccggcugcgcaagggcuuugagaugauuugggaccccaauggguggaccaacacugauagcgacuucucuguaaagcaagauguggucgcuauaacagacuggucaggauacagugguagcuuugugcagcauccugaacucaccggcuuagauugcauccgaccauguuucuggguugagcuggugagagggcuucccagggaaaauacgaccauuuggacauccggaucuucgaucagcuucugcggcgucgacggugauacugccaacugguccuggccugacggggcagaguugccauuuaccauugauaaauga

SEQ ID NO: 138172 - RNA, 1410 nt, Artificial Sequence; identical to SEQ ID NO: 137900
  derived and/or modified sequence opt3 from neuraminidase__InfluenzaA__ABW40029

SEQ ID NO: 138173 - RNA, 1413 nt, Artificial Sequence
  derived and/or modified sequence opt3 from neuraminidase__InfluenzaA__ABW40040
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacggugaugugugucugccgggauaacuggcacggcucuaaucgccccugggugagcuucaaccagaaucuggacuaccagaucggguauauuugcucaggaguguuuggugauaacccuagaccaaaagacggcaaggggaguuguaauccggucacuguugauggagccgacggcgugaaagguuucuccuacaaguaugggaacggcaucuggaucggaaggacaaaaagcaaucggcugcgcaagggcuuugagaugauuugggaccccaacggguggaccgauacugacucugauuucucaguaaagcaagacguggucgcuauaacagauuggaguggauacagcgguuccuuugugcagcauccugaacucaccggcuuagacugcauccgaccauguuucuggguugagcuggugagagggcuucccagggaaaauacgaccauuuggacaucuggaucgagcaucuccuucugcggcgucgauucagacacugccaacuggaguuggccugauggugcagaguugccauuuaccauugacaaauga

SEQ ID NO: 138174 - RNA, 1413 nt, Artificial Sequence; identical to SEQ ID NO: 138046
  derived and/or modified sequence opt3 from neuraminidase__InfluenzaA__ABW40051

SEQ ID NO: 138175 - RNA, 1413 nt, Artificial Sequence; identical to SEQ ID NO: 138046
  derived and/or modified sequence opt3 from neuraminidase__InfluenzaA__ABW40062

SEQ ID NO: 138176 - RNA, 1410 nt, Artificial Sequence; identical to SEQ ID NO: 138082
  derived and/or modified sequence opt3 from neuraminidase__InfluenzaA__ABW40084

SEQ ID NO: 138177 - RNA, 1413 nt, Artificial Sequence
  derived and/or modified sequence opt3 from neuraminidase__InfluenzaA__ABW40095
augaaccccaaucagaagaucauuaccauaggcagcaucuccguggccauugggaucauuucucugaugcuccaaaucggaaacauaaucucaauuugggcuagucacagcauccagacagguucccagaaucauacuggcauuugcaaccagagaaucauaacguacgaaaauucuaccugggucaaccacacauauguuucgauuaauaacacuaaugugguagcagggaaagacaagaccucagugacacuugccggaaacagcagucuguguuccaucucuggcugggcgauuuacaccaaagauaauagcaucaggaucgguuccaagggggacgucuucgugauucgggagccuuuuauaucaugcagucauuuggagugucgcacuuucuuuuuaacacaaggagcucugcuaaacgauaaacacagcaauggcaccguuaaggaccgaucuccauaucgugcccucauguccugcccgcugggcgaagcacccucaccuuacaacagcaaguucgagaguguggccuggucugcuuccgcaugucaugaugggaugggauggcuuacgaucgguauuagcggcccagacaauggggccgucgcugugcugaaauauaacggaaucauaacugaaaccauuaagucguggaaaaagagaaucuugaggacacaggagucugagugcguauguguuaacggcuccugcuuuacuaucaugaccgauggucccucaaauggggccgcgaguuacaaaauuuucaagaucgaaaagggaaaagugacaaagagcauugagcucaacgcaccuaauuuucacuaugaagaguguuccugcuacccagacaccggcacggucaugugugugugccgggauaacuggcacggcucuaaucgccccugggugagcuucaaccagaaucuggacuaccagauaggguauaucugcucaggagucuuuggugauaacccuagaccaaaagacggcaaggggaguuguaauccgaugacuguugauggagccgacggcgugaaagguuucuccuacaaguaugggaacggcguauggauuggaaggacaaaaagcaaucggcugcgcaagggcuuugagaugaucugggaccccaacggguggaccgauacugacucugauuucucagugaagcaagacgucguggcuaucacagauuggaguggauacagcgguuccuuuguucagcauccugaacucaccggcuuagacugcauucgaccauguuucuggguggagcuggucagagggcuucccagggaaaauacgaccauauggacaucuggaucgagcaucuccuucugcggcguggauucagacacugccaacuggaguuggccugauggugcagaguugccauuuaccauugacaaauga

SEQ ID NO: 138178 - RNA, 1413 nt, Artificial Sequence
  derived and/or modified sequence opt3 from neuraminidase__InfluenzaA__ABW40106
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcgugugucucaacggcuccugcuuuacuauuaugaccgauggucccucaaauggggccgcgaguuacaaaaucuucaagauugaaaagggaaaaguaacaaagagcauagagcugaacgcaccuaauuuucacuaugaagaguguuccugcuacccagacaccggcacgguuaugugugugugccgggauaacuggcacggcucuaaucgccccugggucagcuucaaccagaaucuggacuaccagaucggguauauuugcucaggaguguuuggugauaacccuagaccaaaagacggcaaggggaguuguaauccggugacugucgauggagccgacggcguuaaagguuucuccuacaaguaugggaacggcguguggaucggaaggacaaaaagcaaucggcuccgcaagggcuuugagaugguaugggaccccaacggguggaccgauacugacucugauuucucagugaagcaagacgucguggcuaucacagauuggaguggauacagcgguuccuuuguucagcauccugaauuaaccggccuggacugcauucgaccauguuucuggguggagcuugucagaggguugcccagggaaaauacgaccauauggacaucuggaucgagcaucuccuucugcggcguggauucagacacugccaacuggaguuggccugauggugcagagcugccauuuaccauugacaaauga

SEQ ID NO: 138179 - RNA, 1413 nt, Artificial Sequence; identical to SEQ ID NO: 138046
  derived and/or modified sequence opt3 from neuraminidase__InfluenzaA__ABW40117

SEQ ID NO: 138180 - RNA, 1413 nt, Artificial Sequence; identical to SEQ ID NO: 138046
  derived and/or modified sequence opt3 from neuraminidase__InfluenzaA__ABW40128

SEQ ID NO: 138181 - RNA, 1410 nt, Artificial Sequence; identical to SEQ ID NO: 137900
  derived and/or modified sequence opt3 from neuraminidase__InfluenzaA__ABW40139

SEQ ID NO: 138182 - RNA, 1413 nt, Artificial Sequence; identical to SEQ ID NO: 138046
  derived and/or modified sequence opt3 from neuraminidase__InfluenzaA__ABW40150

SEQ ID NO: 138183 - RNA, 1413 nt, Artificial Sequence; identical to SEQ ID NO: 138046
  derived and/or modified sequence opt3 from neuraminidase__InfluenzaA__ABW40161

SEQ ID NO: 138184 - RNA, 1410 nt, Artificial Sequence
  derived and/or modified sequence opt3 from neuraminidase__InfluenzaA__ABW40172
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaagggguccaaccggccgauuguggacaucaauaucaaagaccacagcauuguaucgucuuacguguguuccggacuggucggcgauacgccccgcaagaacgacucaaguagcuccucucauugccuugauccuaauaacgaggaaggugggcacggagugaaaggcugggcuuucgacgauggcaaugacguuuggauggggcgaaccaucagcgagaagucaagauugggauaugagacauuuaaagugauugaagguuggaguaacccaaaguccaaacugcagauaaauaggcaggucaucguggaucggggcaaccguagcggguacucuggaauuuucucaguagagggcaagaguuguaucaaucgcugcuuuuauguugaacuaacuagagguaggaaggaggaaaccgaggugcucuggacaagcaacuccaucgucguguucugugggacuucuggcaccuacggaacaggcucguggcccgacggggccgauauuaaucugaugccuauauga

SEQ ID NO: 138185 - RNA, 1413 nt, Artificial Sequence; identical to SEQ ID NO: 138046
  derived and/or modified sequence opt3 from neuraminidase__InfluenzaA__ABW40183

SEQ ID NO: 138186 - RNA, 1410 nt, Artificial Sequence; identical to SEQ ID NO: 137900
  derived and/or modified sequence opt3 from neuraminidase__InfluenzaA__ABW40194

SEQ ID NO: 138187 - RNA, 1413 nt, Artificial Sequence; identical to SEQ ID NO: 138081
  derived and/or modified sequence opt3 from neuraminidase__InfluenzaA__ABW40205

SEQ ID NO: 138188 - RNA, 1413 nt, Artificial Sequence; identical to SEQ ID NO: 138085
  derived and/or modified sequence opt3 from neuraminidase__InfluenzaA__ABW40216

SEQ ID NO: 138189 - RNA, 1413 nt, Artificial Sequence; identical to SEQ ID NO: 138085
  derived and/or modified sequence opt3 from neuraminidase__InfluenzaA__ABW40227

SEQ ID NO: 138190 - RNA, 1413 nt, Artificial Sequence; identical to SEQ ID NO: 138046
  derived and/or modified sequence opt3 from neuraminidase__InfluenzaA__ABW40238

SEQ ID NO: 138191 - RNA, 1410 nt, Artificial Sequence
  derived and/or modified sequence opt3 from neuraminidase__InfluenzaA__ABW40249
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaagggguccaaccggccgauuguggacaucaauaucaaagaccacagcauuguaucgucuuacguguguuccggacuggucggcgauacgccccgcaagaacgacucaaguagcuccucucauugccuugauccuaauaacgaggaaggugggcacggagugaaaggcugggcuuucgacgauggcaaugacguuuggauggggcgaaccaucagcgagaagucaagauugggauaugagacauuuaaagugauugaagguuggaguaaccauaaguccaaacugcagauaaauaggcaggucaucguggaucggggcaaccguagcggguacucuggaauuuucucaguagagggcaagaguuguaucaaucgcugcuuuuauguugaacuaaucagagguaggaaggaggaaacugaggugcucuggaccagcaacuccauugucguguucugugggacaucuggcacuuacggaaccggcucguggccagacggggccgauauaaaucugaugcccaucuga

SEQ ID NO: 138192 - RNA, 1413 nt, Artificial Sequence; identical to SEQ ID NO: 138046
  derived and/or modified sequence opt3 from neuraminidase__InfluenzaA__ABW40260

SEQ ID NO: 138193 - RNA, 1410 nt, Artificial Sequence
  derived and/or modified sequence opt3 from neuraminidase__InfluenzaA__ABW40271
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugagcauaggaauuggaguaagccucagugugacauaacaggguucgcaccauuuagcaaagauaacuccauucggcugucugccggaggugacaucuggguaacccgcgagcccuacgugucgugcgauccugacaaguguuaucaauucgcgcuaggccaggggacgacucucaauaacguccacucaaaugauaccgugcgagaccguacaccauacagaacucugcuuaugaacgaacugggaguucccuuucauuugggcaccaaacaggugugcauugcuuggagcaguuccucuugucacgaugguaaggccuggcuccaugucugcaucacaggggacgauaagaaugcaaccgccagcuucaucuauaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcacacaucaaccuuaagcgguagugcccaacacguggaggaaugcucuugcuacccucgcuauccaggcgucagauguguuugcagggauaacuggaagggguccaaccggccgauuguggacaucaauaucaaagaccauagcauuguaucgucuuacguguguuccggacuggucggcgauacgccccgcaagaacgacucaaguagcuccucucacugccuugauccuaauaacgaggaaggugggcauggagugaaaggcugggcuuucgacgauggcaaugacguuuggauggggcgaaccaucagcgagaagucaagauugggauacgagacauuuaaagugauugaagguuggaguaacccaaaguccaaacugcagauaaauaggcaggucaucguggaucggggcaaccguagcggguauucuggaauuuucucaguagagggcaagaguuguaucaaucgcugcuuuuacguugaacuaaucagagguaggaaggaggaaacugaggugcucuggaccagcaacuccauugucguguucugugggacaucuggcacuuauggaaccggcucguggcccgacggggccgauauaaaucugaugccuaucuga

SEQ ID NO: 138194 - RNA, 1413 nt, Artificial Sequence; identical to SEQ ID NO: 138046
  derived and/or modified sequence opt3 from neuraminidase__InfluenzaA__ABW40282

SEQ ID NO: 138195 - RNA, 1413 nt, Artificial Sequence; identical to SEQ ID NO: 138081
  derived and/or modified sequence opt3 from neuraminidase__InfluenzaA__ABW40293

SEQ ID NO: 138196 - RNA, 1413 nt, Artificial Sequence; identical to SEQ ID NO: 138046
  derived and/or modified sequence opt3 from neuraminidase__InfluenzaA__ABW40304

SEQ ID NO: 138197 - RNA, 1413 nt, Artificial Sequence; identical to SEQ ID NO: 138046
  derived and/or modified sequence opt3 from neuraminidase__InfluenzaA__ABW40315

SEQ ID NO: 138198 - RNA, 1410 nt, Artificial Sequence; identical to SEQ ID NO: 137900
  derived and/or modified sequence opt3 from neuraminidase__InfluenzaA__ABW40326

SEQ ID NO: 138199 - RNA, 1413 nt, Artificial Sequence; identical to SEQ ID NO: 138087
  derived and/or modified sequence opt3 from neuraminidase__InfluenzaA__ABW40337

SEQ ID NO: 138200 - RNA, 1413 nt, Artificial Sequence; identical to SEQ ID NO: 138081
  derived and/or modified sequence opt3 from neuraminidase__InfluenzaA__ABW40359

SEQ ID NO: 138201 - RNA, 1413 nt, Artificial Sequence
  derived and/or modified sequence opt3 from neuraminidase__InfluenzaA__ABW40370
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacucuggcaccgugaugugugucugccgggauaacuggcacggcagcaaucgccccugggugucauucaaccagaaucuggacuaccagaucggguauauuugcaguggaguguuuggugauaacccuagaccaaaagacggcaagggguccuguaauccggucacgguugauggagccgacggcgugaaagguuucagcuacaaguaugggaacggcguauggaucggaaggacuaaaucuaaucggcugcgcaagggcuuugagaugaucugggaccccaacggguggacagauaccgacucagauuucagugugaagcaagacgucguggcuauuacugauuggagcggauacuccgguucuuuuguucagcauccugaacucacaggcuuagacugcauacgaccauguuucuggguggagcuggucagagggcuucccagggaaaauaccacgaucuggaccucgggaagcuccauuucauucugcggcguggauagugacacagccaacuggucuuggccugauggugcagaguugccauuuacuaucgacaaauga

SEQ ID NO: 138202 - RNA, 1413 nt, Artificial Sequence; identical to SEQ ID NO: 138046
  derived and/or modified sequence opt3 from neuraminidase__InfluenzaA__ABW40403

SEQ ID NO: 138203 - RNA, 1413 nt, Artificial Sequence
  derived and/or modified sequence opt3 from neuraminidase__InfluenzaA__ABW40414
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacggugaugugugucugccgggauaacuggcacggcucuaaucgccccugggugagcuucgaccagaaccuggauuaccagaucggguauauuugcucaggaguguuuggugacaauccuagaccaaaagauggcaaggggaguuguaacccggucacuguugacggagccgacggcgugaaagguuucuccuacaaguaugggaauggcguauggaucggaaggacaaaaagcaaccggcugcgcaagggcuuugagaugaucugggaucccaauggguggaccgacacugauucugacuucucagugaagcaagaugucguggcuauuacagacuggaguggauacagcgguuccuuuguucagcauccugaacucaccggcuuagauugcauacgaccauguuucuggguggagcuggucagagggcuucccagggaaaacacgaccaucuggacaucuggaucgagcauuuccuucugcggcguggacucagauacugccaauuggaguuggccugacggugcagaguugccauuuaccaucgauaaauga

SEQ ID NO: 138204 - RNA, 1413 nt, Artificial Sequence; identical to SEQ ID NO: 138046
  derived and/or modified sequence opt3 from neuraminidase__InfluenzaA__ABW40425

SEQ ID NO: 138205 - RNA, 1413 nt, Artificial Sequence; identical to SEQ ID NO: 138087
  derived and/or modified sequence opt3 from neuraminidase__InfluenzaA__ABW40436

SEQ ID NO: 138206 - RNA, 1413 nt, Artificial Sequence
  derived and/or modified sequence opt3 from neuraminidase__InfluenzaA__ABW40447
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccaggugggguauaucugcagcggagucuuuggugauaauccuagaccaaaagacggcaaggggucauguaacccgaugacuguugauggagccgacggcgugaaagguuucaguuacaaguaugggaauggcguauggauuggaaggacaaaauccaacaagcugcggaagggcuuugagaugaucugggaccccaauggguggaccgauacugacagcgauuucucugugaaacaagacgucguggcuaucacagauuggucaggauacagugguagcuuuguucagcauccugaacucaccggcuuaaacugcauucgcccauguuucuggguggagcugguccgagggcuucccagagaaaauacgaccauauggacauccggaucuucgaucagcuucugcggcguggacuccgauacugccaacuggucauggccugacggugcagaguugccauuuaccauugauaaguga

SEQ ID NO: 138207 - RNA, 1413 nt, Artificial Sequence; identical to SEQ ID NO: 138072
  derived and/or modified sequence opt3 from neuraminidase__InfluenzaA__ABW40458

SEQ ID NO: 138208 - RNA, 1413 nt, Artificial Sequence; identical to SEQ ID NO: 138046
  derived and/or modified sequence opt3 from neuraminidase__InfluenzaA__ABW40469

SEQ ID NO: 138209 - RNA, 1413 nt, Artificial Sequence; identical to SEQ ID NO: 138046
  derived and/or modified sequence opt3 from neuraminidase__InfluenzaA__ABW40491

SEQ ID NO: 138210 - RNA, 1413 nt, Artificial Sequence; identical to SEQ ID NO: 138046
  derived and/or modified sequence opt3 from neuraminidase__InfluenzaA__ABW40502

SEQ ID NO: 138211 - RNA, 1413 nt, Artificial Sequence; identical to SEQ ID NO: 138087
  derived and/or modified sequence opt3 from neuraminidase__InfluenzaA__ABW40513

SEQ ID NO: 138212 - RNA, 1413 nt, Artificial Sequence; identical to SEQ ID NO: 138046
  derived and/or modified sequence opt3 from neuraminidase__InfluenzaA__ABW40524

SEQ ID NO: 138213 - RNA, 1413 nt, Artificial Sequence
  derived and/or modified sequence opt3 from neuraminidase__InfluenzaA__ABW40546
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauggagcucaaugcaccuaacuuucacuaugaagaguguagcugcuacccagacaccggcacggugaugugugucugccgggauaauuggcacggcuccaaccgccccugggugucuuucaaucagaaccuggacuaccagauaggguauaucugcagcggaguguuuggugauaauccuagaccaaaagacggcaaggggucauguaacccggucacuguugauggagccgacggcgugaaagguuucaguuacaaguaugggaauggcguauggauuggaaggacaaaauccaaccggcugcgcaagggcuuugagaugaucugggaccccaauggguggaccgauacugacagcgauuucucugugaagcaagacgucguggcuaucacagauuggucaggauacagugguagcuuuguucagcauccugaacucaccggcuuagacugcauucgaccauguuucuggguggagcuggucagagggcuucccagggaaaacacgaccauauggacauccggaucuucgaucagcuucugcggcguggauuccgacacugccaauuggucauggccugauggugcagaguugccauuuaccauugacaaauga

SEQ ID NO: 138214 - RNA, 1413 nt, Artificial Sequence; identical to SEQ ID NO: 138046
  derived and/or modified sequence opt3 from neuraminidase__InfluenzaA__ABW40557

SEQ ID NO: 138215 - RNA, 1413 nt, Artificial Sequence
  derived and/or modified sequence opt3 from neuraminidase__InfluenzaA__ABW40568
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagcagaucuugagaacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacggugaugugugucugcagggauaacuggcacggcucuaaucggcccugggugagcuucaaccagaaucuggacuaccaaaucggguauauuugcucaggaguguuuggugauaacccucgcccaaaagacggcaaggggaguuguaauccggucacuguugauggagccgacggcgugaaagguuucuccuacaaguaugggaacggcguauggaucggaagaacaaaaagcaauaggcugcggaagggcuuugagaugaucugggaccccaacggguggaccgauacugacucugauuucucagugaagcaggacgucguggcuauuacagauuggaguggauacagcgguuccuuuguucagcauccugaacucaccggcuuagacugcauacgcccauguuucuggguggagcugguccgagggcuucccagagaaaauacgaccaucuggacaucuggaucgagcauuuccuucugcggcguggauucagacacugccaacuggaguuggccugauggugcagaguugccauuuaccaucgacaaauga

SEQ ID NO: 138216 - RNA, 1413 nt, Artificial Sequence
  derived and/or modified sequence opt3 from neuraminidase__InfluenzaA__ABW40579
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccaauaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcaaggggucauguaacccggucacuguugauggagccgacggcgugaaagguuucaguuacaaguaugggaauggcguauggaucggaaggacaaaauccaaccggcugcgcaagggcuuugagaugaucugggaccccaauggguggaccgauacugacagcgauuucucugugaagcaagacgucguggcuauuacagauuggucaggauacagugguagcuuuguucagcauccugaacucaccggcuuagacugcauacgaccauguuucuggguggagcuggucagagggcuucccagggaaaacacgaccaucuggacauccggaucuucgauuagcuucugcggcguggauuccgacacugccaauuggucauggccugauggugcagaguugccauuuaccaucgacaaauga

SEQ ID NO: 138217 - RNA, 1413 nt, Artificial Sequence
  derived and/or modified sequence opt3 from neuraminidase__InfluenzaA__ABW40601
augaaccccaaucagaagaucauuaccauaggcagcaucuccauugccaucggggugauuucucugaugcuccaaaucggaaacauaaucucaauuugggcuagucacagcauccagacagguucccagaaucauacuggcauuugcaaccagagaaucauaacguacgaaaauucuaccugggucaaccacacauauguuaauauuaacaauacuaacgugguagcagggaaagacaagaccucggugacacuugccggaaauucaagccuguguaguaucuccggcugggcgauuuacaccaaagauaacucuaucaggaucgguagcaagggggacgucuucgugauucgggagccuuuuauauccugcucacauuuggagugucgcacuuucuuuuuaacacaaggagcucugcuaaaugauaaacacaguaacggcaccguuaaggaccgaagcccauaucgugcccucaugucuugcccgcugggcgaagcacccuccccuuacaauucaaaguucgagagcguggccuggagugcuucugcaugucaugaugggaugggauggcuuacgaucgguauuuccggcccagacaacggggccgucgcugugcugaaauauaacggaaucauaacugaaaccauuaagagcuggaaaaagagaaucuugaggacacaggagucggagugcguauguguuaauggcucuugcuuuacuaucaugaccgauggucccuccaacggggccgcgucauacaaaauuuucaagaucgaaaagggaaaagugacaaagaguauugagcucaaugcaccuaacuuucacuaugaagaguguagcugcuacccagacaccggcacggucaugugugugugccgggauaauuggcacggcuccaaccgccccugggugucuuucaaucagaaccuggacuaccagauaggguauaucugcagcggagucuuuggugauaauccuagaccaaaagacggcaaggggucauguaacccgguuacuguggauggagccgacggcauuaaagguuucaguuacaaguaugggaauggcguauggaucggaaggacaaaauccaaccggcugcgcaagggcuuugagaugaucugggaccccaauggguggaccaacacugauagcgacuucucugugaagcaagaugucguggcuauuacagacuggucaggauacagugguagcuuuguucagcauccugaacucaccggcuuagauugcauacgaccauguuucuggguggagcuggucagagggcuucccagggaaaauacgaccaucuggacauccggaucuucgauuagcuucugcggcguggacggugauacugccaacugguccuggccugacggggcagaguugccauuuaccaucgauaaauga

SEQ ID NO: 138218 - RNA, 1413 nt, Artificial Sequence; identical to SEQ ID NO: 138081
  derived and/or modified sequence opt3 from neuraminidase__InfluenzaA__ABW40612

SEQ ID NO: 138219 - RNA, 1413 nt, Artificial Sequence; identical to SEQ ID NO: 138046
  derived and/or modified sequence opt3 from neuraminidase__InfluenzaA__ABW40623

SEQ ID NO: 138220 - RNA, 1410 nt, Artificial Sequence; identical to SEQ ID NO: 137900
  derived and/or modified sequence opt3 from neuraminidase__InfluenzaA__ABW40634

SEQ ID NO: 138221 - RNA, 1413 nt, Artificial Sequence; identical to SEQ ID NO: 138046
  derived and/or modified sequence opt3 from neuraminidase__InfluenzaA__ABW40645

SEQ ID NO: 138222 - RNA, 1410 nt, Artificial Sequence
  derived and/or modified sequence opt3 from neuraminidase__InfluenzaA__ABW40656
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggagguggcaucuggguaacccgcgagcccuaugugucgugcgacccugauaaguguuaccaauucgcgcuagggcagggaacgacucucaauaacguccauucaaaugacaccgugcgagaucguacaccauauagaacucugcuuaugaacgaacugggcguucccuuucacuuggguaccaaacaggugugcauugcuuggagcaguuccucuugucaugacgggaaggccuggcuccacgucugcaucacaggagaugacaagaaugcaaccgccagcuucaucuacaacggcaggcugguggauuccauuguaucauggaguaaagagauacugcggacgcaggaaagcgaguguguuugcaucaauggcacuuguacaguggucaugaccgacgggucugcuuccggaaaggcagauacuaaaauucucuuuaucgaggaagguaagauagugcauacaucaaccuuaagcggcagugcccaacacguggaggaaugcucuugcuauccucgcuacccaggggucagauguguuugcagggacaacuggaagggauccaaccggccgauuguggauaucaauaucaaagaccacagcauuguaucgucuuacguguguuccggccuggucggugacacgccccgcaagaacgauucaaguagcuccucucauugccuugacccuaauaacgaggaagggggacacggcgugaaaggcugggcuuucgaugacgggaaugauguuuggaugggacgaaccaucagcgagaagucaagauuggguuaugagacauuuaaagugauugaaggcuggaguaacccaaaguccaaacugcagauaaauaggcaggucaucguggaccgggggaaccguagcggauacucuggcauuuucucaguagaggguaagaguuguaucaaucgcugcuuuuauguugaacuaaucagagggaggaaggaggaaacugaggugcucuggaccagcaacuccauugucguguucuguggcacaucuggaacuuacggcaccgggucguggcccgauggagccgacauaaaucugaugccuaucuga

SEQ ID NO: 138223 - RNA, 1413 nt, Artificial Sequence; identical to SEQ ID NO: 138087
  derived and/or modified sequence opt3 from neuraminidase__InfluenzaA__ABW40667

SEQ ID NO: 138224 - RNA, 1413 nt, Artificial Sequence; identical to SEQ ID NO: 138072
  derived and/or modified sequence opt3 from neuraminidase__InfluenzaA__ABW40678

SEQ ID NO: 138225 - RNA, 1413 nt, Artificial Sequence; identical to SEQ ID NO: 138081
  derived and/or modified sequence opt3 from neuraminidase__InfluenzaA__ABW71297

SEQ ID NO: 138226 - RNA, 1413 nt, Artificial Sequence; identical to SEQ ID NO: 138087
  derived and/or modified sequence opt3 from neuraminidase__InfluenzaA__ABW71308

SEQ ID NO: 138227 - RNA, 1413 nt, Artificial Sequence; identical to SEQ ID NO: 138046
  derived and/or modified sequence opt3 from neuraminidase__InfluenzaA__ABW71319

SEQ ID NO: 138228 - RNA, 1413 nt, Artificial Sequence; identical to SEQ ID NO: 138046
  derived and/or modified sequence opt3 from neuraminidase__InfluenzaA__ABW71330

SEQ ID NO: 138229 - RNA, 1413 nt, Artificial Sequence
  derived and/or modified sequence opt3 from neuraminidase__InfluenzaA__ABW71341
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacggugaugugugucugccgggauaacuggcacggcucuaaucgccccugggugagcuucaaccagaaucuggacuaccagaucggguauauuugcucaggaguguuuggugauaacccuagaccaaaagacggcaaggggaguuguaauccggucacuguugauggagccgacggcgugaaagguuucuccuacaaguaugggaacggcguauggcugggaaggacaaaaagcaaucggcuccgcaagggcuuugagaugaucugggaccccaacggguggaccgauacugacucugauuucucagugaagcaagacgucguggcuaucacagauuggaguggauacagcgguuccuuuguucagcauccugaauuaaccggccuggacugcauucgaccauguuucuggguggagcuugucagaggguugcccagggaaaauacgaccauauggacaucuggaucgagcaucuccuucugcggcguggauucagacacugccaacuggaguuggccugauggugcagagcugccauuuaccauugacaaauga

SEQ ID NO: 138230 - RNA, 1410 nt, Artificial Sequence; identical to SEQ ID NO: 138073
  derived and/or modified sequence opt3 from neuraminidase__InfluenzaA__ABW71352

SEQ ID NO: 138231 - RNA, 1413 nt, Artificial Sequence; identical to SEQ ID NO: 138087
  derived and/or modified sequence opt3 from neuraminidase__InfluenzaA__ABW71363

SEQ ID NO: 138232 - RNA, 1413 nt, Artificial Sequence; identical to SEQ ID NO: 138072
  derived and/or modified sequence opt3 from neuraminidase__InfluenzaA__ABW71374

SEQ ID NO: 138233 - RNA, 1413 nt, Artificial Sequence; identical to SEQ ID NO: 138046
  derived and/or modified sequence opt3 from neuraminidase__InfluenzaA__ABW71385

SEQ ID NO: 138234 - RNA, 1413 nt, Artificial Sequence
  derived and/or modified sequence opt3 from neuraminidase__InfluenzaA__ABW71396
augaaccccaaucagaagaucauuaccauaggcagcaucuccauugccaucgggauuaucucucugaugcuccaaauaggaaacaucauuucaaucugggcuagucacagcgugcagacagguucccagaaucauacuggcauuugcaaccagagaaucauaacguacgagaauagcaccugggucaaccacacauauguuaauauuaacaauacuaacgugguagcagggaaagacaagaccucggugacacuugccggaaauucaagccuguguaguaucuccggcugggcgauuuacaccaaagauaacucuaucaggaucgguagcaagggggacgucuucgugauucgggaaccuuuuauauccugcucacauuuggagugucgcacuuucuuuuuaacacaaggagcucugcuaaaugauaaacacaguaacggcaccguuaaggaccgaagcccauaucgugcccucaugucuugcccgcugggcgaagcacccuccccuuacaauucaaaguucgagagcguggccuggagugcuucugcaugucaugaugggaugggauggcuuacgaucgguauuuccggcccagacaacggggccgucgcugugcugaaauauaacggaaucauaacugaaaccauuaagagcuggaaaaagagaaucuugaggacacaggagucggagugcguauguguuaauggcucuugcuuuacuaucaugaccgauggucccuccaacggggccgcgucauacaaaauuuucaagaucgaaaagggaaaagugacaaagaguauugagcucaaugcaccuaacuuucacuaugaagaguguagcugcuacccagacaccggcacggucaugugugugugccgggauaauuggcacggcuccaaccgccccugggugucuuucaaucagaaccuggacuaccaggucggguauauaugcagcggaguuuuuggugauaauccuagaccaaaagacggcaaggggucauguaacccgaugacuguggauggagccgacggcguaaaagguuucaguuacaaguaugggaauggcguguggaucggaaggacaaaauccaacaagcugcggaagggcuuugagaugauuugggaccccaauggguggaccgauacugacagcgauuucucugucaaacaagacgugguugcuaucacagauuggucaggauacagugguagcuuugugcagcauccugaacucaccggcuuagacugcauccgcccauguuucugggucgagcuggugcgagggcuucccagagaaaacgccacgauuuggaccuccggaucuucgauaucuuucugcggcguagauuccgacacagcaaauuggucauggccugauggugcugaguugccauuuacuaucgacaaguga

SEQ ID NO: 138235 - RNA, 1413 nt, Artificial Sequence
  derived and/or modified sequence opt3 from neuraminidase__InfluenzaA__ABW71407
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccaggugggguauaucugcagcggagucuuuggugauaauccuagaccaaaagacggcaaggggucauguaacccgaugacuguugauggagccgacggcgugaaagguuucaguuacaaguaugggaauggcguauggauuggaaggacaaaauccaacaagauccggaagggcuuugagaugaucugggaccccaauggguggaccgauacugacagcgauuucucugugaaacaagacgucguggcuauuacagauuggucaggauacagugguagcuuuguucagcauccugaacugaccggccucgacugcauacgcccauguuucuggguggaguuaguccgagggcugcccagagaaaacacgaccaucuggacauccggaucuucgauuagcuucugcggcguggauuccgacacugccaauuggucauggccugauggugcagagcuuccauuuaccaucgacaaguga

SEQ ID NO: 138236 - RNA, 1413 nt, Artificial Sequence; identical to SEQ ID NO: 138072
  derived and/or modified sequence opt3 from neuraminidase__InfluenzaA__ABW71418

SEQ ID NO: 138237 - RNA, 1413 nt, Artificial Sequence; identical to SEQ ID NO: 138046
  derived and/or modified sequence opt3 from neuraminidase__InfluenzaA__ABW71440

SEQ ID NO: 138238 - RNA, 1413 nt, Artificial Sequence; identical to SEQ ID NO: 138046
  derived and/or modified sequence opt3 from neuraminidase__InfluenzaA__ABW71451

SEQ ID NO: 138239 - RNA, 1413 nt, Artificial Sequence; identical to SEQ ID NO: 138081
  derived and/or modified sequence opt3 from neuraminidase__InfluenzaA__ABW71462

SEQ ID NO: 138240 - RNA, 1410 nt, Artificial Sequence; identical to SEQ ID NO: 136343
  derived and/or modified sequence opt3 from neuraminidase__InfluenzaA__ABW80980

SEQ ID NO: 138241 - RNA, 1410 nt, Artificial Sequence; identical to SEQ ID NO: 136187
  derived and/or modified sequence opt3 from neuraminidase__InfluenzaA__ABW80981

SEQ ID NO: 138242 - RNA, 1413 nt, Artificial Sequence
  derived and/or modified sequence opt3 from neuraminidase__InfluenzaA__ABW81474
augaaccccaaucagaagaucauuaccauaggcagcaucuccguggccauugggaucauuucucugauccuccaaauaggaaacaucauuucaaucugggcuagucacagcauucagacagguucccagaauuacacuggcaucugcaaccagaaaauaauuacguaugagaauagaaccugggucaaccaaacauacguuaauuucaacaauacuaacgugguagcagggaaggacaaaccuucuaugacccuugccggaaauucgucacuguguccaaucaggggcugggcgauuuauacaaaggauaacagcauccggaucgguaguaaaggggacguguuugucauucgcgaaccguucauauccugcucucauuuggagugucgaaccuuuuucuuaacucagggagcucugcuaaaugauaagcacagcaacggcacaaucaaggaccguucccccuuuagagcccucaugucaugcccucugggcgaagcaccaagucccuacaauagcagguucgagucuguggccugguccgcuucagcaugucaugaugggcuuggauggcugaccauugguaucagcggcccugacaacggggccguugcuguguugaaauauaacggaauaauuacggaaacuaucaagaguuggaaaaagcagauccuccggacccaggagucugagugcgucugugugaauggcuccugcuuuacaauuaugacugaugguccaagcaaccgcgccgcgucguacagaaucuucaaaauugaaaaggggaggguaaccaagucuauagagcuggacgcacccaauuaucacuacgaagaguguuccugcuacccugauacaggaaccguuaugugugugugccgggacaacuggcauggcucaaaucgcccaugggucaguuuuaaccaaaaucuggauuaucagaucggcuacauuugcagcgggguguucggagacaacccgcgacccaaagauggugagggcuccuguaauccugugacggucgacggggccgacggaguuaagggcuuuucuuauagauacgguaacgggguguggaucggcaggacuaaaagcaaucggcuccguaagggauucgaaaugaucugggauccaaacggcuggacagacaccgauucagacuuuaguaugaaacaggauguaguggcuaugacugacugguccggguauagcggaucuuucguccagcaccccgaguuaacaggucuggauugcaugcgcccuuguuucuggguggaacuuguuagaggcuugccaagggagaauaccacgauuuggaccucagggaguagcauauccuuuugcggagugaacucugaaacagccaauuggucguggcccgacggcgcagagcugccguucacuaucgauaaguga

SEQ ID NO: 138243 - RNA, 1413 nt, Artificial Sequence
  derived and/or modified sequence opt3 from neuraminidase__InfluenzaA__ABW81475
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagucgucaguaacccuugccggaaauagcagucuguguuccauuucuggcugggcgaucuacacaaaagauaacagcaucaggauugguuccaagggggacguguucgucauacgggagccuuuuaucucaugcagucauuuggagugucgcaccuucuuuuuaacucaaggagcucugcuaaaugauaaacacagcaacggcacagugaaggaccgaucuccauaucgugcccucauguccugcccgcugggcgaagcacccucaccuuacaauagcaaguucgagaguguugccuggucugcuuccgcaugucaugaugggaugggauggcuuaccauugguaucagcggcccagacaacggggccguggcuguccugaaauauaacggaauaauuacggaaacuaucaagucguggaaaaagagaaucuugaggacccaggagucugagugcguguguguaaauggcuccugcuuuacaauuaugacugauggucccucaaacggggccgcgaguuacaaaaucuucaagauugaaaagggaaaaguuaccaagagcauagagcucaaugcaccuaacuuucacuaugaagaguguuccugcuacccagacacaggcaccgugaugugugucugccgggauaauuggcacggcucuaaccgccccugggugagcuucaaucagaaccuggacuaccagaucggguauauuugcucaggaguguuuggugauaauccuagaccaaaagacggcgaggggaguuguaacccggucacgguugauggagccgacggcgugaaggguuucuccuacaaauaugggaauggcguauggaucggaaggacuaagagcaaccggcugcgcaaaggcuuugaaaugaucugggaccccaauggguggacagauaccgacucugauuucucacucaagcaagacguggucgcuauuacugauuggaguggauacagcgguuccuuugugcagcauccugaguuaacaggccuggacugcauacgaccauguuucuggguugaacuugugagaggguugcccagggagaacaccacgaucuggaccucuggaucgagcauuuccuucugcggcgucaauucagauacagccaacuggaguuggccugacggugcagaacugccauuuacuaucgauaaguga

SEQ ID NO: 138244 - RNA, 1413 nt, Artificial Sequence
  derived and/or modified sequence opt3 from neuraminidase__InfluenzaA__ABW81477
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggugaaccacacauauguuaauauuaacaauacuaacgugaucgcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagcagaucuugagaacacaggagucggagugcguguguguaaauggcucuugcuuuacuauuaugaccgauggucccuccaacggggccgcgucauacaaaaucuucaagauugaaaagggaaaaguuacaaagaguauagagcucagcgcaccuaauuuucacuaugaagaguguuccugcuacccagacaccggcacggugaugugugucugcagggauaacuggcacggcucuaaucggcccugggugagcuucaaccagaaucuggacuaccaaaucggguauauuugcucaggaguguuuggugauaacccucgcccaaaagacggcgaggggaguuguaauccggucacuguugauggagccaacggcgugaaggguuucuccuacaaauaugggaauggcguauggaucggaagaacaaagagcaacaggcugcggaaaggcuuugaaaugaucugggaccccaauggguggccugacaccgauucugacuucucagugaagcaggaugucguggcuauuacugacuggaguggauacagcgguuccuuuguucagcauccagagcucacaggcuuagauugcauacgccccuguuucuggguggaacugguccgagggcuuccuaaggagaacaccacgaucuggaccucuggaucgagcauuuccuucugcggcgucaauucagacacagccaacuggaguuggccagauggugcagaauugcccuuuacuaucgacaaauga

SEQ ID NO: 138245 - RNA, 1413 nt, Artificial Sequence
  derived and/or modified sequence opt3 from neuraminidase__InfluenzaA__ABW81478
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcgaggggucauguaacccggucacuguugauggagccgacggcgugaaggguuucaguuacaaauaugggaauggcguauggaucggaaggacaaagaacaaucggcugcgcaaaggcuuugaaaugaucugggaccccaacggguggaccgauacugacuccgauuucagcgugaagcaagacgucguggcuauuacagauuggucuggauacucagguaguuuuguucagcauccugagcucaccggcuuagacugcauacgaccauguuucuggguggaacuggucagagggcuucccagggagaauacgaccaucuggacaagcggauccucuauuucguucugcggcgugaacagcgauacugccaacugguccuggccugacggugcagaauugccauuuaccaucgauaaguga

SEQ ID NO: 138246 - RNA, 1413 nt, Artificial Sequence
  derived and/or modified sequence opt3 from neuraminidase__InfluenzaA__ABW81479
augaaccccaaucagaagaucauuaccauaggcagcaucuccguggccauugggaucauuucucugauccuccaaauaggaaacaucauuucaaucugggcuagucacagcauucagacagguucccagaauuacacuggcaucugcaaccagaaaauaauuacguaugagaauagaaccugggucaaccaaacauacguuaauaucaacaauacuaacgugguagcagggaaggacaaaccuucuaugacccuugccggaaauucgucacuguguccaauuaggggcugggcgaucuauacaaaggauaacagcauccggauugguaguaaaggggacguguucgucauacgcgaaccguuuaucuccugcucucauuuggagugucgaaccuucuuuuuaacucagggagcucugcuaaaugauaagcacagcaacggcacaauuaaggaccguucccccuucagagcccucaugucaugcccucugggcgaagcaccaagucccuacaauagcagguuugagucuguggccugguccgcuucagcaugucaugaugggcuuggauggcugaccaucgguauaagcggcccugacaacggggccguugcuguguugaaauauaacggaauuaucacggaaacuaucaagaguuggaaaaagcagauucuccggacccaggagucugagugcgucugugugaauggcuccugcuucacaaucaugacugaugguccaagcaaccgcgccgcgucguacagaauuuuuaaaauagaaaaggggaggguaaccaagucuaucgagcuggacgcacccaauuaucacuacgaagaguguuccugcuacccugauacaggaaccguuaugugugugugccgggacaacuggcauggcucaaaucgcccaugggucaguuucaaccaaaaucuggauuaucagauuggcuacaucugcagcgggguguuuggagacaacccgcgacccaaagauggugagggcuccuguaauccugugacggucgacggggccgacggaaucaagggcuucucuuauagauacgguaacgggguuuggauuggcaggacuaaaagcaaucggcuccguaagggauuugaaaugauaugggauccaaacggcuggacagacaccgauucagacuucaguaugaaacaggaugugguagcuaugacugacugguccggguauagcggaucuuuugugcagcaccccgaguuaacaggucuggauugcaugcgcccuuguuucugggucgaacuugugagaggcuugccaagggagaauaccacgaucuggaccucagggaguagcauuuccuucugcggaguuaacucugaaacagccaauuggucguggcccgacggcgcagagcugccguuuacuaucgauaaguga

SEQ ID NO: 138247 - RNA, 1413 nt, Artificial Sequence; identical to SEQ ID NO: 136412
  derived and/or modified sequence opt3 from neuraminidase__InfluenzaA__ABW81480

SEQ ID NO: 138248 - RNA, 1413 nt, Artificial Sequence
  derived and/or modified sequence opt3 from neuraminidase__InfluenzaA__ABW81481
augaaccccaaucagaagaucauuaccauaggcagcaucuccguggccauugggaucauuucucugauccuccaaauaggaaacaucauuucaaucugggcuagucacagcauucagacagguucccagaauuacacuggcaucugcaaccagaaaauaauuacguaugagaauagaaccugggucaaccaaacauacguuaauaucaacaauacuaacgugguagcagggaaggacaaaccuucuaugacccuugccggaaauucgucacuguguccaauuaggggcugggcgaucuauacaaaggauaacagcauccggauugguaguaaaggggacguguucgucauacgcgaaccguuuaucuccugcucucauuuggagugucgaaccuucuuuuuaacucagggagcucugcuaaaugauaagcacagcaacggcacaauuaaggaccguucccccuucagagcccucaugucaugcccucugggcgaagcaccaagucccuacaauagcagguuugagucuguggccugguccgcuucagcaugucaugaugggcuuggauggcugaccaucgguauaagcggcccugacaacggggccguugcuguguugaaauauaacggaauuaucacggaaacuaucaagaguuggaaaaagcagauucuccggacccaggagucugagugcgucugugugaauggcuccugcuucacaaucaugacugaugguccaagcaaccgcgccgcgucguacagaauuuuuaaaauagaaaaggggaggguaaccaagucuaucgagcuggacgcacccaauuaucacuacgaagaguguuccugcuacccugauacaggaaccguuaugugugugugccgggacaacuggcauggcucaaaucgcccaugggucaguuucaaccaaaaucuggauuaucagauuggcuacaucugcagcgggguguuuggagacaacccgcgacccaaagauggugagggcuccuguaauccugugacggucgacggggccgacggaguuaagggcuucucuuauagauacgguaacgggguguggaucggcaggacuaaaagcaaucggcuccguaagggauuugaaaugauuugggauccaaacggcuggacagacaccgauucagacuucaguaugaaacaggauguaguggcuaugacugacugguccggguauagcggaucuuuuguccagcaccccgaguuaacaggucuggauugcaugcgcccuuguuucuggguggaacuuguuagaggcuugccaagggagaauaccacgauauggaccucagggaguagcaucuccuucugcggagugaacucugaaacagccaauuggucguggcccgacggcgcagagcugccguuuacuauugauaaguga

SEQ ID NO: 138249 - RNA, 1413 nt, Artificial Sequence
  derived and/or modified sequence opt3 from neuraminidase__InfluenzaA__ABW81482
augaaccccaaucagaagaucauuaccauaggcagcaucuccguggccauugggaucauuucucugauccuccaaauaggaaacaucauuucaaucugggcuagucacagcauucagacagguucccagaauuacacuggcaucugcaaccagaaaauaauuacguaugagaauagaaccugggucaaccaaacauacguuaauaucaacaauacuaacgugguagcagggaaggacaaaccuucuaugacccuugccggaaauucgucacuguguccaauuaggggcugggcgaucuauacaaaggauaacagcauccggauugguaguaaaggggacguguucgucauacgcgaaccguuuaucuccugcucucauuuggagugucgaaccuucuuuuuaacucagggagcucugcuaaaugauaagcacagcaacggcacaauuaaggaccguucccccuucagagcccucaugucaugcccucugggcgaagcaccaagucccuacaauagcagguuugagucuguggccugguccgcuucagcaugucaugaugggcuuggauggcugaccaucgguauaagcggcccugacaacggggccguugcuguguugaaauauaacggaauuaucacggaaacuaucaagaguuggaaaaagcagauucuccggacccaggagucugagugcgucugugugaauggcuccugcuucacaaucaugacugaugguccaagcaaccgcgccgcgucguacagaauuuuuaaaauagaaaaggggaggguaaccaagucuaucgagcuggacgcacccaauuaucacuacgaagaguguuccugcuacccugauacaggaaccguuaugugugugugccgggacaacuggcauggcucaaaucgcccaugggucaguuucaaccaaaaucuggauuaucagauuggcuacaucugcagcgggguguuuggagacaacccgcgacccaaagauggugagggcuccuguaauccugugacggucgacggggccgacggaguuaagggcuucucuuauagauacgguaacgggguguggaucggcaggacuaaaagcaaucggcuccguaagggauuugaaaugauuugggauccaaacggcuggacagacaccgauucagacuucaguaugaaacaggauguaguggcuaugacugacugguccggguauagcggaucuuuuguccagcaccccgaguuaacaggucuggccugcaugcgcccuuguuucuggguggaacuuguuagaggcuugccaagggagaauaccacgauauggaccucagggaguagcaucuccuucugcggagugaacucugaaacagcaaauuggucguggcccgauggcgcugagcugccguuuacuauugacaaguga

SEQ ID NO: 138250 - RNA, 1413 nt, Artificial Sequence; identical to SEQ ID NO: 136402
  derived and/or modified sequence opt3 from neuraminidase__InfluenzaA__ABW81483

SEQ ID NO: 138251 - RNA, 1413 nt, Artificial Sequence
  derived and/or modified sequence opt3 from neuraminidase__InfluenzaA__ABW81484
augaaccccaaucagaagaucauuaccauaggcagcaucuccauugccaucgggauuaucucucugaugcuccaaauaggaaacaucauuucaaucugggcuagucacagcauucagacagguaaucagaaccauacuggcaucugcaaucagagaauaauuacguacgagaacuccaccugggugaaucacacauaugucaacaucaauaacacuaauguuguggcagggaaaggaaagaccucuguaacacuugccggcaacucgucacuguguagcauuagugguugggcgaucuacaccaaagacaauuccaucaggauugggucuaagggagauguguucgucauacgggaaccuuuuaucagcugcucccauuuggagugucgcacuuucuuuuuaacacaaggcgcucugcuaaacgacaaacacucaaauggcaccgugaaggaucgaaguccauaucgugcccucaugagcugcccgcugggggaagcacccucuccuuacaacuccaaguucgagucaguugccuggagcgcuagugcaugucaugacggaauggguuggcuuacgauuggcaucucugggccagauaacggagccguggcuguccugaaauauaauggcauaauuacugaaaccaucaaguccuggaaaaagagaaucuugaggacacaggagagcgagugcguguguguaaacgguucgugcuuuacuauuaugaccgacgggcccucuaauggagccgcguccuacaaaaucuucaagauugaaaagggcaaaguuacaaagucaauagagcucaacgcaccuaauuuucacuaugaagaguguaguugcuacccagauaccggcacggugaugugugucugccgggacaacuggcacgggagcaaucgccccuggguguccuucaaccagaaucuggauuaccagaucggauauauuugcucugguguguuuggcgacaacccuagaccaaaagaugggaagggaagcuguaauccggucacuguugacggcgccgauggugugaaaggguucucauacaaguauggcaacggaguauggaucggcaggacaaaaaguaaucggcugcgcaagggguuugagaugaucugggaccccaacggauggaccgacacugauuccgacuucagcgugaagcaagaugucguggcuauuacagacuggucugguuacucaggcaguuuuguucagcauccugaacucaccggguuagauugcauacgaccauguuucuggguggagcuggucagaggacuucccagggaaaauacgaccaucuggacaagcggcuccucuauuucguucugcgguguggacagcgauacugccaacugguccuggccugacggggcagaguugccauuuaccaucgauaaauga

SEQ ID NO: 138252 - RNA, 1413 nt, Artificial Sequence
  derived and/or modified sequence opt3 from neuraminidase__InfluenzaA__ABW81487
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcaaggggucauguaacccggucacuguugauggagccgacggcgugaaagguuucaguuacaaguaugggaauggcguauggaucggaaggacaaaauccaaccggcugcgcaagggcuuugagaugaucugggaccccaauggguggaccgauacugacagcgauuucucugugaagcaagacgucguggcuauuacagauuggucaggauacagugguagcuuuauacagcauccugaacucaccggcuuagacugcauccgaccauguuucuggguugagcuggugagagggcuucccagggaaaacacgaccauuuggacauccggaucuucgaucagcuucugcggcgucgauuccgacacugccaauuggucauggccugauggugcagaguugccauuuaccauugacaaauga

SEQ ID NO: 138253 - RNA, 1413 nt, Artificial Sequence; identical to SEQ ID NO: 136402
  derived and/or modified sequence opt3 from neuraminidase__InfluenzaA__ABW81488

SEQ ID NO: 138254 - RNA, 1413 nt, Artificial Sequence; identical to SEQ ID NO: 136402
  derived and/or modified sequence opt3 from neuraminidase__InfluenzaA__ABW81489

SEQ ID NO: 138255 - RNA, 1413 nt, Artificial Sequence
  derived and/or modified sequence opt3 from neuraminidase__InfluenzaA__ABW81490
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggaguguaaaacuuucuuuuuaacacaaggagcucugcuaaaugauaagcacaguaacggcaccgugaaggaccgcagcccauaucgagcccucaugucuugcccgcugggcgaagcacccuccccuuacaauucaaaauucgagagcguugccuggagugcuucugcaugucaugaugggaugggauggcuuacgauugguaucuccggcccagacaacggggccguggcuguccugaaguauaacggaauaauuacugaaaccaucaaaagcuggaagaaacguaucuugagaacacaggagucggagugcguguguguaaauggcucuugcuuuacuauuaugaccgauggucccuccaacggggccgcgucauacaagaucuucaagauugaaaaaggaaagguuacaaaaaguauagagcucaaugcaccuaacuuucacuaugaagaguguagcugcuacccagacaccggcacggugaugugugucugcagggauaauuggcacggcuccaaccggcccugggugucuuucaaucagaaccuggacuaccagaucggguauauuugcagcggaguguuuggugauaauccucgcccaaaggacggcaaagggucauguaacccggucacuguugauggagccgacggcgugaaggguuucaguuacaaauaugggaauggcguauggaucggaagaacaaaguccaacaggcugcggaagggcuuugagaugaucugggaccccaauggguggaccgauacugacagcgauuucucugugaaacaagacgucguggcuauuacagauuggucaggauacagugguagcuuuguucagcauccugaacucaccggcuuagacugcauacgcccauguuucuggguggagcugguccgagggcuucccagagaaaacacgaccaucuggacauccggaucuucgauuagcuucugcggcguggauuccgacacugccaauuggucauggccugauggugcagaguugccauuuaccaucgacaaguga

SEQ ID NO: 138256 - RNA, 1413 nt, Artificial Sequence
  derived and/or modified sequence opt3 from neuraminidase__InfluenzaA__ABW81491
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcugggagaaaagaaucuugaggacacaggagucggaaugcguguguguaaauggcucuugcuuuacuauuaugaccgauggucccuccaacggggccgcgucauacaagaucuucaaaauugagaagggaaagguuacaaaaaguauagaacucaaugcaccuaacuuucacuaugaggaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaggacggcaaagggucauguaacccggucacuguugauggagccgacggcgugaaggguuucaguuacaaauaugggaauggcguauggaucggaaggacaaaguccaaccggcugcgcaaaggcuuugaaaugaucugggaccccaauggguggaccgauacugacagcgauuucucugugaagcaagacgucguggcuauuacagauuggucaggauacagugguagcuuuguucagcauccugagcucaccggcuuagacugcauacgaccauguuucuggguggaacuggucagagggcuucccagggagaacacgaccaucuggacauccggaucuucgauuagcuucugcggcguggauuccgacacugccaauuggucauggccugauggugcagaauugccauuuaccaucgacaaguga

SEQ ID NO: 138257 - RNA, 1413 nt, Artificial Sequence
  derived and/or modified sequence opt3 from neuraminidase__InfluenzaA__ABW81492
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcaaggggucauguaacccggucacuguugauggagccgacggcgugaaagguuucaguuacaaguaugggaauggcguauggaucggaaggacaaaauccaaccggcugcgcaagggcuuugagaugaucugggaccccaauggguggaccgauacugacagcgauuucucugugaagcaagacgucguggcuauuacagauuggucaggauacagugguagcuuuguucagcauccugaacucaccggcuuagacugcauacgaccauguuucuggguggagcuggucagagggcuucccagggaaaacacgaccaucugggccuccggaucuucgauuagcuucugcggcguggauuccgacacagcaaauuggucauggccugauggugcugaguugccauuuacuaucgacaaauga

SEQ ID NO: 138258 - RNA, 1413 nt, Artificial Sequence; identical to SEQ ID NO: 136402
  derived and/or modified sequence opt3 from neuraminidase__InfluenzaA__ABW81493

SEQ ID NO: 138259 - RNA, 1413 nt, Artificial Sequence; identical to SEQ ID NO: 136402
  derived and/or modified sequence opt3 from neuraminidase__InfluenzaA__ABW81494

SEQ ID NO: 138260 - RNA, 1413 nt, Artificial Sequence; identical to SEQ ID NO: 136402
  derived and/or modified sequence opt3 from neuraminidase__InfluenzaA__ABW81495

SEQ ID NO: 138261 - RNA, 1413 nt, Artificial Sequence; identical to SEQ ID NO: 138256
  derived and/or modified sequence opt3 from neuraminidase__InfluenzaA__ABW81497

SEQ ID NO: 138262 - RNA, 1413 nt, Artificial Sequence
  derived and/or modified sequence opt3 from neuraminidase__InfluenzaA__ABW81498
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcugggagaaaagaaucuugaggacacaggagucggaaugcguguguguaaauggcucuugcuuuacuauuaugaccgauggucccuccaacggggccgcgucauacaagaucuucaaaauugagaagggaaagguuacaaaaaguauagaacucaaugcaccuaacuuucacuaugaggaguguagcugcuacccagacaccggcacggugaugugugucugccgggauaauuggcacggcuccaaccgccccugggugucuuucaaucagaaccuggacuaccaggugggguauaucugcagcggagucuuuggugauaauccuagaccaaaggacggcaaagggucauguaacccgguuacuguggauggagccgacggcguaaaggguuucaguuacaaauaugggaauggcguguggauuggaaggacaaaguccaaccggcugcgcaaaggcuuugaaaugaucugggaccccaauggguggaccgauacugacagcgauuucucugucaagcaagacgugguugcuaucacagauuggucaggauacagugguagcuuugugcagcauccugagcucaccggcuuagacugcauucgaccauguuucugggucgaacuggugagagggcuucccagggagaacacgaccauauggacauccggaucuucgaucagcuucugcggcguagauuccgacacugccaauuggucauggccugauggugcagaauugccauuuaccauugacaaguga

SEQ ID NO: 138263 - RNA, 1413 nt, Artificial Sequence
  derived and/or modified sequence opt3 from neuraminidase__InfluenzaA__ABW81499
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggagggacaaaaccucgguaacacuugccggaaauucaagccuguguaguauuuccggcugggcgaucuacaccaaggauaacucuauccggauugguagcaaaggggacguguucgucauacgcgagccuuuuaucuccugcucacauuuggagugucgaacuuucuuuuuaacacaaggagcucugcuaaaugauaagcacaguaacggcaccgugaaagaccguagcccauauagagcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaguauaacggaauaauuacugaaaccaucaaaagcuggaagaaaaggaucuugcggacacaggagucggagugcguguguguaaauggcucuugcuuuacuauuaugaccgauggucccuccaacggggccgcgucauacaagaucuucaaaauugaaaagggaaagguuacaaaaaguauagagcucaaugcaccuaacuuucacuaugaagaguguagcugcuacccagacaccggcacggugaugugugucugccgcgauaauuggcacggcuccaacagacccugggugucuuucaaucagaaccuggacuaccagaucggguauauuugcagcggaguguuuggugauaauccuaggccaaaggacggcaaagggucauguaacccggucacuguugauggagccgacggcgugaaggguuucaguuacaaauaugggaauggcguauggaucggacggacaaaguccaaccgccugcgaaaaggcuuugagaugaucugggaccccaauggguggaccgauacugacagcgauuucucugugaagcaagacgucguggcuauuacagauuggucaggauacagugguagcuuuguucagcauccugaacucaccggcuuagacugcauaagaccauguuucuggguggagcuggucagggggcuuccccgggaaaacacgaccaucuggacauccggaucuucgauuagcuucugcggcguggauuccgacacugccaauuggucauggccugauggugcagaguugccauuuaccaucgacaaguga

SEQ ID NO: 138264 - RNA, 1413 nt, Artificial Sequence
  derived and/or modified sequence opt3 from neuraminidase__InfluenzaA__ABW81500
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaagacggcaaggggucauguaacccggucacugccgauggagcugacggcguuaaagguuucaguuacaaguaugggaauggcguguggaucggaaggacaaaauccaaccggcugcgcaagggcuuugagaugaucugggaccccaauggguggaccgauacugacagcgauuucucuguaaagcaagacguggucgccauuacagauuggucaggauacagugguagcuuugugcagcauccugaacucaccggcuuagacugcauacgaccauguuucuggguugagcuggugagagggcuucccagggaaaacacgaccaucuggacauccggaucuucgauuagcuucugcggcgucgauuccgacacugcaaauuggucauggccugauggugcugaguugccauuuaccaucgacaaauga

SEQ ID NO: 138265 - RNA, 1413 nt, Artificial Sequence
  derived and/or modified sequence opt3 from neuraminidase__InfluenzaA__ABW81501
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagaaaauaauuacguacgaaaauucuaccugggugaaccacacauaugucaauaucaacaauacuaacguuguggcagggaaggacaaaaccucgguaacacuugccggaaauucaagccuguguaguguguccggcugggcgauuuacaccaaggauaacucuaucagaaucgguagcaaaggggacgucuucgugauuagggagccuuuuauauccugcucacauuuggagugucggacuuucuuuuuaacacaaggagcucugcuaaaugauaagcacaguaacggcaccguuaaggaccgcagcccauaucgagcccucaugucuugcccgcugggcgaagcacccuccccuuacaauucaaaauucgagagcguggccuggagugcuucugcaugucaugaugggaugggauggcuuacgaucgguauuuccggcccagacaacggggccgucgcugugcugaaguauaacggaaucauaacugaaaccauuaaaagcuggaagaaacguaucuugagaacacaggagucggagugcguauguguuaauggcucuugcuuuacuaucaugaccgauggucccuccaacggggccgcgucauacaagauuuucaagaucgaaaaaggaaaggugacaaaaaguauugagcucaaugcaccuaacuuucacuaugaagaguguagcugcuacccagacaccggcacggucaugugugugugcagggauaauuggcacggcuccaaccggcccugggugucuuucaaucagaaccuggacuaccagauaggguauaucugcagcggagucuuuggugauaauccucgcccaaaggacggcaaagggucauguaacccgguuacuguggauggagccgacggcguaaaggguuucaguuacaaauaugggaauggcguguggauuggaagaacaaaguccaacaggcugcggaagggcuuugagaugaucugggaccccaauggguggaccgauacugacagcgauuucucugucaaacaagacgugguugcuaucacagauuggucaggauacagugguagcuuugugcagcauccugaacucaccggcuuagacugcauucgcccauguuucugggucgagcuggugcgagggcuucccagagaaaacacgaccauauggacauccggaucuucgaucagcuucugcggcguagauuccgacacugccaauuggucauggccugauggugcagaguugccauuuaccauugacaaguga

SEQ ID NO: 138266 - RNA, 1413 nt, Artificial Sequence; identical to SEQ ID NO: 138087
  derived and/or modified sequence opt3 from neuraminidase__InfluenzaA__ABW86324

SEQ ID NO: 138267 - RNA, 1413 nt, Artificial Sequence; identical to SEQ ID NO: 138059
  derived and/or modified sequence opt3 from neuraminidase__InfluenzaA__ABW86335

SEQ ID NO: 138268 - RNA, 1413 nt, Artificial Sequence; identical to SEQ ID NO: 138046
  derived and/or modified sequence opt3 from neuraminidase__InfluenzaA__ABW86346

SEQ ID NO: 138269 - RNA, 1413 nt, Artificial Sequence; identical to SEQ ID NO: 138046
  derived and/or modified sequence opt3 from neuraminidase__InfluenzaA__ABW86357

SEQ ID NO: 138270 - RNA, 1413 nt, Artificial Sequence; identical to SEQ ID NO: 138046
  derived and/or modified sequence opt3 from neuraminidase__InfluenzaA__ABW86368

SEQ ID NO: 138271 - RNA, 1413 nt, Artificial Sequence; identical to SEQ ID NO: 138072
  derived and/or modified sequence opt3 from neuraminidase__InfluenzaA__ABW86379

SEQ ID NO: 138272 - RNA, 1413 nt, Artificial Sequence; identical to SEQ ID NO: 138046
  derived and/or modified sequence opt3 from neuraminidase__InfluenzaA__ABW86390

SEQ ID NO: 138273 - RNA, 1413 nt, Artificial Sequence; identical to SEQ ID NO: 138087
  derived and/or modified sequence opt3 from neuraminidase__InfluenzaA__ABW86401

SEQ ID NO: 138274 - RNA, 1413 nt, Artificial Sequence; identical to SEQ ID NO: 138046
  derived and/or modified sequence opt3 from neuraminidase__InfluenzaA__ABW86412

SEQ ID NO: 138275 - RNA, 1413 nt, Artificial Sequence
  derived and/or modified sequence opt3 from neuraminidase__InfluenzaA__ABW86423
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuugccauuaugacugauggucccuccaacggggcggcaucauacaaaaucuucaagauugaaaagggaaaaguuaccaagaguauagagcucaaugccccuaacuuucacuaugaagaguguagcugcuacccagacacaggcaccgugaugugugucugccgggauaauuggcacggcuccaaccgccccugggugucuuucaaucagaaccuggacuaccaggugggguauaucugcagcggagucuuuggugauaauccuagaccaaaagacggcaaggggucauguaacccgaugacgguugauggagcugacggcgugaaagguuucaguuacaaguaugggaauggcguauggauuggaaggacuaaauccaacaagcugcggaagggcuuugagaugaucugggaccccaauggguggacagauaccgacagcgauuucucugugaaacaagacgucguggccaucacugauuggucaggauacagugguagcuuuguucagcauccugaacucacaggcuuagacugcauucgcccauguuucuggguggagcugguccgagggcuucccagagaaaacaccacgauauggaccuccggaucuucgaucagcuucugcggcguggauuccgacacagcaaauuggucauggccugauggugcugaguugccauuuacuauugacaaguga

SEQ ID NO: 138276 - RNA, 1413 nt, Artificial Sequence; identical to SEQ ID NO: 138046
  derived and/or modified sequence opt3 from neuraminidase__InfluenzaA__ABW86434

SEQ ID NO: 138277 - RNA, 1413 nt, Artificial Sequence; identical to SEQ ID NO: 138046
  derived and/or modified sequence opt3 from neuraminidase__InfluenzaA__ABW86445

SEQ ID NO: 138278 - RNA, 1413 nt, Artificial Sequence; identical to SEQ ID NO: 138081
  derived and/or modified sequence opt3 from neuraminidase__InfluenzaA__ABW86456

SEQ ID NO: 138279 - RNA, 1413 nt, Artificial Sequence
  derived and/or modified sequence opt3 from neuraminidase__InfluenzaA__ABW86467
augaacaccaaucagaagaucauuacaauaggcagcaucuccauugccaucgggauuaucucucugaugcuccaaauaggaaacaucauuucaaucugggcuagucacagcauucagacugguucccagaaucauacgggcaucugcaaccagagaauaauuaccuacgaaaauucuacaugggugaaccacacuuaugucucgaucaauaacaccaauguuguggcagggaaagacaagacaucaguaacccuugccggaaacagcagucuguguuccauuucuggcugggcgaucuacacuaaagauaauagcaucaggauugguuccaagggggacguguucgucauacgggagcccuuuaucucaugcagucauuuggagugucgcacauucuuuuuaacccaaggagcucugcuaaacgauaaacacagcaauggcacggugaaggaccgaucuccuuaucgugcccucauguccugcccacugggcgaagcaccgucacccuacaacagcaaguucgagaguguugccuggucugcuuccgcaugucaugaugggaugggauggcuuacuauugguaucagcggcccugacaauggggccguggcuguccugaaauauaacggaauaauuaccgaaacaaucaagucguggaaaaagagaaucuugaggacucaggagucugagugcguguguguaaacggcuccugcuuuaccauuaugacagaugguccaucaaauggggccgcgaguuacaaaaucuucaagauugaaaagggaaaaguuaccaagagcauagagcucaacgcacccaauuuucacuaugaagaguguuccugcuacccugacacgggcacugugaugugugucugccgggauaacuggcacggcucuaaucgcccaugggugagcuucaaccagaaucuggacuaccagaucggguauauuugcucaggaguguuuggugauaaccccagaccuaaagacggcaaggggaguuguaauccagucacaguugauggagccgacggcgugaaagguuucuccuacaaguaugggaacggcguauggaucggaaggaccaaaagcaaucggcugcgcaagggcuuugagaugaucugggacccgaacggguggacugauacagacucugauuucucaauuaagcaagacguggucgcuauaaccgauuggaguggauacagcgguuccuuugugcagcaucccgaacucacgggcuuagacugcauccgaccuuguuucuggguugagcuggugagagggcuuccaagggaaaauaccacaauuuggacuucuggaucgagcaucuccuucugcggcgucgauucagacaccgccaacuggaguuggcccgauggugcagaguugccuuuuacaauugacaaauga

SEQ ID NO: 138280 - RNA, 1413 nt, Artificial Sequence; identical to SEQ ID NO: 138081
  derived and/or modified sequence opt3 from neuraminidase__InfluenzaA__ABW86478

SEQ ID NO: 138281 - RNA, 1413 nt, Artificial Sequence
  derived and/or modified sequence opt3 from neuraminidase__InfluenzaA__ABW86489
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacggugaugugugucugccgggauaacuggcacggcucuaaucgccccugggugagcuucaaccagaaucuggacuaccagaucggguauauuugcucaggaguguuuggugauaacccuagaccaaaagacggcaaggggaguuguaauccggucacuguugauggagccgacggcgugaaagguuucuccuacaaguaugggaacggcguauggaucggaaggacaaaaagcaaucggcugcgcaagggcuuugagaugaucugggaccccaacggguggaccgauacugacucugauuucucagugaagcaagacgucgugggaauuacagauuggagugguuacagcggcuccuuuguucagcauccugaacucaccggguuagacugcauacgaccauguuucuggguggagcuggucagaggacuucccagggaaaauacgaccaucuggacaucuggcucgagcauuuccuucugcgguguggauucagacacugcuaacuggaguuggccugauggggccgaguugccauuuaccaucgacaaauga

SEQ ID NO: 138282 - RNA, 1413 nt, Artificial Sequence
  derived and/or modified sequence opt3 from neuraminidase__InfluenzaA__ABW86500
augaaccccaaucagaagaucaugaccauuggcagcauauccaucgccauugggaucauuucucugaugcuccaaaucggaaacauaaucucaauuugggcuagucacagcauccagacagguucccagaaucauacuggcauuugcaaccagagaaucauaacguacgaaaauucuaccugggugaaccacacauaugucaauauuaacaauacuaacguuguggcagggaaagacaagaccucgguaacacuugccggaaauucaagccuguguaguaucuccggcugggcgauuuacaccaaagauaacucuaucaggaucgguagcaagggggacguguucgucauucgggagccuuuuauauccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgaucgguauuuccggcccagacaacggggccguggcuguccugaaauauaacggaaucauaacugaaaccauuaagagcuggaaaaagagaaucuugaggacacaggagucggagugcguguguguaaauggcucuugcuuuacuaucaugaccgauggucccuccaacggggccgcgucauacaaaauuuucaagaucgaaaagggaaaaguuacaaagaguauugagcucaaugcaccuaacuuucacuaugaagaguguagcugcuacccagacaccggcacggugaugugugucugccgggauaauuggcacggcuccaaccgccccugggugucuuucaaucagaaccuggacuaccagauaggguauaucugcagcggaguguuuggugauaauccuagaccaaaagacggcaaggggucauguaacccggucacuguugauggagccgacggcgugaaagguuucaguuacaaguaugggaauggcguauggauuggaaggacaaaauccaaccggcugcgcaagggcuuugagaugaucugggaccccaauggguggaccaacacugauagcgacuucucuaugaagcaagauguggucgcuaucacagacuggucaggauacagugguagcuuugugcagcauccugaacucaccggcuuagauugcauucgaccauguuucuggguugagcuggugagagggcuucccagggaaaauacgaccauauggacauccggaucuucgaucagcuucugcggcgucgacuccgauacugccaacuggucauggccugacggugcagaguugccauuuaccauugauaaauga

SEQ ID NO: 138283 - RNA, 1413 nt, Artificial Sequence; identical to SEQ ID NO: 138046
  derived and/or modified sequence opt3 from neuraminidase__InfluenzaA__ABW86511

SEQ ID NO: 138284 - RNA, 1413 nt, Artificial Sequence
  derived and/or modified sequence opt3 from neuraminidase__InfluenzaA__ABW86522
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgagaauagcaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggaaccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccaggugggguauaucugcagcggagucuuuggugauaauccuagaccaaaagacggcaaggggucauguaacccgaugacuguugauggagccgacggcgugaaagguuucaguuacaaguaugggaauggcguauggauuggaaggacaaaauccaacaagcugcggaagggcuuugagaugaucugggaccccaauggguggaccgauacugacagcgauuucucugugaaacaagacgucguggcuguuacagauuggucaggauacagugguagcuuugugcagcauccugaacucaccggcuuagacugcauccgcccauguuucugggucgagcuggugcgagggcuucccagagaaaacgccacgauuuggaccuccggaucuucgauaucuuucugcggcguagauuccgacacagcaaauuggucauggccugauggugcugaguugccauuuacuaucgacaaguga

SEQ ID NO: 138285 - RNA, 1413 nt, Artificial Sequence; identical to SEQ ID NO: 138046
  derived and/or modified sequence opt3 from neuraminidase__InfluenzaA__ABW86533

SEQ ID NO: 138286 - RNA, 1413 nt, Artificial Sequence; identical to SEQ ID NO: 138081
  derived and/or modified sequence opt3 from neuraminidase__InfluenzaA__ABW86544

SEQ ID NO: 138287 - RNA, 1413 nt, Artificial Sequence; identical to SEQ ID NO: 138046
  derived and/or modified sequence opt3 from neuraminidase__InfluenzaA__ABW86555

SEQ ID NO: 138288 - RNA, 1410 nt, Artificial Sequence
  derived and/or modified sequence opt3 from neuraminidase__InfluenzaA__ABW86566
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccgugaucgagagaaauauaacagaaaucguauauuugaccaacacuacaauugagaaggaaaucugccccaaauuagcugaguacaggaauuggaguaagccucagugugacauuaccggguucgcaccauuuagcaaagauaacuccauccggcugucugccggaggugacauaugggugacgcgcgagcccuaugucucgugcgauccugacaaguguuaccaauucgcgcuaggccaggggacuacccucaauaacgugcauucaaaugauacaguucgagaccguacuccauauagaacccugcuuaugaacgaacugggagugcccuuucacuugggcacaaagcaggucugcauugcuuggagcaguuccucuugucaugaugguaaagccuggcuccacgugugcaucaccggggacgauaagaaugcaacggccagcuucauuuacaacggaaggcugguagacuccaucguuucauggaguaaagagauccugcggacucaggaaagcgagugugugugcauuaauggcacauguaccgucgugaugacugauggcucugcuuccgggaaggcagacacaaaaauacucuuuaucgaggaaggaaagauugugcauaccucaacguuaagcgguagugcccaacacgucgaggaaugcucuugcuauccucgcuacccaggcguuagaugugugugcagggauaacuggaagggguccaaccggccgaucguagacauaaauauuaaagaccacagcaucgugucgucuuacgucuguuccggacuggugggcgauacccccaggaagaacgacucaaguagcuccucucauugccuugauccuaauaacgaggaaggugggcacggaguuaaaggcugggcuuucgacgauggcaaugacguguggauggggcgaacaaucagcgagaagucaagauugggauaugagacuuuuaaagucauugaagguuggaguaacccaaaguccaaacugcagaucaaucgccaggugauuguagaucggggcaaccguagcggguacucuggaauauucucaguugagggcaagaguuguaucaaucgcugcuuuuauguggaacuaauuagagguaggaaggaggaaaccgagguccucuggacaagcaacuccaucguggucuucugugggacuucuggcaccuacggaacaggcucguggcccgacggggccgauaucaaucugaugccuauuuga

SEQ ID NO: 138289 - RNA, 1413 nt, Artificial Sequence; identical to SEQ ID NO: 138072
  derived and/or modified sequence opt3 from neuraminidase__InfluenzaA__ABW86609

SEQ ID NO: 138290 - RNA, 1413 nt, Artificial Sequence; identical to SEQ ID NO: 137075
  derived and/or modified sequence opt3 from neuraminidase__InfluenzaA__ABW91188

SEQ ID NO: 138291 - RNA, 1410 nt, Artificial Sequence
  derived and/or modified sequence opt3 from neuraminidase__InfluenzaA__ABW91210
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuauacugugugaaccgacuaucauugagagaaauaucaccgaaauuguguauuugacaaacaccacuaucgagaaggaaauaugccccaaauuagcugaguacaggaauuggaguaagccucagugugacauuacaggguucgcaccauuuagcaaagauaacuccauccggcugucugccggaggugacauuuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcaucgcuuggagcaguuccucuugucaugaugguaaggccuggcuccacgucugcaucacaggggacgauaagaaugcaaccgccagcuucauuuacaacggaaggcugguggacuccauaguaucauggaguaaagagauccugcggacgcaggaaagcgaguguguuugcauuaauggcacuuguacaguggucaugaccgauggcucugcuuccgggaaggcagacacuaaaauccucuuuauagaggaaggaaagauugugcauacaucaaccuuaagcgguagugcccaacacguggaggaaugcucuugcuauccucgcuacccaggcgucagauguguuugcagggauaacuggaagggguccaaccggccgaucguggacaucaauauuaaagaccacagcaucguaucgucuuacguguguuccggacuggucggcgauacgccccgcaagaacgacucaaguagcuccucucauugccuugauccuaauaacgaggaaggugggcacggagugaaaggcugggcuuucgacgauggcaaugacguuuggauggggcgaaccauuagcgagaagucaagauugggauaugagacauuuaaagugauagaagguuggaguaacccaaaguccaaacugcagaucaauaggcaggucauuguggaucggggcaaccguagcggguacucuggaaucuucucaguagagggcaagaguuguaucaaucgcugcuuuuauguugaacuaauuagagguaggaaggaggaaacugaggugcucuggaccagcaacuccauagucguguucugugggacaucuggcacuuacggaaccggcucguggcccgacggggccgauaucaaucugaugccuauuuga

SEQ ID NO: 138292 - RNA, 1413 nt, Artificial Sequence; identical to SEQ ID NO: 138046
  derived and/or modified sequence opt3 from neuraminidase__InfluenzaA__ABW91221

SEQ ID NO: 138293 - RNA, 1410 nt, Artificial Sequence
  derived and/or modified sequence opt3 from neuraminidase__InfluenzaA__ABW91232
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaaguacuauaaucgagagaaauauuaccgaaaucguguauuugacaaacaccacuauugagaaggaaaucugcccgaaauuagcugaguacaggaauuggagcaagccccagugugacauaacaggguucgcaccuuuuuccaaagauaacucuauucggcugucggccggaggugacaucuggguaacccgcgagccauaugugucaugcgaucccgacaaguguuaccaauucgcgcuaggccaggggacgacucucaauaacguccauagcaaugauaccgugcgagaccguacaccuuauagaacucugcuuaugaacgaacugggaguuccauuucacuugggcaccaaacaggugugcauugcuuggaguuccucuagcugucaugaugguaaggccuggcuccacgucugcaucacaggggacgauaagaaugcaaccgccuccuucaucuacaacggaaggcugguggacucaauuguaaguuggagcaaagagauacugcggacgcaggaaucugaguguguuugcaucaauggcacuuguacaguggucaugaccgauggcuccgcuucagggaaggcagacacuaaaauucucuuuaucgaggaaggaaagauagugcauacaagcaccuuaagugguucugcccaacacguggaggaaugcuccugcuauccccgcuacccuggcgucagauguguuugcagggauaacuggaaggggagcaaccggccaauuguggacaucaauaucaaagaccacucgauuguaucuuccuacguguguucaggacuggucggcgauacgccgcgcaagaacgacaguagcuccucuggucauugccuugaucccaauaacgaggaagggggacacggcgugaaaggcugggcuuucgacgaugggaaugacguuuggaugggacgaaccaucagcgagaagucaagauuggguuaugagacauuuaaagugauugaaggcuggaguaacccuaaguccaaacugcagauaaauaggcaggucaucguggaucgggggaaccguagcggauacucuggcauuuucucaguagaggguaagaguuguaucaaucgcugcuuuuauguugaacuaaucagagggaggaaggaggaaacugaggugcucuggaccagcaacuccauugucguguucuguggcacaucuggaacuuacggcaccgggucguggccagacggagccgauauaaaucugaugcccaucuga

SEQ ID NO: 138294 - RNA, 1410 nt, Artificial Sequence; identical to SEQ ID NO: 138082
  derived and/or modified sequence opt3 from neuraminidase__InfluenzaA__ABW91243

SEQ ID NO: 138295 - RNA, 1410 nt, Artificial Sequence; identical to SEQ ID NO: 137900
  derived and/or modified sequence opt3 from neuraminidase__InfluenzaA__ABW91254

SEQ ID NO: 138296 - RNA, 1410 nt, Artificial Sequence; identical to SEQ ID NO: 137900
  derived and/or modified sequence opt3 from neuraminidase__InfluenzaA__ABW91265

SEQ ID NO: 138297 - RNA, 1413 nt, Artificial Sequence; identical to SEQ ID NO: 138046
  derived and/or modified sequence opt3 from neuraminidase__InfluenzaA__ABW91276

SEQ ID NO: 138298 - RNA, 1413 nt, Artificial Sequence
  derived and/or modified sequence opt3 from neuraminidase__InfluenzaA__ABW91287
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaacaauacauaugucaacauuaauaacacuaauguuguggcagagaaagacaagaccucgguaacacuugccgggaacucaagccuguguaguaucuccggaugggcgaucuacaccaaagauaauucuauuaggauaggcagcaagggugacaucuucgugauucgggagccuuuuaucuccugcucacacuuggaaugucgcacuuucuuuuuaacacaaggggcucugcuaaacgauaaacauaguaauggaaccgucaaggaccgaagcccauaucgugcccucaugucuugcccgcugggcgaggcacccuccccuuacaacucaagauucgaaagcguggccuggagugcuucugcaugucacgauggcaugggguggcuuacgauaggaauuuccgguccagacaacggcgccguugcugugcugaaguauaaugggaucaucacugagaccauuaaaagcuggaagaaaaggaucuugcggacacaggagucggaaugcgucuguaugaacggaucuugcuuuacuauuaugaccgauggccccuccaauggugccgcgucauacaagauauucaaaaucgagaaggggaaggugacaaaaaccauugaacucaacgcaccuaauuuucauuaugaggaguguaguugcuacccagacacgggaacuguaauguguguuugccgcgauaacuggcacggcagcaauagacccuggguguccuucaaccagaaucuggacuaccagaucggcuauaucugcucuggggucuuuggagauaacccuaggccaaaggacggugaaggcagcuguaauccggugacaguggauggggccgacggagucaaaggcuucucauacaaguaugguaacgggguuuggauuggccggaccaaaaguaaucgccugcgaaagggauuugagaugauaugggaccccaacggcuggacuaauacagauuccgacuucagcgugaaacaagauaucguagcuauuaccgacuggucuggguacucaggaaguuuugugcagcacccugaacucacggguuuagauugcaucagaccauguuucugggucgagcuggugaggggccuuccccgggaaaacaccacaauuuggacuagcggguccucuaucucguucugcggaguuaacagcggcaccgccaauugguccuggccugacggugcagaguugccauuuacaauagauaaguga

SEQ ID NO: 138299 - RNA, 1413 nt, Artificial Sequence; identical to SEQ ID NO: 138046
  derived and/or modified sequence opt3 from neuraminidase__InfluenzaA__ABW91298

SEQ ID NO: 138300 - RNA, 1413 nt, Artificial Sequence
  derived and/or modified sequence opt3 from neuraminidase__InfluenzaA__ABW91309
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucagacggggccgcgaguuacaaaaucuucaagauugaaaagggaaaaguuacaaagagcauagagcucaaugcaccuaacuuucacuaugaagaguguuccugcuacccagauaccggcacggugaugugugucugccgggacaauuggcacggcucuaaccgccccugggugagcuucaaucagaaccuggauuaccagaucggguauauuugcucaggaguguuuggugacaauccuagaccaaaagauggcaaggggaguuguaacccggucacugccgacggagcugacggcguuaaagguuucuccuacaaguaugggaauggcguguggaucggaaggacaaaaagcaaccggcugcgcaagggcuuugagaugaucugggaucccaauggguggaccgacacugauucugacuucucaguaaagcaagauguggucgccauuacagacuggaguggauacagcgguuccuuugugcagcauccugaacucaccggcuuagauugcauacgaccauguuucuggguugagcuggugagagggcuucccagggaaaacacgaccaucuggacaucuggaucgagcauuuccuucugcggcgucgacucagauacugcaaauuggaguuggccugacggugcugaguugccauuuaccaucgauaaauga

SEQ ID NO: 138301 - RNA, 1413 nt, Artificial Sequence; identical to SEQ ID NO: 138046
  derived and/or modified sequence opt3 from neuraminidase__InfluenzaA__ABW91320

SEQ ID NO: 138302 - RNA, 1413 nt, Artificial Sequence; identical to SEQ ID NO: 138046
  derived and/or modified sequence opt3 from neuraminidase__InfluenzaA__ABW91331

SEQ ID NO: 138303 - RNA, 1413 nt, Artificial Sequence; identical to SEQ ID NO: 138046
  derived and/or modified sequence opt3 from neuraminidase__InfluenzaA__ABW91342

SEQ ID NO: 138304 - RNA, 1413 nt, Artificial Sequence; identical to SEQ ID NO: 138046
  derived and/or modified sequence opt3 from neuraminidase__InfluenzaA__ABW91353

SEQ ID NO: 138305 - RNA, 1413 nt, Artificial Sequence
  derived and/or modified sequence opt3 from neuraminidase__InfluenzaA__ABW91364
augaacaccaaucagaagaucauuacaauaggcagcaucuccauugccaucgggauuaucucucugaugcuccaaauaggaaacaucauuucaaucugggcuagucacagcauucagacugguucccagaaucauacgggcaucugcaaccagagaauaauuaccuacgaaaauucuacaugggugaaccacacuuaugucaauaucaacaauaccaacguugugacagggaaagacaagaccucgguaacucuugcaggaaauucaagccuguguaguauuuccggcugggccaucuacacaaaagauaacucuaucaggauugguagcaagggggacguguucgucauacgggagcccuuuaucuccugcucacauuuggagugucgcaccuucuuuuuaacgcaaggagcgcugcuaaaugauaaacacaguaacggcacugugaaggaccgaagcccuuaucgugcucucaugucuugcccacugggcgaagccccgucccccuacaauucaaaguucgagagcguugcauggagugccucugcuugucaugaugggaugggauggcuuaccauugguaucuccggcccugacaacggggcaguggccguccugaaauauaacggaauaauuacagaaacuaucaagagcuggaaaaagagaaucuugaggacccaggagucggagugcguguguguaaauggcucuugcuuuacaauuaugaccgaugguccauccgacggggcugccucauacaaaaucuucaagauugaaaagggaaaaguuacgaagaguauagagcucaacgcgcccaauuuucacuaugaagaguguagcugcuacccugauacuggcacagugaugugugucugccgggacaacuggcacggcuccaaucgcccaugggugucuuucaaccagaaucuggauuaccagaucggguauauuugcagcggaguguuuggugacaaccccagaccuaaagauggcaaggggucauguaauccagucaccguugacggagcagacggcgugaaagguuucaguuacaaguaugggaacggcguauggaucggaaggacuaaauccaauaagcugcggaagggcuuugagaugaucugggauccgaacggguggacagacaccgauaaugacuucagcgugaaacaagaugucguggccauuacggacuggucuggauacucagguaguuuuguucagcaucccgaacucaccggcuuagauugcauacgcccuuguuucuggguggagcugguccgagggcuuccaagagaaaacacaacuaucuggaccagcggauccucuauuucguucugcggcguggacagcgauacagcuaauugguccuggcccgacggugccgaguugccuuuuacuaucgauaaguga

SEQ ID NO: 138306 - RNA, 1413 nt, Artificial Sequence; identical to SEQ ID NO: 138046
  derived and/or modified sequence opt3 from neuraminidase__InfluenzaA__ABW91375

SEQ ID NO: 138307 - RNA, 1413 nt, Artificial Sequence; identical to SEQ ID NO: 138072
  derived and/or modified sequence opt3 from neuraminidase__InfluenzaA__ABW91386

SEQ ID NO: 138308 - RNA, 1410 nt, Artificial Sequence
  derived and/or modified sequence opt3 from neuraminidase__InfluenzaA__ABW91397
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguaucugcauuaauggcacuuguacaguugugaugaccgauggcucugcuuccgggaaggcagacacuaaaauccucuuuauagaggaaggaaagauuguccauacaucaaccuuaagcgguagugcccaacacguggaggaaugcucuugcuauccucgcuacccaggcgugagaugugucugcagggauaacuggaagggguccaaccggccgaucguugacaucaauauuaaagaccacagcaucgugucgucuuacguauguuccggacuggugggcgauacgccccgcaagaacgacucaaguagcuccucucauugccuugauccuaauaacgaggaaggugggcacggagucaaaggcugggcuuucgacgauggcaaugacguguggauggggcgaaccauuagcgagaagucaagauugggauaugagacauuuaaaguuauagaagguuggaguaacccaaaguccaaacugcagaucaauaggcaagugauugucgaucggggcaaccguagcggguacucuggaaucuucucaguggagggcaagaguuguaucaaucgcugcuuuuauguagaacuaauuagagguaggaaggaggaaacugagguucucuggaccagcaacuccauaguggucuucugugggacaucuggcacuuacggaaccggcucguggcccgacggggccgauaucaaucugaugccuauuuga

SEQ ID NO: 138309 - RNA, 1413 nt, Artificial Sequence; identical to SEQ ID NO: 138217
  derived and/or modified sequence opt3 from neuraminidase__InfluenzaA__ABW91408

SEQ ID NO: 138310 - RNA, 1413 nt, Artificial Sequence
  derived and/or modified sequence opt3 from neuraminidase__InfluenzaA__ABW91419
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagagaaagacaagaccucgguaacacuugccggaaauucaagccuguguaguauuuccggaugggcgaucuacaccaaagauaacucuaucaggauuggcagcaagggugacguguucgucauacgggagccuuuuaucuccugcucacauuuggaaugucgcacuuucuuuuuaacacaaggggcucugcuaaaugauaaacacaguaacggaaccgugaaggaccgaagcccauaucgugcccucaugucuugcccgcugggcgaggcacccuccccuuacaauucaaaguucgaaagcguugccuggagugcuucugcaugucaugauggcaugggguggcuuacgauuggaaucuccgguccagacaacggcgccguggcuguccugaaauauaacgggauaauuacugagaccaucaagagcuggaaaaagagaaucuugaggacacaggagucggaaugcguguguguaaauggaucuugcuuuacuauuaugaccgauggccccuccaacggugccgcgucauacaaaaucuucaagauugagaaggggaaaguuacaaagaguauagaacucaaugcaccuaacuuucacuaugaggaguguagcugcuacccagacaccggaacggugaugugugucugccgggauaauuggcacggcuccaaccgccccugggugucuuucaaucagaaccuggacuaccaggugggcuauaucugcagcggggucuuuggagauaauccuagaccaaaagacgguaagggcucauguaacccgaugacuguugauggggccgacggagugaaaggcuucaguuacaaguaugguaaugggguauggauuggcaggacaaaauccaacaagcugcggaagggauuugaaaugaucugggaccccaauggcuggaccgauacugacagcgauuucucugugaaacaagacgucguggcuaucacagauuggucaggguacagugggagcuuuguucagcauccugagcucaccgguuuagacugcauucgcccauguuucuggguggaacugguccgaggccuucccagagagaacacgaccauauggacauccgggucuucgaucagcuucugcggaguggauuccgacacugccaauuggucauggccugauggcgcagaauugccauuuaccauugacaaguga

SEQ ID NO: 138311 - RNA, 1413 nt, Artificial Sequence
  derived and/or modified sequence opt3 from neuraminidase__InfluenzaA__ABW91430
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacgggagcguggccguccugaaauauaacggaauaauuacugaaaccaucaagucguggaaaaagagaaucuugaggacacaggagucugagugcguguguguaaauggcuccugcuuuacuauuaugaccgauggucccucaaacggggcugccaguuacaaaaucuucaagauugaaaagggaaaaguuacaaagagcauagagcucaaugcgccuaacuuucacuaugaagaguguuccugcuacccagacaccggcacggugaugugugucugccgggauaauuggcacggcucuaaccgccccugggugagcuucaaucagaaccuggacuaccaggugggguauaucugcucaggagucuuuggugauaauccuagaccaaaagacggcaaggggaguuguaacccgaugacuguugauggagcagacggcgugaaagguuucuccuacaaguaugggaauggcguauggauuggaaggacaaaaagcaacaagcugcggaagggcuuugagaugaucugggaccccaauggguggaccgauacugacucugauuucucagugaaacaagacgucguggccaucacagauuggaguggauacagcgguuccuuuguucagcauccugaacucaccggcuuagacugcauucgcccauguuucuggguggagcugguccgagggcuucccagagaaaacacgaccauauggacaucuggaucgagcaucuccuucugcggcguggauucagacacugcuaauuggaguuggccugauggugccgaguugccauuuaccauugacaaguga

SEQ ID NO: 138312 - RNA, 1410 nt, Artificial Sequence; identical to SEQ ID NO: 137900
  derived and/or modified sequence opt3 from neuraminidase__InfluenzaA__ABW91441

SEQ ID NO: 138313 - RNA, 1413 nt, Artificial Sequence; identical to SEQ ID NO: 138087
  derived and/or modified sequence opt3 from neuraminidase__InfluenzaA__ABW91452

SEQ ID NO: 138314 - RNA, 1413 nt, Artificial Sequence; identical to SEQ ID NO: 138087
  derived and/or modified sequence opt3 from neuraminidase__InfluenzaA__ABW91463

SEQ ID NO: 138315 - RNA, 1413 nt, Artificial Sequence; identical to SEQ ID NO: 138046
  derived and/or modified sequence opt3 from neuraminidase__InfluenzaA__ABW91474

SEQ ID NO: 138316 - RNA, 1413 nt, Artificial Sequence; identical to SEQ ID NO: 138087
  derived and/or modified sequence opt3 from neuraminidase__InfluenzaA__ABW91485

SEQ ID NO: 138317 - RNA, 1413 nt, Artificial Sequence; identical to SEQ ID NO: 138046
  derived and/or modified sequence opt3 from neuraminidase__InfluenzaA__ABW91496

SEQ ID NO: 138318 - RNA, 1413 nt, Artificial Sequence; identical to SEQ ID NO: 138072
  derived and/or modified sequence opt3 from neuraminidase__InfluenzaA__ABW91507

SEQ ID NO: 138319 - RNA, 1413 nt, Artificial Sequence; identical to SEQ ID NO: 138087
  derived and/or modified sequence opt3 from neuraminidase__InfluenzaA__ABW91518

SEQ ID NO: 138320 - RNA, 1413 nt, Artificial Sequence
  derived and/or modified sequence opt3 from neuraminidase__InfluenzaA__ABW91529
augaaccccaaucagaagaucauuaccauaggcagcaucuccauugccaucgggacaauuucucugaugcuccaaaucggaaacauaaucucaauuugggcuagucacagcauccagacugguucccagaaucauacgggcauuugcaaccagagaaucauaaccuacgaaaauucuacaugggugaaccacacuuaugucucgauuaauaacaccaauguuguggcagggaaagacaagacaucaguaacccuugccggaaacagcagucuguguuccaucucuggcugggcgauuuacacuaaagauaauagcaucaggaucgguuccaagggggacguguucgucauucgggagccuuuuauaucaugcagucauuuggagugucgcacauucuuuuuaacccaaggagcucugcuaaacgauaaacacagcaauggcacgaucaaggaccgaucuccauaucgugcccucauguccugcccgcugggcgaagcacccucaccuuacaacagcaaguucgagaguguggccuggucugcuuccgcaugucaugaugggaugggauggcuuacuauugguaucagcggcccagacaauggggccguugcugugcugaaauauaacggaauaauuaccgaaacaaucaagucguggaaaaagagaaucuugaggacucaggagucugagugcgucugugugaacggcuccugcuuuaccauuaugacagauggucccucaaauggggccgcgaguuacaaaaucuucaagauugaaaagggaaaaguaaccaagagcauagagcucaacgcaccuaauuuucacuaugaagaguguuccugcuacccagacacgggcacuguuaugugugugugccgggauaacuggcacggcucuaaucgccccugggucagcuucaaccagaaucuggacuaccagaucggguauauuugcucaggaguguuuggugauaacccuagaccaaaagacggcaaggggaguuguaauccggugacagucgauggagccgacggcguuaaagguuucuccuacaaguaugggaacggcguguggaucggaaggaccaaaagcaaucggcugcgcaagggcuuugagaugaucugggaccccaacggguggacugauacagacucugauuucucaguaaagcaagacguggucgcuauuaccgauuggaguggauacagcgguuccuuugugcagcauccugaacucacgggcuuagacugcauacgaccauguuucuggguugagcuggugagagggcuucccagggaaaauaccacaaucuggacuucuggaucgagcauuuccuucugcggcgucgauucagacaccgccaacuggaguuggccugauggugcagaguugccauuuacaaucgacaaauga

SEQ ID NO: 138321 - RNA, 1413 nt, Artificial Sequence
  derived and/or modified sequence opt3 from neuraminidase__InfluenzaA__ABW91540
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccuggaugaaccacacauaugugucgaucaauaacacuaaugucguugcagggaaagacaagaccucagugacacuugccggaaacagcagucuguguuccauuucuggcugggcgaucuacaccaaagauaauagcaucaggauugguuccaagggggacguauucgugauacgggagccuuuuaucucaugcagucauuuggagugucgcacuuucuuuuuaacacaaggagcucugcuaaacgauaaacacagcaauggcaccgucaaggaccgaucuccauaucgugcccucauguccugcccgcugggcgaagcacccucaccuuacaacagcaaguucgagaguguggccuggucugcuuccgcaugucaugaugggaugggauggcuuacgauugguaucagcggcccagacaauggggccguugcugugcugaaauauaacggaauaauuacugaaaccaucaagucguggaaaaagagaaucuugaggacacaggagucugagugcgucugugugaacggcuccugcuuuacuauuaugaccgauggucccucaaauggggccgcgaguuacaaaaucuucaagauugaaaagggaaaaguaacaaagagcguugagcucaacgcaccuaauuuucacuaugaagaguguuccugcuacccagacaccggcacggugaugugugucugccgggauaacuggcacggcucuaaucgccccugggugagcuucaaccagaaucuggacuaccagauaggguauaucugcucaggaguguuuggugauaacccuagaccaaaagacggcaaggggaguuguaauccggucacuguugauggagccgacggcgugaaagguuucuccuacaaguaugggaacggcguauggauuggaaggacaaaaagcaaucggcugcgcaagggcuuugagaugaucugggaccccaacggguggaccgauacugacucugauuucucagugaagcaagacgucguggcuaucacagauuggaguggauacagcgguuccuuuguucagcauccugaacucaccggcuuagacugcauucgaccauguuucuggguggagcuggucagagggcuucccagggaaaauacgaccauauggacaucuggaucgagcaucuccuucugcggcguggauucagacacugccaacuggaguuggccugauggugcagaguugccauuuaccauugacaaauga

SEQ ID NO: 138322 - RNA, 1410 nt, Artificial Sequence
  derived and/or modified sequence opt3 from neuraminidase__InfluenzaA__ABW91551
augaaccccaaucagaagaucauuaccauaggcagcgugucccugacaaucucuacuauuugcuucuuuaugcaaaucgccauucucaucacgaccgucacacuucacuucaaacaguacgaguuuaacuucccuccaaauaaccagguuaugcugugugaaccgacuauaaucgagagaaauauuaccgaaaucguguauuugacaaacaccacuauugagaaggaaaucugccccaaauuagcugaguacaggaauuggucaaagccucagugugacauaacaggguuugcaccauucaguaaagauaacagcauucggcuguccgccggaggugacaucuggguaacccgcgagcccuaugugucuugcgauccugacaaguguuaccaauuugcgcuaggccaggggacgacucucaauaacguccauucgaaugauaccgugcgagaccguacaccauauagaacucugcuuaugaacgaacugggaguucccuuccacuugggcaccaaacaggugugcauugcuuggucaagcaguuccugucaugaugguaaggccuggcuccacgucugcaucacaggggacgauaagaaugcaaccgccucuuuuaucuacaacggaaggcugguggacagcauuguauccuggucaaaagagauacugcggacgcaggaaagugaguguguuugcaucaauggcacuuguacaguggucaugaccgauggcagcgcuucugggaaggcagacacuaaaauucucuucaucgaggaaggaaagauagugcauacauccaccuuaucagguagcgcccaacacguggaggaaugcaguugcuauccucgcuacccaggcgucagauguguuugcagggauaacuggaaggggucuaaccggccgauuguggacaucaauaucaaagaccacuccauuguaagcucguacguguguucuggacuggucggcgauacgccccgcaagaacgacuccucaaguagcucccauugccuugauccuaauaacgaggaaggugggcacggagugaaaggcugggcuuuugacgauggcaaugacguuuggauggggcgaaccaucucugagaagucuagauugggauaugagacauucaaagugauugaagguuggucaaacccaaagaguaaacugcagauaaauaggcaggucaucguggaucggggcaaccguuccggguacagcggaauuuuuagcguagagggcaagucauguaucaaucgcugcuucuauguugaacuaaucagagguaggaaggaggaaacugaggugcucuggaccaguaacagcauugucguguucugugggacauccggcacuuacggaaccggcucuuggcccgacggggccgauauaaaucugaugccuaucuga

SEQ ID NO: 138323 - RNA, 1413 nt, Artificial Sequence; identical to SEQ ID NO: 138046
  derived and/or modified sequence opt3 from neuraminidase__InfluenzaA__ABW91562

SEQ ID NO: 138324 - RNA, 1413 nt, Artificial Sequence; identical to SEQ ID NO: 138081
  derived and/or modified sequence opt3 from neuraminidase__InfluenzaA__ABW91584

SEQ ID NO: 138325 - RNA, 1413 nt, Artificial Sequence; identical to SEQ ID NO: 138046
  derived and/or modified sequence opt3 from neuraminidase__InfluenzaA__ABW91595

SEQ ID NO: 138326 - RNA, 1413 nt, Artificial Sequence; identical to SEQ ID NO: 138087
  derived and/or modified sequence opt3 from neuraminidase__InfluenzaA__ABW91606

SEQ ID NO: 138327 - RNA, 1413 nt, Artificial Sequence; identical to SEQ ID NO: 138081
  derived and/or modified sequence opt3 from neuraminidase__InfluenzaA__ABW91617

SEQ ID NO: 138328 - RNA, 1413 nt, Artificial Sequence; identical to SEQ ID NO: 138046
  derived and/or modified sequence opt3 from neuraminidase__InfluenzaA__ABW91628

SEQ ID NO: 138329 - RNA, 1413 nt, Artificial Sequence; identical to SEQ ID NO: 138046
  derived and/or modified sequence opt3 from neuraminidase__InfluenzaA__ABW91639

SEQ ID NO: 138330 - RNA, 1410 nt, Artificial Sequence; identical to SEQ ID NO: 137900
  derived and/or modified sequence opt3 from neuraminidase__InfluenzaA__ABW91650

SEQ ID NO: 138331 - RNA, 1350 nt, Artificial Sequence
  derived and/or modified sequence opt3 from neuraminidase__InfluenzaA__ABX10517
augaaccccaauaagaaaaucauuaccauaggcagcaucugcauggugacagggauggucucccugaugcuccagauuggaaaccuuaucucuauuuggguuucacacaguauccauacugguaaucaacacaaggccgagccuauaagcaacacgaauuuccugaccgaaaaagcuguggcauccguaaaguuggccggcaacucuucguuauguccaaucaaugggugggcggugcauucaaaagacaacagcauuagaaucggaaguaagggcgaugucuuugugauuagggagccguucaucuccugcucucaccuggaaugucggacauuuuuccuaacucagggugcucuccugaaugacaagcauagcaacgggaccguuaaagaucgcucaccccaccgaacacuuauguccugcccugugggagaggccccaagucccuacaauagccguuuugaaucugucgcaugguccgccucagcuugucacgacggcaccagcuggcugacuauaggcauuagugggccugauaacggagcaguggccguauugaaguauaaugguaucauuacagacaccaucaaaucuuggagaaacaauauccucaggacgcaggaguccgagugcgcuuguguuaacggcagcugcuucacugugaugaccgaugggccaucgaacggacaggccucucauaagauuuuuaaaauggaaaagggcaaggucgugaaauccguggagcuggacgcgcccaauuaccacuaugaagaguguucaugcuacccugaugccggugagauaacaugugucugccgggacaacuggcaugggaguaaucgcccauggguuagcuucaaccaaaaucuggaauaucagaucggauacauuugcuccggcguguuuggcgauaacccgagacccaaugacgggacuggaucuugugguccuguaagcucaaacggcgcauauggggugaagggauucaguuuuaaauacggcaauggugucuggaucgggaggaccaaguccacaaacagccggucuggcuucgagaugauaugggauccaaauggauggaccgaaacggacucaaguuuuagcgugaaacaggacauuguugcuaucacugauugguccggcuacucugggucguucgugcagcaccccgagcucacaggauuagacugcauccgcccuuguuucugggucgaacugauucgagguagaccaaaggagagcaccaucugggccuccggcucaaguauuucuuuuugcggggugaacagcgauacuguaggaugguccuggcccgacggcgcagagcuuccguucacaauagauaaauga

SEQ ID NO: 138332 - RNA, 1410 nt, Artificial Sequence; identical to SEQ ID NO: 137945
  derived and/or modified sequence opt3 from neuraminidase__InfluenzaA__ABX10527

SEQ ID NO: 138333 - RNA, 1413 nt, Artificial Sequence
  derived and/or modified sequence opt3 from neuraminidase__InfluenzaA__ABX58242
augaaccccaaucagaagaucauuaccauaggcagcaucuccauugccaucgggauuaucucucugaugcuccaaauaggaaacaucauuucaaucuggacaagucacagcauucagacugguucccagaaucauacgggcaucugcaaccagagaauaauuaccuacgaaaauucuacaugggugaaccacacuuaugucucgaucaauaacaccaauguuguggcugggaaagacaagacaucaguaacccuugcaggaaacagcagucuguguuccauuucuggcugggccaucuacacuaaagauaauagcaucaggauugguuccaagggggacguguucgucauacgggagccuuuuaucucaugcagucauuuggagugucgcacauucuuuuuaacccaaggagcgcugcuaaacgauaaacacagcaauggcacggugaaggaccgaucuccauaucgugcucucauguccugcccgcugggcgaagcccccucaccuuacaacagcaaguucgagaguguugcauggucugccuccgcuugucaugaugggaugggauggcuuacuauugguaucagcggcccagacaauggggcaguggccguccugaaauauaacggaauaauuaccgaaacaaucaagucguggaaaaagagaaucuugaggacucaggagucugagugcguguguguaaacggcuccugcuuuaccauuaugacagauggucccucaaauggggcugccaguuacaaaaucuucaagauugaaaagggaaaaguuaccaagagcauagagcucaacgcgccuaauuuucacuaugaagaguguuccugcuacccagacacgggcacugugaugugugucugccgggauaacuggcacggcucuaaucgccccugggugagcuucaaccagaaucuggacuaccagaucggguauauuugcucaggaguguuuggugauaacccuagaccaaaagacggcaaggggaguuguaauccggucacaguugauggagcagacggcgugaaagguuucuccuacaaguaugggaacggcguauggaucggaaggaccaaaagcaaucggcugcgcaagggcuuugagaugaucugggaccccaacggguggacugauacagacucugauuucucagugaagcaagacgucguggccauuaccgauuggaguggauacagcgguuccuuuguucagcauccugaacucacgggcuuagacugcauacgaccauguuucuggguggagcuggucagagggcuucccagggaaaauaccacaaucuggacuucuggaucgagcauuuccuucugcggcguggauucagacaccgcuaacuggaguuggccugauggugccgaguugccauuuacaaucgacaaauga

SEQ ID NO: 138334 - RNA, 1413 nt, Artificial Sequence; identical to SEQ ID NO: 138145
  derived and/or modified sequence opt3 from neuraminidase__InfluenzaA__ABX58253

SEQ ID NO: 138335 - RNA, 1413 nt, Artificial Sequence; identical to SEQ ID NO: 138046
  derived and/or modified sequence opt3 from neuraminidase__InfluenzaA__ABX58264

SEQ ID NO: 138336 - RNA, 1413 nt, Artificial Sequence; identical to SEQ ID NO: 138046
  derived and/or modified sequence opt3 from neuraminidase__InfluenzaA__ABX58275

SEQ ID NO: 138337 - RNA, 1413 nt, Artificial Sequence; identical to SEQ ID NO: 138046
  derived and/or modified sequence opt3 from neuraminidase__InfluenzaA__ABX58286

SEQ ID NO: 138338 - RNA, 1413 nt, Artificial Sequence
  derived and/or modified sequence opt3 from neuraminidase__InfluenzaA__ABX58297
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagaaaauaauuacguacgaaaauucuaccugggugaaccacacauaugucucgaucaauaacacuaauguuguggcagggaaggacaaaaccucaguaacacuugccggaaacagcagucuguguuccauuucuggcugggcgaucuacaccaaggauaauagcaucagaauugguuccaaaggggacguguucgucauaagggagccuuuuaucucaugcagucauuuggagugucggacuuucuuuuuaacacaaggagcucugcuaaacgauaagcacagcaauggcaccgugaaggaccgcucuccauaucgagcccucauguccugcccgcugggcgaagcacccucaccuuacaacagcaaauucgagaguguugccuggucugcuuccgcaugucaugaugggaugggauggcuuacgauugguaucagcggcccagacaauggggccguggcuguccugaaguauaacggaauaauuacugaaaccaucaaaucguggaagaaacguaucuugagaacacaggagucugagugcguguguguaaacggcuccugcuuuacuauuaugaccgauggucccucaaauggggccgcgaguuacaagaucuucaagauugaaaaaggaaagguuacaaaaagcauagagcucaacgcaccuaauuuucacuaugaagaguguuccugcuacccagacaccggcacggugaugugugucugcagggauaacuggcacggcucuaaucggcccugggugagcuucaaccagaaucuggacuaccagaucggguauauuugcucaggaguguuuggugauaacccucgcccaaaggacggcaaagggaguuguaauccggucacuguugauggagccgacggcgugaaggguuucuccuacaaauaugggaacggcguauggaucggaagaacaaagagcaauaggcugcggaagggcuuugagaugaucugggaccccaacggguggaccgauacugacucugauuucucagugaaacaagacgucguggcuauuacagauuggaguggauacagcgguuccuuuguucagcauccugaacucaccggcuuagacugcauacgcccauguuucuggguggagcugguccgagggcuucccagagaaaauacgaccaucuggacaucuggaucgagcauuuccuucugcggcguggauucagacacugccaacuggaguuggccugauggugcagaguugccauuuaccaucgacaaguga

SEQ ID NO: 138339 - RNA, 1413 nt, Artificial Sequence; identical to SEQ ID NO: 138217
  derived and/or modified sequence opt3 from neuraminidase__InfluenzaA__ABX58308

SEQ ID NO: 138340 - RNA, 1413 nt, Artificial Sequence
  derived and/or modified sequence opt3 from neuraminidase__InfluenzaA__ABX58319
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccauuaaggaccgaucuccauaucgugcccucauguccugcccgcugggcgaagcacccucaccuuacaacagcaaguucgagaguguggccuggucugcuuccgcaugucaugaugggaugggauggcuuacgaucgguauaagcggcccagacaauggggccguugcugugcugaaauauaacggaauuaucacugaaaccaucaagucguggaaaaagagaauuuugaggacacaggagucugagugcgucugugugaacggcuccugcuuuacuaucaugaccgauggucccucaaauggggccgcgaguuacaaaauuuucaagauagaaaagggaaaaguaacaaagagcaucgagcucaacgcaccuaauuuucacuaugaagaguguuccugcuacccagacaccggcacgguuaugugugugugccgggauaacuggcacggcucuaaucgccccugggucagcuucaaccagaaucuggacuaccagauuggguauaucugcucaggaguguuuggugauaacccuagaccaaaagacggcaaggggaguuguaauccggugacugucgauggagccgacggcguuaaagguuucuccuacaaguaugggaacggcguguggaucggaaggacaaaaagcaaucggcugcgcaagggcuuugagaugauuugggaccccaacggguggaccgauacugacucugauuucucaguaaagcaagacguggucgcuauaacagauuggaguggauacagcgguuccuuugugcagcauccugaacucaccggcuuagacugcauccgaccauguuucuggguugagcuggugagagggcuucccagggaaaauacgaccauuuggacaucuggaucgagcaucuccuucugcggcgucgauucagacacugccaacuggaguuggccugauggugcagaguugccauuuaccauugacaaauga

SEQ ID NO: 138341 - RNA, 1413 nt, Artificial Sequence; identical to SEQ ID NO: 138217
  derived and/or modified sequence opt3 from neuraminidase__InfluenzaA__ABX58352

SEQ ID NO: 138342 - RNA, 1413 nt, Artificial Sequence; identical to SEQ ID NO: 138046
  derived and/or modified sequence opt3 from neuraminidase__InfluenzaA__ABX58363

SEQ ID NO: 138343 - RNA, 1413 nt, Artificial Sequence; identical to SEQ ID NO: 138046
  derived and/or modified sequence opt3 from neuraminidase__InfluenzaA__ABX58385

SEQ ID NO: 138344 - RNA, 1413 nt, Artificial Sequence; identical to SEQ ID NO: 138046
  derived and/or modified sequence opt3 from neuraminidase__InfluenzaA__ABX58396

SEQ ID NO: 138345 - RNA, 1413 nt, Artificial Sequence
  derived and/or modified sequence opt3 from neuraminidase__InfluenzaA__ABX58407
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguccuauuuccggcugggcgaucuacaccaaagauaauucuaucaggauugguagcaagggggacguguucgucauacgggagccauuuaucuccugcucacauuuggagugucgcacuuucuuuuuaacacaaggagcucugcuaaacgauaaacacaguaauggcaccgugaaggaccgaagcccguaucgugcccucaugucuugcccccugggcgaagcaccuuccccauacaacucaaaguucgagagcguugccuggagugcuucugcaugucaugaugggaugggauggcuuacgauugguaucuccggccccgacaauggggccguggcuguccugaaauauaacggaauaauuacugaaaccaucaagagcuggaaaaagagaaucuugaggacacaggagucggagugcguguguguaaacggcucuugcuuuacuauuaugaccgaugguccuuccaauggggccgcgucauacaaaaucuucaagauugaaaagggaaaaguuacaaagaguauagagcucaacgcaccaaauuuucacuaugaagaguguagcugcuaccccgacaccggcacggugaugugugucugccgggauaacuggcacggcuccaaucgcccuugggugucuuucaaccagaaucuggacuaccagaucggguauauuugcagcggaguguuuggugauaacccaagaccgaaagacggcaaggggucauguaaucccgucacuguugauggagccgacggcgugaaagguuucaguuacaaguaugggaacggcguauggaucggaaggacaaaauccaaucggcugcgcaagggcuuugagaugaucugggacccuaacggguggaccgauacugacagcgauuucucugugaagcaagacgucguggcuauuacagauuggucaggauacagugguagcuuuguucagcauccagaacucaccggcuuagacugcauacgacccuguuucuggguggagcuggucagagggcuuccuagggaaaauacgaccaucuggacauccggaucuucgauuagcuucugcggcguggauuccgacacugccaacuggucauggccagauggugcagaguugcccuuuaccaucgacaaauga

SEQ ID NO: 138346 - RNA, 1413 nt, Artificial Sequence; identical to SEQ ID NO: 138087
  derived and/or modified sequence opt3 from neuraminidase__InfluenzaA__ABX58418

SEQ ID NO: 138347 - RNA, 1413 nt, Artificial Sequence; identical to SEQ ID NO: 138046
  derived and/or modified sequence opt3 from neuraminidase__InfluenzaA__ABX58429

SEQ ID NO: 138348 - RNA, 1413 nt, Artificial Sequence; identical to SEQ ID NO: 138046
  derived and/or modified sequence opt3 from neuraminidase__InfluenzaA__ABX58440

SEQ ID NO: 138349 - RNA, 1413 nt, Artificial Sequence
  derived and/or modified sequence opt3 from neuraminidase__InfluenzaA__ABX58451
augaaccccaaucagaagaucauuaccauaggcagcaucuccauugccaucgggacaauuucucugaugcuccaaaucggaaacauaaucucaauuugggcuagucacagcauccagacugguucccagaaucauacgggcauuugcaaccagagaaucauaaccuacgaaaauucuacaugggugaaccacacuuaugucucgauuaauaacaccaauguuguggcagggaaagacaagacaucaguaacccuugccggaaacagcagucuguguuccaucucuggcugggcgauuuacacuaaagauaauagcaucaggaucgguuccaagggggacguguucgucauucgggagccuuuuauaucaugcagucauuuggagugucgcacauucuuuuuaacccaaggagcucugcuaaacgauaaacacagcaauggcacggugaaggaccgaucuccauaucgugcccucauguccugcccgcugggcgaagcacccucaccuuacaacagcaaguucgagaguguugccuggucugcuuccgcaugucaugaugggaugggauggcuuacuaucgguauuagcggcccagacaauggggccguggcuguccugaaauauaacggaaucauaaccgaaacaauuaagucguggaaaaagagaaucuugaggacucaggagucugagugcguguguguaaacggcuccugcuuuaccaucaugacagauggucccucaaauggggccgcgaguuacaaaauuuucaagaucgaaaagggaaaaguuaccaagagcauugagcucaacgcaccuaauuuucacuaugaagaguguuccugcuacccagacacgggcacugugaugugugucugccgggauaacuggcacggcucuaaucgccccugggugagcuucaaccagaaucuggacuaccagauaggguauaucugcucaggaguguuuggugauaacccuagaccaaaagacggcaaggggaguuguaauccggucacaguugauggagccgacggcgugaaagguuucuccuacaaguaugggaacggcguauggauuggaaggaccaaaagcaaucggcugcgcaagggcuuugagaugaucugggaccccaacggguggacugauacagacucugauuucucagugaagcaagacgucguggcuaucaccgauuggaguggauacagcgguuccuuuguucagcauccugaacucacgggcuuagacugcauucgaccauguuucuggguggagcuggucagagggcuucccagggaaaauaccacaauauggacuucuggaucgagcaucuccuucugcggcguggauucagacaccgccaacuggaguuggccugauggugcagaguugccauuuacaauugacaaauga

SEQ ID NO: 138350 - RNA, 1413 nt, Artificial Sequence; identical to SEQ ID NO: 138087
  derived and/or modified sequence opt3 from neuraminidase__InfluenzaA__ABX58462

SEQ ID NO: 138351 - RNA, 1413 nt, Artificial Sequence; identical to SEQ ID NO: 138046
  derived and/or modified sequence opt3 from neuraminidase__InfluenzaA__ABX58473

SEQ ID NO: 138352 - RNA, 1413 nt, Artificial Sequence; identical to SEQ ID NO: 138087
  derived and/or modified sequence opt3 from neuraminidase__InfluenzaA__ABX58484

SEQ ID NO: 138353 - RNA, 1413 nt, Artificial Sequence
  derived and/or modified sequence opt3 from neuraminidase__InfluenzaA__ABX58495
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaaucgaaccgugaaggaccguucuccauauagagcccucauguccugcccgcugggcgaagcacccucaccuuacaacagcaaguucgagaguguugccuggucugcuuccgcaugucaugauggcaugggguggcuuacgauuggaaucagcgguccagacaauggcgccguggcuguccugaaauauaacgggauaauuacugaaaccaucaagucguggaaaaagaggaucuugcggacacaggagucugagugcguguguguaaacggauccugcuuuacuauuaugaccgauggccccucaaauggugccgcgaguuacaaaaucuucaagauugaaaaggggaaaguuacaaagagcauagagcucaacgcaccuaauuuucacuaugaagaguguuccugcuacccagacaccggaacggugaugugugucugccgcgauaacuggcacggcucuaauagacccugggugagcuucaaccagaaucuggacuaccagaucggcuauauuugcucagggguguuuggagauaacccuaggccaaaagacgguaagggcaguuguaauccggucacuguugauggggccgacggagugaaaggcuucuccuacaaguaugguaacgggguauggaucggccggacaaaaagcaaucgccugcgaaagggauuugagaugaucugggaccccaacggcuggaccgauacugacucugauuucucagugaagcaagacgucguggcuauuacagauuggaguggguacagcggauccuuuguucagcauccugaacucaccgguuuagacugcauaagaccauguuucuggguggagcuggucaggggccuuccccgggaaaauacgaccaucuggacaucugggucgagcauuuccuucugcggaguggauucagacacugccaacuggaguuggccugauggcgcagaguugccauuuaccaucgacaaauga

SEQ ID NO: 138354 - RNA, 1413 nt, Artificial Sequence; identical to SEQ ID NO: 138081
  derived and/or modified sequence opt3 from neuraminidase__InfluenzaA__ABX58506

SEQ ID NO: 138355 - RNA, 1413 nt, Artificial Sequence; identical to SEQ ID NO: 138087
  derived and/or modified sequence opt3 from neuraminidase__InfluenzaA__ABX58528

SEQ ID NO: 138356 - RNA, 1413 nt, Artificial Sequence; identical to SEQ ID NO: 138087
  derived and/or modified sequence opt3 from neuraminidase__InfluenzaA__ABX58539

SEQ ID NO: 138357 - RNA, 1413 nt, Artificial Sequence
  derived and/or modified sequence opt3 from neuraminidase__InfluenzaA__ABX58550
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacggugaugugugucugccgggauaacuggcacggcucuaaucgccccugggugagcuucaaccagaaucuggacuaccagaucggguauauuugcucaggaguguuuggugauaacccuagaccaaaagacggcaaggggaguuguaauccggucacuguugauggagccgacggcgugaaagguuucuccuacaaguaugggaacggcguauggaucggaaggacaaaaagcaaucggcugcgcaagggcuuugagaugaucugggaccccaacggguggaccgauacugacucugauuucucagugaagcaagacgucguggcuauuacagauuggaguggauacagcgguuccuuuguucagcauccugaacucaccggcuuagacugcauacgaccauguuucuggguggagcuggucagagggcuucccagggaaaauacgaccaucuggacaucuggaucgagcauuuccuucugcggcguggauucagacacugccaacuggaguuggccugauggugcagaguugccauuuaccguagacaaauga

SEQ ID NO: 138358 - RNA, 1413 nt, Artificial Sequence; identical to SEQ ID NO: 138046
  derived and/or modified sequence opt3 from neuraminidase__InfluenzaA__ABX58561

SEQ ID NO: 138359 - RNA, 1413 nt, Artificial Sequence
  derived and/or modified sequence opt3 from neuraminidase__InfluenzaA__ABX58572
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacggugaugugugucugccgggauaacuggcacggcucuaaucgccccugggugagcuucaaccagaaucuggacuaccagaucggguauauuugcucaggaguguuuggugauaacccuagaccaaaagacggcaaggggaguuguaauccgaugacugucgauggagccgacggcguuaaagguuucuccuacaaguaugggaacggcguguggaucggaaggacaaaaagcaaucggcugcgcaagggcuuugagaugaucugggaccccaacggguggaccgauacugacucugauuucucaguaaagcaagacguggucgcuauuacagauuggaguggauacagcgguuccuuugugcagcauccugaacucaccggcuuagacugcauacgaccauguuucuggguugagcuggugagagggcuucccagggaaaauacgaccaucuggacaucuggaucgagcauuuccuucugcggcgucgauucagacacugccaacuggaguuggccugauggugcagaguugccauuuaccaucgacaaauga

SEQ ID NO: 138360 - RNA, 1413 nt, Artificial Sequence; identical to SEQ ID NO: 138046
  derived and/or modified sequence opt3 from neuraminidase__InfluenzaA__ABX58583

SEQ ID NO: 138361 - RNA, 1413 nt, Artificial Sequence; identical to SEQ ID NO: 138046
  derived and/or modified sequence opt3 from neuraminidase__InfluenzaA__ABX58594

SEQ ID NO: 138362 - RNA, 1413 nt, Artificial Sequence; identical to SEQ ID NO: 138072
  derived and/or modified sequence opt3 from neuraminidase__InfluenzaA__ABX58605

SEQ ID NO: 138363 - RNA, 1413 nt, Artificial Sequence; identical to SEQ ID NO: 138072
  derived and/or modified sequence opt3 from neuraminidase__InfluenzaA__ABX58616

SEQ ID NO: 138364 - RNA, 1413 nt, Artificial Sequence; identical to SEQ ID NO: 138046
  derived and/or modified sequence opt3 from neuraminidase__InfluenzaA__ABX58627

SEQ ID NO: 138365 - RNA, 1413 nt, Artificial Sequence; identical to SEQ ID NO: 138046
  derived and/or modified sequence opt3 from neuraminidase__InfluenzaA__ABX58638

SEQ ID NO: 138366 - RNA, 1413 nt, Artificial Sequence
  derived and/or modified sequence opt3 from neuraminidase__InfluenzaA__ABX58682
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacgaugaugugugugugccgggauaacuggcacggcucuaaucgccccugggucagcuucaaccagaaucuggacuaccagaucggguauauuugcucaggaguguuuggugauaacccuagaccaaaagacggcaaggggaguuguaauccggugacugucgauggagccgacggcguuaaagguuucuccuacaaguaugggaacggcguguggaucggaaggacaaaaagcaaucggcugcgcaagggcuuugagaugaucugggaccccaacggguggaccgauacugacucugauuucucaguaaagcaagacguggucgcuauuacagauuggaguggauacagcgguuccuuugugcagcauccugaacucaccggcuuagacugcauacgaccauguuucuggguugagcuggugagagggcuucccagggaaaauacgaccaucuggacaucuggaucgagcauuuccuucugcggcgucgauucagacacugccaacuggaguuggccugauggugcagaguugccauuuaccaucgacaaauga

SEQ ID NO: 138367 - RNA, 1413 nt, Artificial Sequence
  derived and/or modified sequence opt3 from neuraminidase__InfluenzaA__ABX58693
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcagggaaagacaagaccucgguaacacuugccggaaacucaagccuguguaguauuuccggcugggcgaucuacaccaaagauaauucuaucaggauugguagcaagggggacguguucgucauacgggaaccuuuuaucuccugcucacacuuggagugucgcacuuucuuuuuaacacaaggagcucugcuaaacgauaaacauaguaauggcaccgugaaggaccgaagcccauaucgugcccucaugucuugcccgcugggcgaagcacccuccccuuacaacucaaaguucgagagcguugccuggagugcuucugcaugucacgaugggaugggauggcuuacgauugguaucuccggcccagacaacggggccguggcuguccugaaauauaauggaauaauuacuggcaccaucaagagcuggaaaaagcagaucuugagaacacaggaaucggagugcguguguaugaacgguucuugcuuuacuauuaugaccgaugggcccuccaauagggccgcgucauacaaaaucuucaagauugagaagggaaaaguaacaaagaguauagaacucaacgcaccuaauuuucauuaugaggaauguagcugcuacccagacaccggcaucguuaugugugugugccgggauaacuggcacggcuccaaucgccccugggucucuuucaaccagaaucuggacuaccaaauuggguauaucugcagcggagugcugggugauaacccuagaccagaggacggcgaggggucauguaauccggugacggucgauggagccgacggcguuaaagguuuuaguuacaaguaugacaacgggguguggaucggcaggacuaaauccaaucggcuccgcaagggauucgaaaugauuugggaucccaacggcuggacaaauaccgacagcgauuuuucuguaaaacaggacguggucgcuauaacugauuggucaggguacagugguagcuucgugcagcacccugaguuaacaggacuggacugcauccgaccauguuuuuggguugaacuugugagaggcuugcccagggagaacaccacgauuuggaccuccgggucuucgaucagcuucugcggagucaacuccgauacagccaauuggucauggccugacggcgcagaacugccauucacuauugauaaguga

SEQ ID NO: 138368 - RNA, 1413 nt, Artificial Sequence; identical to SEQ ID NO: 138217
  derived and/or modified sequence opt3 from neuraminidase__InfluenzaA__ABX58704

SEQ ID NO: 138369 - RNA, 1413 nt, Artificial Sequence; identical to SEQ ID NO: 138145
  derived and/or modified sequence opt3 from neuraminidase__InfluenzaA__ABX58715

SEQ ID NO: 138370 - RNA, 1350 nt, Artificial Sequence
  derived and/or modified sequence opt3 from neuraminidase__InfluenzaA__ABY19420
augaaccccaaucagaaggugaucaccauuggcagcauaugcauggucaucgggauuguuucccugaugcuccaaaucggaaacaugauuucuaucugggugucacacaguauacagacagguaaucagaaccagguagagccuaucauuaauacuaacuuccuuacgggcaaagccguggcuagcaucacccuggcaggaaauuccucuuuguguccaauuagagggugggccauccauucgaaggacaacucaauaaggauuggcagcaaaggugaugucuuugugauccgggaaccguucauuaguugcucccacuuagagugucgcacauuuuuccugacucaaggggcgcuacucaaugacaagcauucuaacggaaccguuaaagaucgaagcccccaccguacacugauguccugcccugugggcgaagcuccaucacccuacaauaguagauuugagagcgucgccuggucugcauccgccugucaugacggcaccucauggcuuacuaucgggaucagcggaccugauaacggugcuguggcaguacugaaguauaauggcauuauaacagacaccaucaagaguuggaggaacaauauuuugcggacgcaggaaucugagugcgccuguguuaacggguccugcuucacugugaugaccgauggaccaagcaacggccaggcuucguacaaaaucuuuaagauggagaaagguaaggucauaaaaucuguggaacucgacgcccccaauuaucacuacgaggaauguuccugcuauccugaugcgggggagauuacaugugugugccgcgacaacuggcacggaucaaauagaccaugggucaguuucaaccagaaucuggaguaccaaaucggcuauaucugcagcggcguuuuuggggauaacccgaggcccaaugacggaacugguuccuguggcccugugucucauaacggggcauacggaguaaagggcuucagcuuuaaguacgguaaugggguguggauuggccggaccaaaucaccaaacagucgcuccggauucgaaaugaucugggaucccaauggcuggagcgagacagacucuucauuuagugucaagcaggacauuguggccauaaccgauuggagcggguauuccggaucuuucguucagcacccugaacugacgggucucgacugcauccgaccauguuucuggguggaguuaauuagaggcaggcccaaagaaucgacugucuggacaagcggguccucaaucaguuuuugcggagugaacucugauaccguaagcugguccuggccggacggcgcugagcugccuuucucaaucgauaaguga

SEQ ID NO: 138371 - RNA, 1350 nt, Artificial Sequence
  derived and/or modified sequence opt3 from neuraminidase__InfluenzaA__ABY19421
augaaccccaaucagaagaucauuaccauaggcagcaucugcauggugauugggaucgucucccugaugcuccaaauuggaaacaugaucucuauauggguuucacacaguauccagacagguaaucagaaccagguggagccuauuaucaauacuaacuuccuuacgggcaaagccguagcuagcauuacccuggcaggaaauuccucuuuguguccaaucagagggugggccauacauucgaaggacaacucaauuaggaucggcagcaaaggugauguguuugucauucgggaaccguucaucaguugcucccacuuagagugucgcacauuuuuccugacucaaggggcgcuacucaaugacaagcauucuaacggaaccgugaaagaucgaagcccccaccguacacugauguccugcccuguuggcgaagcuccaucacccuacaauaguagauuugagagcguggccuggucugcauccgccugucaugacggcaccucauggcuuacuaucgggauuagcggaccugauaacggugcugucgcagugcugaaguauaauggcauaaucacagacaccauuaagaguuggaggaacaauaucuugcggacgcaggaaucugagugcgccuguguaaacggguccugcuucacuguuaugaccgauggaccaagcaacggccaggcuucguacaaaauauuuaagauggagaaagguaaggugauuaaaucugucgaacucgacgcccccaauuaucacuacgaggaauguuccugcuauccugaugcgggggagaucacaugugugugccgcgacaacuggcacggaucaaauagaccaugggugaguuucaaccagaaucuggaguaccaaaucggcuauauuugcagcggcgucuuuggggauaacccgaggcccaaugacggaacugguuccuguggcccuguuucucauaacggggcauacggagugaagggcuucagcuuuaaguacgguaaugggguauggaucggccggaccaaaucaccaaacagucgcuccggauucgaaaugauuugggaucccaauggcuggagcgagacagacucuucauuuagugugaagcaggacauagucgccaucaccgauuggagcggguauuccggaucuuucgugcagcacccugaacugacgggucucgacugcauucgaccauguuucuggguugaguuaaucagaggcaggcccaaagaaucgacuguguggacaagcggguccucaaucaguuuuugcggagucaacucugauaccgugagcugguccuggccggacggcgcugagcugccuuucucaauugauaaguga

SEQ ID NO: 138372 - RNA, 1413 nt, Artificial Sequence
  derived and/or modified sequence opt3 from neuraminidase__InfluenzaA__ABY51020
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacggugaugugugucugccgggauaacuggcacggcucuaaucgccccugggugagcuucaaccagaaucuggacuaccagaucggguauauuugcucaggaguguuuggugauaacccuagaccaaaagacggcaaggggaguuguaauccgcugacugucgauggagccgacggcguuaaagguuucuccuacaaguaugggaacggcguguggaucggaaggacaaaaagcaaucggcuccgcaagggcuuugagaugaucugggaccccaacggguggaccgauacugacucugauuucucaguaaagcaagacguggucgcuauuacagauuggaguggauacagcgguuccuuugugcagcauccugaauuaaccggccuggacugcauacgaccauguuucuggguugagcuugugagaggguugcccagggaaaauacgaccaucuggacaucuggaucgagcauuuccuucugcggcgucgauucagacacugccaacuggaguuggccugauggugcagagcugccauuuaccaucgacaaauga

SEQ ID NO: 138373 - RNA, 1410 nt, Artificial Sequence; identical to SEQ ID NO: 138082
  derived and/or modified sequence opt3 from neuraminidase__InfluenzaA__ABY51031

SEQ ID NO: 138374 - RNA, 1413 nt, Artificial Sequence
  derived and/or modified sequence opt3 from neuraminidase__InfluenzaA__ABY51042
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgagaauagcaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggaaccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacuggcaccaucaagagcuggaaaaagcagaucuugagaacacaggaaucggagugcguguguaugaaugguucuugcuuuacuauuaugaccgaugggcccuccaacagggccgcgucauacaaaaucuucaagauugagaagggaaaaguaacaaagaguauagaacucaaugcaccuaacuuucacuaugaggaauguagcugcuacccagacaccggcaucguuaugugugugugccgggauaauuggcacggcuccaaccgccccugggucucuuucaaucagaaccuggacuaccaaauuggguauaucugcagcggaguguuuggugauaauccuagaccaaaagacggcgaggggucauguaacccggugacggucgauggagccgacggcguuaaggguuucaguuacaaauaugacaaugggguguggaucggcaggacuaaguccaaccggcugcgcaaaggauuugagaugauuugggaucccaauggcuggacaaacaccgacagcgauuucucuguaaagcaggacguggucgcuauaacugauuggucaggguacaguggaucuuuugugcagcauccugaacucacagguuuagacugcauccgaccauguuucuggguugagcuggugagaggccuucccagggaaaauaccacgauuuggaccuccgggucuucgaucagcuucugcggagucaacuccgauacagccaacuggucauggccugacggcgcagaguugccauuuacuauugauaaguga

SEQ ID NO: 138375 - RNA, 1413 nt, Artificial Sequence
  derived and/or modified sequence opt3 from neuraminidase__InfluenzaA__ABY51053
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcagggaaagacaagaccucgguaacacuugccggaaacucaagccuguguaguauuuccggcugggcgaucuacaccaaagauaauucuaucaggauugguagcaagggggacguguucgucauacgggaaccuuuuaucuccugcucacacuuggagugucgcacuuucuuuuuaacacaaggagcucugcuaaacgauaaacauaguaauggcaccgugaaggaccgaagcccauaucgugcccucaugucuugcccgcugggcgaagcacccuccccuuacaacucaaaguucgagagcguugccuggagugcuucugcaugucacgaugggaugggauggcuuacgauugguaucuccggcccagacaacggggccguggcuguccugaaauauaauggaauaauuacuggcaccaucaagagcuggaaaaagcagaucuugagaacacaggaaucggagugcguguguaugaacgguucuugcuuuacuauuaugaccgaugggcccuccaauagggccgcgucauacaaaaucuucaagauugagaagggaaaaguaacaaagaguauagaacucaacgcaccuaauuuucauuaugaggaauguagcugcuacccagacaccggcaucguuaugugugugugccgggauaacuggcacggcuccaaucgccccugggucucuuucaaccagaaucuggacuaccaaauuggguauaucugcagcggaguguuuggugauaacccuagaccagaggacggcgaggggucauguaauccggugacggucgauggaacugacggcguuaaagguuucaguuacaaguaugacaacgggguguggaucggcaggacaaaauccaaucggcugcgcaagggauuugaaaugauuugggaucccaacggcuggaccaauacugacagcgauuucucuguaaaacaggacguggucgccauaacagauuggucaggguacagugguagcuuugugcagcacccugagcucaccggauuagacugcauccgaccauguuucuggguugaacuggugagaggccuucccagggagaacacgaccauuuggacauccgggucuucgaucagcuucugcggagucaacuccgauacugcuaauuggucauggccugacggcgccgaauugccauuuaccauugauaaguga

SEQ ID NO: 138376 - RNA, 1413 nt, Artificial Sequence; identical to SEQ ID NO: 138145
  derived and/or modified sequence opt3 from neuraminidase__InfluenzaA__ABY51064

SEQ ID NO: 138377 - RNA, 1413 nt, Artificial Sequence; identical to SEQ ID NO: 138046
  derived and/or modified sequence opt3 from neuraminidase__InfluenzaA__ABY51075

SEQ ID NO: 138378 - RNA, 1413 nt, Artificial Sequence
  derived and/or modified sequence opt3 from neuraminidase__InfluenzaA__ABY51086
augaaccccaaucagaagaucauuaccauaggcagcaucuccauugccaucgggauuaucucuauaaugcugcaaaucggaaacauuaucucaauuugggcuagucacagcauccagacagguucccagaaucauacuggcauaugcaaccagagaauuaucacguacgaaaauucuaccugggugaaccacacauaugucaauauuaacaauacuaacguuguggcagagaaagacaagaccucgguaacacucgccggaaauucaagccuuuguaguaucuccggaugggcgaucuacaccaaagauaacucuauuaggauaggcagcaagggugacguguucgucauccgggagccuuuuauuuccugcucacaucuggaaugucgcacuuucuuuuugacacaaggggcuuuacugaaugauaaacacaguaacggaaccgugaaggaccgaagcccauaucgugcccuaaugucuugcccgcucggcgaggcacccuccccuuacaauucaaaguucgaaagcguugccuggagugcuucugcaugucaugauggcaugggguggcugacgaucggaauauccgguccagacaacggcgccguggcuguccuuaaauauaacgggauuaucacugagaccaucaagagcuggaaaaagaggauucugagaacacaggagucggaaugcguguguguaaauggaucuugcuuuacuaucaugaccgauggccccuccaacggugccgcgucauacaaaauuuucaagauagagaaggggaaaguuacaaagaguaucgaauugaaugcaccuaacuuucacuaugaggaguguagcugcuacccagacaccggaacggugaugugugucugccgggauaauuggcacggcuccaaccgccccugggugucuuucaaucagaaccucgacuaccagauuggcuauaucugcagcgggguguuuggagauaauccuagaccaaaagacgguaagggcucauguaacccggucacuguugauggggccgacggaaucaaaggcuucaguuacaaguaugguaaugggguguggauuggcaggacaaaauccaaccggcugcgcaagggauuugaaaugauaugggaccccaauggcuggaccaacacugauagcgacuucucuguaaagcaagauguggucgcuaucacagacuggucaggguacagugggagcuuugugcagcauccugagcugaccggucucgauugcauucgaccauguuucuggguugaauuagugagaggccugcccagggagaauacgaccaucuggacauccgggucuucgauuagcuucugcggagucgacggcgauacugccaacugguccuggccugacggugcagaacuuccauuuaccaucgauaaauga

SEQ ID NO: 138379 - RNA, 1413 nt, Artificial Sequence
  derived and/or modified sequence opt3 from neuraminidase__InfluenzaA__ABY51097
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcguggagcucaacgcaccuaauuuucacuaugaagaguguuccugcuacccagacaccggcacggucaugugugugugccgggauaacuggcacggcucuaaucgccccugggugagcuucaaccagaaucuggacuaccagauaggguauaucugcucaggagucuuuggugauaacccuagaccaaaagacggcaaggggaguuguaauccgguuacuguggauggagccgacggcguaaaagguuucuccuacaaguaugggaacggcguguggauuggaaggacaaaaagcaaucggcugcgcaagggcuuugagaugaucugggaccccaacggguggaccgauacugacucugauuucucagucaagcaagacgugguugcuaucacagauuggaguggauacagcgguuccuuugugcagcauccugaacucaccggcuuagacugcauucgaccauguuucugggucgagcuggugagagggcuucccagggaaaauacgaccauauggacaucuggaucgagcaucuccuucugcggcguagauucagacacugccaacuggaguuggccugauggugcagaguugccauuuaccauugacaaauga

SEQ ID NO: 138380 - RNA, 1413 nt, Artificial Sequence
  derived and/or modified sequence opt3 from neuraminidase__InfluenzaA__ABY51108
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacggugaugugugucugccgggauaacuggcacggcucuaaucgccccugggugagcuucaaccagaaucuggacuaccagaucggguauauuugcucaggaguguuuggugauaacccuagaccaaaagacggcaaggggaguuguaauccggucacuguugauggagccgacggcgugaaagguuucuccuacaaguaugggaacggcguauggaucggaaggacaaaaagcaaucggcugcgcaagggcuuugagaugaucugggaccccaacggguggaccgauacugacucugauuucucagugaagcaagacauugucgcuauaacagauuggaguggauacagcgguuccuuugugcagcauccugaacucaccggcuuagacugcauccgaccauguuucuggguugagcuggugagagggcuucccagggaaaauacgaccauuuggacaucuggaucgagcaucuccuucugcggcgucgauucagacacugccaacuggaguuggccugauggugcagaguugccauuuaccauugacaaauga

SEQ ID NO: 138381 - RNA, 1413 nt, Artificial Sequence; identical to SEQ ID NO: 138046
  derived and/or modified sequence opt3 from neuraminidase__InfluenzaA__ABY51119

SEQ ID NO: 138382 - RNA, 1410 nt, Artificial Sequence; identical to SEQ ID NO: 137900
  derived and/or modified sequence opt3 from neuraminidase__InfluenzaA__ABY51130

SEQ ID NO: 138383 - RNA, 1413 nt, Artificial Sequence; identical to SEQ ID NO: 138087
  derived and/or modified sequence opt3 from neuraminidase__InfluenzaA__ABY51141

SEQ ID NO: 138384 - RNA, 1413 nt, Artificial Sequence
  derived and/or modified sequence opt3 from neuraminidase__InfluenzaA__ABY51152
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacggugaugugugucugccgggauaacuggcacggcucuaaucgccccugggugagcuucaaccagaaucuggacuaccagaucggguauauuugcucaggaguguuuggugauaacccuagaccaaaagacggcaaggggaguuguaauccggucacuguugauggagccgacggcgugaaagguuucuccuacaaguaugggaacggcguauggaucggaaggacaaaaagcaaucggcugcgcaagggcuuugagaugaucugggaccccaacggguggaccgauacugacucugauuucucagugaagcaagacgucguggcuauuacagauuggaguggauacagcgguuccuuuguucagcauccugaacucaccggcuuagacugcauacgaccauguuucuggguggagcuggucagagggcuucccagggaaaauacgaccaucuggacaucuggaucgagcauuuccuucugcggcgugaacucagauacugccaauuggaguuggccugacggugcagaguugccauuuaccaucgauaaauga

SEQ ID NO: 138385 - RNA, 1413 nt, Artificial Sequence
  derived and/or modified sequence opt3 from neuraminidase__InfluenzaA__ABY51163
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaauucuugccggaaauucaagccuguguaguaucuccggcugggcgaucuacacaaaagauaacucuauuaggauagguagcaagggggacguguucgucauccgggagccuuuuauuuccugcucacauuuggagugucgcaccuucuuuuuaacucaaggagcucugcuaaaugauaaacacaguaacggcacagugaaggaccgaagcccauaucgugcccucaugucuugcccgcugggcgaagcacccuccccuuacaauucaaaguucgagagcguugccuggagugcuucugcaugucaugaugggaugggauggcuuaccaucgguauauccggcccagacaacggggccguggcuguccugaaauauaacggaauuaucacggaaacuaucaagagcuggaaaaagagaauuuugaggacccaggagucggagugcguguguguaaauggcucuugcuuuacaaucaugacugauggucccuccaacggggccgcgucauacaaaauuuucaagauagaaaagggaaaaguuaccaagaguaucgagcucaaugcaccuaacuuucacuaugaagaguguagcugcuacccagacacaggcaccgugaugugugucugccgggauaauuggcacggcuccaaccgccccugggugucuuucaaucagaaccuggacuaccagauuggguauaucugcagcggaguguuuggugauaauccuagaccaaaagacggcaaggggucauguaacccggucacgguugauggagccgacggcgugaaagguuucaguuacaaguaugggaauggcguauggaucggaaggacuaaauccaaccggcugcgcaagggcuuugagaugauuugggaccccaauggguggacagauaccgacagcgauuucucugugaagcaagacgucguggcuauaacugauuggucaggauacagugguagcuuuguucagcauccugaacucacaggcuuagacugcauccgaccauguuucuggguggagcuggucagagggcuucccagggaaaacaccacgauuuggaccuccggaucuucgaucagcuucugcggcguggauuccgacacagccaauuggucauggccugauggugcagaguugccauuuacuauugacaaauga

SEQ ID NO: 138386 - RNA, 1413 nt, Artificial Sequence
  derived and/or modified sequence opt3 from neuraminidase__InfluenzaA__ABY51174
augaaccccaaucagaagaugaucaccauuggcagcauauccaucgccauugggaucauuucucugaugcuccaaaucggaaacauaaucucaauuugggcuagucacagcauccagacagguucccagaaucauacuggcauuugcaaccagagaaucauaacguacgagaauagcaccugggugaaccacacauaugucaauauuaacaauacuaacguuguggcagggaaagacaagaccucgguaacacuugccggaaauucaagccuguguaguaucuccggcugggcgauuuacaccaaagauaacucuaucaggaucgguagcaagggggacguguucgucauucgggaaccuuuuauauccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgaucgguauuuccggcccagacaacggggccguggcuguccugaaauauaacggaaucauaacugaaaccauuaagagcuggaaaaagagaaucuugaggacacaggagucggagugcguguguguaaauggcucuugcuuuacuaucaugaccgauggucccuccaacggggccgcgucauacaaaauuuucaagaucgaaaagggaaaaguuacaaagaguauugagcucaaugcaccuaacuuucacuaugaagaguguagcugcuacccagacaccggcacggugaugugugucugccgggauaauuggcacggcuccaaccgccccugggugucuuucaaucagaaccuggacuaccaggugggguauauaugcagcggagucuuuggugauaauccuagaccaaaagacggcaaggggucauguaacccgaugacuguugauggagccgacggcgugaaagguuucaguuacaaguaugggaauggcguauggaucggaaggacaaaauccaacaagcugcggaagggcuuugagaugauuugggaccccaauggguggaccgauacugacagcgauuucucugugaaacaagacgucguggcuaucacagauuggucaggauacagugguagcuuuguucagcauccugaacucaccggcuuagacugcauccgcccauguuucuggguggagcugguccgagggcuucccagagaaaacacgaccauuuggacauccggaucuucgauaucuuucugcggcguggauuccgacacugccaauuggucauggccugauggugcagaguugccauuuaccaucgacaaguga

SEQ ID NO: 138387 - RNA, 1413 nt, Artificial Sequence; identical to SEQ ID NO: 138046
  derived and/or modified sequence opt3 from neuraminidase__InfluenzaA__ABY51185

SEQ ID NO: 138388 - RNA, 1413 nt, Artificial Sequence; identical to SEQ ID NO: 138081
  derived and/or modified sequence opt3 from neuraminidase__InfluenzaA__ABY51196

SEQ ID NO: 138389 - RNA, 1410 nt, Artificial Sequence; identical to SEQ ID NO: 138082
  derived and/or modified sequence opt3 from neuraminidase__InfluenzaA__ABY51229

SEQ ID NO: 138390 - RNA, 1413 nt, Artificial Sequence
  derived and/or modified sequence opt3 from neuraminidase__InfluenzaA__ABY51240
augaaccccaaucagaagaucauuaccauaggcagcaucuccauugccaucgggauuaucucucugaugcuccaaauaggaaacaucauuucagugugggcuagucacagcauccagacagguucccagaaucauacuggcauuugcaaccagagaaucauaacguacgaaaauucuaccugggucaaccacacauauguuucgauuaauaacacuaaugugguagcagggaaagacaagaccucagugacacuugccggaaacagcagucuguguuccaucucuggcuggagcauuuacaccaaagauaauuccaucaggaucgguucaaagggggacgucuucgugauucgggagccuuuuauaaguugcagccauuuggagugucgcacuuucuuuuuaacacaaggagcgcugcuaaacgauaaacacucuaauggcaccguuaaggaccgauccccauaucgugcucucaugucaugcccgcugggcgaagcccccagcccuuacaacaguaaguucgagucuguggcaugguccgccagcgcuugucaugaugggaugggauggcuuacgaucgguauuucgggcccagacaauggggcagucgccgugcugaaauauaacggaaucauaacugaaaccauuaagucuuggaaaaagagaaucuugaggacacaggaguccgagugcguauguguuaacggcucaugcuuuacuaucaugaccgauggucccaguaauggggcugccagcuacaaaauuuucaagaucgaaaagggaaaagugacaaaguccauugagcucaacgcgccuaauuuucacuaugaagaguguucuugcuacccagacaccggcacggucaugugugugugccgggauaacuggcacggcagcaaucgccccugggugucauucaaccagaaucuggacuaccagauaggguauaucugcaguggagucuuuggugauaacccuagaccaaaagacggcaagggguccuguaauccgguuacuguggauggagcagacggcguaaaagguuucagcuacaaguaugggaacggcguguggauuggaaggacaaaaucuaaucggcugcgcaagggcuuugagaugaucugggaccccaacggguggaccgauacugacucagauuucagugucaagcaagacgugguugccaucacagauuggagcggauacuccgguucuuuugugcagcauccugaacucaccggcuuagacugcauucgaccauguuucugggucgagcuggugagagggcuucccagggaaaauacgaccauauggacaucgggaagcuccaucucauucugcggcguagauagugacacugcuaacuggucuuggccugauggugccgaguugccauuuaccauugacaaauga

SEQ ID NO: 138391 - RNA, 1413 nt, Artificial Sequence; identical to SEQ ID NO: 138072
  derived and/or modified sequence opt3 from neuraminidase__InfluenzaA__ABY51251

SEQ ID NO: 138392 - RNA, 1413 nt, Artificial Sequence
  derived and/or modified sequence opt3 from neuraminidase__InfluenzaA__ABY51262
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacggugaugugugucugccgggauaacuggcacggcucuaaucgccccugggugagcuucaaccagaaucuggacuaccagaucggguauauuugcucaggaguguuuggugauaacccuagaccaaaagacggcaaggggaguuguaauccggucacuguugauggagccgacggcgugaaagguuucuccuacaaguaugggaacggcguauggaucggaaggacaaaaagcaaucggcugcgcaagggcuuugagaugaucugggaccccaacggguggaccgauacugacucugauuucucagugaagcaagacgucguggcuauuacagauuggaguggauacagcgguuccuuuguucagcauccugaacucaccggcuuagacugcauacgaccauguuucuggguggagcuggucagagggcuucccagggaaaaugccacgaucuggaccucuggaucgagcauuuccuucugcggcguggauucagacacagcaaacuggaguuggccugauggugcugaguugccauuuacuaucgacaaauga

SEQ ID NO: 138393 - RNA, 1410 nt, Artificial Sequence; identical to SEQ ID NO: 137900
  derived and/or modified sequence opt3 from neuraminidase__InfluenzaA__ABY51273

SEQ ID NO: 138394 - RNA, 1350 nt, Artificial Sequence
  derived and/or modified sequence opt3 from neuraminidase__InfluenzaA__ABY76285
augaaccccaaucagaagaucauuaccauaggcagcaucugcauggugauugggaucgucucccugaugcuccaaauuggaaacaugaucucuauauggguuucacacaguauccagacagguaaucagagacaggccgagccuauuagcaacacuaaauuccuuacggaaaaggcuguggcauccguaacccuggccggcaauucuucguuguguccaaucucagggugggcgguguacagcaaagacaacaguauuaggaucggauccaagggcgaugucuuugugauacgggagccguucauuucuugcagccauuuagaaugucgcacauuuuuccugacucaaggugcucuacucaaugacaaacacuccaacgggaccguuaaggaucgaucaccccaucguacacugaugaguugcccugugggagaggccccaagccccuauaauucuagauuugaauccgucgcauggucagccagcgcuugucacgacggcaccaguuggcuuacuaucggcauuucugggccugauaacggagcaguggccguacugaaguacaaugguaucaucacagacaccauuaaauccuggaggaacaauauauugcggacgcaggagagcgagugcgcuuguguuaacggcucgugcuucacugugaugaccgaugggccaucuaauggacaggccuccuauaagaucuuuaaaauggaaaagggcaaagucgugaagucaguggagcucgacgcgcccaacuaccauuaugaagaguguaguugcuacccugaugccggugagauuacaugugucugccgcgacaacuggcacgggagcaauagaccauggguuuccuucaaccagaaucuggaauaucaaaucggauacauaugcucuggcguguuuggcgauaacccgaggcccaaugacgggacuggaagcugugguccuguaucaccaaacggcgcauacggggugaagggauucaguuuuaaauauggcaauggugucuggauugggcggaccaaguccacaaacagccgcucuggcuucgagaugaucugggaucccaauggauggaccggcacggacucaaguuuuagcgugaaacaggacaucguugcuauuacugauugguccggguacucuggaucguucgugcagcacccugaacugacaggucucgacugcauccgaccauguuucugggucgaguuaauuagaggcaggcccaaggaaagcaccauauggacuuccgggucaaguaucucuuuuugcggagugaacagcgauacaguauccuggucauggccggacggcgccgagcugccuuucaccauugauaaauga

SEQ ID NO: 138395 - RNA, 1413 nt, Artificial Sequence
  derived and/or modified sequence opt3 from neuraminidase__InfluenzaA__ABY81352
augaaccccaaucagaagaucauuaccauaggcagcaucugcauggccauugggaucauuucccugauccuccaaauaggaucuaucauuucaaucugggugagucacagcauucagacagguucccagaaccauacuggcaucuguaaucagagaauaauuacguacgagaacucuaccugggucaaucaaacauauguuaacaucucgaauacuaacgugguagcugggaaagacaccacaucaaugacccuugcaggaaauagcagucugugcccuauuaggggcugggccaucuacuccaaggauaacucuauccggauugguagcaaaggggacguguucgucauacgcgaaccauuuaucuccuguucacacuuggagugccgaacuuucuuuuuaacacagggagcgcugcuaaaugauaagcauaguaacggcaccgugaaagaccguagcccguauagagcucucaugucuugucccauuggcgaagccccuuccccauacaauucaagguucgagagcguugcauggagugccucugcuugccacgaugggaugggauggcugacgaucgguauauccggccccgacgauggggcaguggccguccuuaaguauaacggaauuaucacugaaaccaucaagagcuggcggaaacagauucugcgcacacaggagucggagugugugugcguaaauggcucuuguuuuacuaucaugaccgacgguccuuccgaugggcaggcuucauacagaauuuucaagauagaaaaaggaaagaucacaaaaaguauugaguuggacgccccaaacagccauuaugaagagugcuccuguuaccccgauaccggcacgguuaugugcgugugcagggacaacuggcacggcucuaaucggccuugggucagcuuuaaccaaaaucucgauuaccagaucggguauaucuguucaggaguguucggugacaacccacgcccgaaggacggcaaggggaguugcgaucccgugaaugucgacggagcggauggcguuaaagguuuuuccuaccgauaugggaacggcguguggauuggaagaacuaagagcaauucuucaaggaaaggcuucgagaugauaugggacccuaacggguggacagauaccgacaguaauuuucugguaaagcaggauguggucgcaaugacugacuggagcggauacuccgguucuuucgugcaacacccagaacugacaggccucgauuguaugcggcccugcuuuuggguugaguuaauccgugggcgcccuagagagaaaaccacgauuuggaccucgggaagcuccaucucauucuguggcgugaacagugacacagucaauuggucuuggccagauggugccgaacugcccuucacuauugacaaguga

SEQ ID NO: 138396 - RNA, 1413 nt, Artificial Sequence
  derived and/or modified sequence opt3 from neuraminidase__InfluenzaA__ABY81363
augaaccccaaucagaagaucauuaccauaggcagcaucuccauugccaucgggauuaucucucugaugcuccaaauaggaaacaucauuucaaucugggcuagucacagcauucagaucgguucccagaaucauacaggcauaugcaaccagagaauuaucacuuacgaaaauucuacgugggugaaccacaccuaugucucgauuaauaacacaaauguuguggcagggaaagacaagacuucaguaacccuugccggaaacagcagucuguguuccaucucuggcugggcgaucuacacaaaagauaauagcauuaggauagguuccaagggggacguguucgucauccgggagccuuuuauuucaugcagucauuuggagugucgcaccuucuuuuuaacucaaggagcucugcuaaacgauaaacacagcaauggcacagugaaggaccgaucuccauaucgugcccucauguccugcccgcugggcgaagcacccucaccuuacaacagcaaguucgagaguguugccuggucugcuuccgcaugucaugaugggaugggauggcuuaccaucgguauaagcggcccagacaauggggccguggcuguccugaaauauaacggaauuaucacggaaacuaucaagucguggaaaaagagaauuuugaggacccaggagucugagugcguguguguaaacggcuccugcuuuacaaucaugacugauggucccucaaauggggccgcgaguuacaaaauuuucaagauagaaaagggaaaaguuaccaagagcaucgagcucaacgcaccuaauuuucacuaugaagaguguuccugcuacccagacacaggcaccgugaugugugucugccgggauaacuggcacggcucuaaucgccccugggugagcuucaaccagaaucuggacuaccagauuggguauaucugcucaggaguguuuggugauaacccuagaccaaaagacggcaaggggaguuguaauccggucacgguugauggagccgacggcgugaaagguuucuccuacaaguaugggaacggcguauggaucggaaggacuaaaagcaaucggcugcgcaagggcuuugagaugauuugggaccccaacggguggacagauaccgacucugauuucucagugaagcaagacgucguggcuauaacugauuggaguggauacagcgguuccuuuguucagcauccugaacucacaggcuuagacugcauccgaccauguuucuggguggagcuggucagagggcuucccagggaaaauaccacgauuuggaccucuggaucgagcaucuccuucugcggcguggauucagacacagccaacuggaguuggccugauggugcagaguugccauuuacuauugacaaauga

SEQ ID NO: 138397 - RNA, 1410 nt, Artificial Sequence; identical to SEQ ID NO: 138082
  derived and/or modified sequence opt3 from neuraminidase__InfluenzaA__ABY81374

SEQ ID NO: 138398 - RNA, 1413 nt, Artificial Sequence; identical to SEQ ID NO: 138046
  derived and/or modified sequence opt3 from neuraminidase__InfluenzaA__ABY81385

SEQ ID NO: 138399 - RNA, 1413 nt, Artificial Sequence
  derived and/or modified sequence opt3 from neuraminidase__InfluenzaA__ABY81407
augaaccccaaucagaagaucauuaccauaggcagcaucuccauugccaucgggacaauuucucugaugcuccaaaucggaaacauaaucucaauuugggcuagucacagcauccagacugguucccagaaucauacgggcauuugcaaccagagaaucauaaccuacgaaaauucuacaugggugaaccacacuuaugucucgauuaauaacaccaauguuguggcagggaaagacaagacaucaguaacccuugccggaaacagcagucuguguuccaucucuggcugggcgauuuacacuaaagauaauagcaucaggaucgguuccaagggggacguguucgucauucgggagccuuuuauaucaugcagucauuuggagugucgcacauucuuuuuaacccaaggagcucugcuaaacgauaaacacagcaauggcacggugaaggaccgaucuccauaucgugcccucauguccugcccgcugggcgaagcacccucaccuuacaacagcaaguucgagaguguugccuggucugcuuccgcaugucaugaugggaugggauggcuuacuaucgguauuagcggcccagacaauggggccguggcuguccugaaauauaacggaaucauaaccgaaacaauuaagucguggaaaaagagaaucuugaggacucaggagucugagugcguguguguaaacggcuccugcuuuaccaucaugacagauggucccucaaauggggccgcgaguuacaaaauuuucaagaucgaaaagggaaaaguuaccaagagcauugagcucaacgcaccuaauuuucacuaugaagaguguuccugcuacccagacacgggcacugugaugugugucugccgggauaacuggcacggcucuaaucgccccugggugagcuucaaccagaaucuggacuaccagauaggguauaucugcucaggaguguuuggugauaacccuagaccaaaagacggcaaggggaguuguaauccggucacaguugauggagccgacggcgugaaagguuucuccuacaaguaugggaacggcguauggauuggaaggaccaaaagcaaucggcugcgcaagggcuuugagaugaucugggaccccaacggguggacugauacagacucugauuuccucgugaagcaagacgucguggcuaucaccgauuggucaggauacagugguagcuuuguucagcauccugaauuaacgggccuggacugcauucgaccauguuucuggguggagcuugucagaggguugcccagggaaaauaccacaauauggacuuccggaucuucgaucagcuucugcggcguggauuccgacaccgccaacuggucauggccugauggugcagagcugccauuuacaauugacaaauga

SEQ ID NO: 138400 - RNA, 1410 nt, Artificial Sequence; identical to SEQ ID NO: 138082
  derived and/or modified sequence opt3 from neuraminidase__InfluenzaA__ACA24505

SEQ ID NO: 138401 - RNA, 1413 nt, Artificial Sequence; identical to SEQ ID NO: 138046
  derived and/or modified sequence opt3 from neuraminidase__InfluenzaA__ACA24516

SEQ ID NO: 138402 - RNA, 1413 nt, Artificial Sequence; identical to SEQ ID NO: 138046
  derived and/or modified sequence opt3 from neuraminidase__InfluenzaA__ACA24527

SEQ ID NO: 138403 - RNA, 1410 nt, Artificial Sequence
  derived and/or modified sequence opt3 from neuraminidase__InfluenzaA__ACA24692
augaaccccaaucagaagaucauuaccauaggcagcgugucccugacaaucucuacuauuugcuucuuuaugcaaaucgccauucucaucacgaccgucacacuucacuucaaacaguacgaguuuucaccuccaccgaacaaucagguuaugcugugugaacccacuauaaucgagagaaacauuaccgaaaucguguauuugacaaauaccacuauugagaaggaaaucugcccuaaauuagcugaguacaggaacuggaguaagccacagugugacauaacaggguucgcacccuuuagcaaagauaauuccauucggcugucugccggaggugacaucuggguaacccgcgagccuuaugugucgugcgauccagacaaguguuaccaauucgcgcuaggccaggggacgacucucaacaauguccauucaaacgauaccgugcacgaccgaacacccuaucguacucugcuuaugaaugaacugggaguuccuuuucauuugggcaccaaacaggugugcauugcuuggagcaguuccucuugucacgaugguaaggccuggcuccaugucugcgugacaggggacgauaagaacgcaaccgccagcuucaucuacaauggaagacugguagacuccaucguuucauggaguaaagagauucugaggacgcaggaaagcgagugugugugcauaaacggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccacgguacccgggcguucgcugugugugcagagauaauuggaagggguccaacaggcccauaguagacauuaacaucaaagacuacagcaucgugucgaaguaugucuguucuggacuggugggcgauacgccucggaaaaaugacuccucaaguagcucccauugccuugauccaaacaaugaggaaggugggcacggaguuaagggcugggcuuucgacgauggcaacgacguguggauggggcgcaccauuucugagaaaagccgaucaggauacgagacauuuaaggucaucgaagguuggaguaaucccaacuccaaauugcagauuaauagacaggugauaguagauaggggcaaccggagcggguauucuggaaucuucucaguugagggcaagaguuguauuaaucguugcuuuuacguggaacugauccgcgguagaaacgaggaaacugagguccuauggaccagcaauuccaucguggucuucugugggacaucuggcacuuauggaaccggcucguggccugacggggccgauauuaaccucaugccaauauga

SEQ ID NO: 138404 - RNA, 1410 nt, Artificial Sequence
  derived and/or modified sequence opt3 from neuraminidase__InfluenzaA__ACA24703
augaaccccaaucagaagaucauuaccauaggcagcgugucccugacaaucucuacuauuugcuucuuuaugcagaucgccauucucaucacgaccgucacacuucacuucaaacaguacgaguuuucaaguccuccaaacaaucagguuaugcugugugaaccgacuauaaucgagagaaacauuaccgaaaucguguauuugacaaauauuaccaucgagaaggaaacuugccccaaauuagcugaguacaggaacuggagcaagccucagugugacauaacaggguucgcaccauuuuccaaagauaauucuauucggcugucggccggaggugacaucuggguaacccgcgagcccuaugugucaugcgauccugacaaguguuaccaauucgcgcuaggccaggggacgacucucaacaauguccauagcaacgauaccgugcacgaccgaacaccauaucguacucugcuuaugaaugaacugggaguucccuuucauuugggcaccaaacaggugugcauugcuuggaguuccucuagcugucacgaugguaaggccuggcuccaugucugcgugacaggggacgauaagaacgcaaccgccuccuucaucuacaauggaagacugguagacucaaucguuaguuggagcaaagagauucugaggacgcaggaaucugagugugugugcauaaacggcacuuguacagucgugaugaccgauggcuccgcuucagggaaugcagacacuaagauccucuuuauugaggaaggaaaaaucgugcacacaagcaccuuaagugguucugcccaacacgucgaggaaugcuccugcuauccucgguacccaggcguucgcugugugugcagagauaacuggaaggggagcaacaggccgauaguagacauuaauaucaaggacuacucgaucgugucucgguaugucuguuccggacuggugggcgauacgccccgcaaaaacgacucaaguagcuccucucauugccuugauccuaauaacgaggaaggugggcacggaguuaagggcugggcuuucgacgauggcaaugacguguggauggggcgaaccauuagcgagaaaucaagaaguggauacgagacauuuaaggucaucgaagguugguccaacccaaauagcaaauugcagauuaacaggcaagugauaguagaucggggcaaucguucuggguauucaggaaucuucaguguugagggcaagagcuguauuaaccgcugcuuuuacguggaacugaucagagguaggaaagaggaaacugagguccuauggaccuccaauucuaucguggucuucugugggacaucgggcacuuauggaaccggcagcuggcccgacggggccgauauuaaccucaugccuauauga

SEQ ID NO: 138405 - RNA, 1413 nt, Artificial Sequence
  derived and/or modified sequence opt3 from neuraminidase__InfluenzaA__ACA33539
augaaccccuaccagaagaucauuaccauaggcagcaucuccauugccaucgggauuaucucucugaugcuccaaauaggaaauaucauuucaaucugggcuagucacagcauucagacagguucccagaaccauacuggcaucugcaaucagagaauaauuacguaugagaacucuaccugggugaaucacacauacgucucgaucaacaauacuaacguuguggcagggaaagacaagaccucaguaacacuugccggaaauagcagucuguguuccauuucuggcugggcgaucuauaccaaagauaacagcaucaggauugguuccaagggggacguguucgucauacgggaaccuuuuaucucaugcagucauuuggagugucgcacuuucuuuuuaacacaaggagcucugcuaaaugauaaacacagcaacggcaccgugaaggaccgaucuccauaccgugcccucauguccugcccgcugggcgaagcacccucaccuuauaauagcaaguucgagaguguugccuggucugcuuccgcaugucaugaugggaugggauggcuuacgauugguaucagcggcccagacaacggggccguggcuguccugaaauacaauggaauaauuacugaaaccaucaagucguggaaaaagagaaucuugaggacacaggagucugagugcguguguguaaacggcuccugcuuuacuauuaugaccgauggucccucaaacggggccgcgaguuauaaaaucuucaagauugaaaagggaaaaguuacaaagagcauagagcucaaugcaccuaacuuuuacuacgaagaguguuccugcuauccagacaccggcacggugaugugugucugccgggauaauuggcacggcucuaaccgccccugggugagcuucaaucagaaccuggacuaccagaucggguauauuugcucaggaguguuuggugauaauccuagaccaaaagacggcaaggggaguuguaacccggucacuguugauggagccgacggcgugaaagguuucuccuacaaguaugggaauggcguauggaucggaaggacaaaaagcaaccggcugcgcaagggcuuugagaugaucugggaccccaauggguggaccgauacugacucugauuucucagugaagcaagacgucguggcuauuacagauuggaguggauacagcgguuccuuuguucagcacccugaacucaccggcuuagacugcauacgaccauguuucuggguggagcuggucagagggcuucccagggaaaacacgaccaucuggacaucuggaucgagcauuuccuucugcggcguggauucagacacugccaauuggaguuggccugauggugcagaguugccauuuaccaucgacaaauga

SEQ ID NO: 138406 - RNA, 1413 nt, Artificial Sequence
  derived and/or modified sequence opt3 from neuraminidase__InfluenzaA__ACA33540
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuuuauuacgaagaguguuccugcuacccagacaccggcacggugaugugugucugccgggauaacuggcacggcucuaaucgccccugggugagcuucaaccagaaucuggacuaucagaucggguacauuugcucaggaguguuuggugauaacccuagaccaaaagacggcaaggggaguuguaauccggucacuguugauggagccgacggcgugaaagguuucuccuauaaguacgggaacggcguauggaucggaaggacaaaaagcaaucggcugcgcaagggcuuugagaugaucugggaccccaacggguggaccgauacugacucugauuucucagugaagcaagacgucguggcuauuacagauuggaguggauauagcgguuccuuuguucagcacccugaacucaccggcuuagacugcauacgaccauguuucuggguggagcuggucagagggcuucccagggaaaauacgaccaucuggacaucuggaucgagcauuuccuucugcggcguggauucagacacugccaacuggaguuggccugauggugcagaguugccauuuaccaucgacaaauga

SEQ ID NO: 138407 - RNA, 1413 nt, Artificial Sequence
  derived and/or modified sequence opt3 from neuraminidase__InfluenzaA__ACA33582
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuuuauuacgaagaguguuccugcuacccagacaccggcacggugaugugugucugccgggauaacuggcacggcucuaaucgccccugggugagcuucaaccagaaucuggacuaucagaucggguacauuugcucaggaguguuuggugauaacccuagaccaaaagacggcaaggggaguuguaauccgaugacugucgauggagccgacggcguuaaagguuucuccuauaaguacgggaacggcguguggaucggaaggacaaaaagcaaucggcugcgcaagggcuuugagaugaucugggaccccaacggguggaccgauacugacucugauuucucaguaaagcaagacguggucgcuauuacagauuggaguggauauagcgguuccuuugugcagcacccugaacucaccggcuuagacugcauacgaccauguuucuggguugagcuggugagagggcuucccagggaaaauacgaccaucuggacaucuggaucgagcauuuccuucugcggcgucgauucagacacugccaacuggaguuggccugauggugcagaguugccauuuaccaucgacaaauga

SEQ ID NO: 138408 - RNA, 1413 nt, Artificial Sequence
  derived and/or modified sequence opt3 from neuraminidase__InfluenzaA__ACA33622
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagagaaucuugaggacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuuuauuacgaagaguguagcugcuacccagacaccggcacggugaugugugucugccgggauaauuggcacggcuccaaccgccccugggugucuuucaaucagaaccuggacuaucagaucggguacauuugcagcggaguguuuggugauaauccuagaccaaaagacggcaaggggucauguaacccggucacuguugauggagccgacggcgugaaagguuucaguuauaaguacgggaauggcguauggaucggaaggacaaaauccaaccggcugcgcaagggcuuugagaugaucugggaccccaauggguggaccaacacugauagcgacuucucugugaagcaagaugucguggcuauuacagacuggucaggauauagugguagcuuuguucagcacccugaacucaccggcuuagauugcauacgaccauguuucuggguggagcuggucagagggcuucccagggaaaauacgaccaucuggacauccggaucuucgauuagcuucugcggcguggacuccgauacugccaacuggucauggccugacggugcagaguugccauuuaccaucgauaaauga

SEQ ID NO: 138409 - RNA, 1413 nt, Artificial Sequence; identical to SEQ ID NO: 138085
  derived and/or modified sequence opt3 from neuraminidase__InfluenzaA__ACA96522

SEQ ID NO: 138410 - RNA, 1362 nt, Artificial Sequence
  derived and/or modified sequence opt3 from neuraminidase__InfluenzaA__ACC55274
augaaccccaaucagaagaucauuaccauaggcagcgugucccugacaaucgccacugucugcuuccucaugcaaauugcuauccuugcaaugacgguuacccugcacuuuagacagaacgaguguucuauuucagccaauagucaggugguaccuugcgaaccaacaacugagaaagaaguguguagcaaggucguggacuacagguccuggucuaaaccgcagugccaaaucaccggguucgcgcccuuuucgaaggauaacucaauacgguugagcgcuggaggugacaucuggauuacacgcgagccuuauguuaguugugauaccuccaaaugcuaccaguucgccuuaggccaggggacuacacuggacaaugaacauucuaacggaaccauccacgaucguauuccacaucgaacgcuacucaugaaugagcugggcgugcccuuucaccuugguacuagacaggucuguaucgcauggagcuccucaaguugccaugacgggaaggccuggcugcacguguguguaaccggagaugacaggaacgcuacagccagcuucauauauaauggcauguugguugauucuauuggcuccuggucacaaaacauccuccggacucaggagagcgaaugcguguguauuaaugggaguugcaccgucgugaugacagacggaucugcauccgguaaggcugauacccgcauccuguuugugaaagagggcaagaucguccacauuagcccucugucggggucugcccagcauauagaagagugcuccuguuacccaagauaucccaacguuaggugcgugugucgggacaauuggaaaggaucaaaccgcccuguaaucgauauuaauaugacggacuacaguaucgacagcuccuaugugugcucuggccucgucggugauacuccacgaaacgaggacagcucaaguuccagcaacuguagagauccgaaugaagagagggggaaccccggagugaagggcugggcguucgacucuggcgaugacguuuggauggggcggacaauaucacgugauagucgcagcggauacgaaaccuuuagagugauugguggcuggacuacagcaaauuccaaaucucagaccaacaggcaagucaucguggacaauaacaauuggucgggguacagcggaaucuucuccguagagcacaagucaugcauuaaccgguguuuuuauguugaauuaauccgaggccgcccuaaggagacgagagugugguggaccaguaauucuauugucguguucugcgguacaagcgggacuuacggcaccggauccuggccagauggcgccaacauaaauuuuaugcccaucuga

SEQ ID NO: 138411 - RNA, 1413 nt, Artificial Sequence; identical to SEQ ID NO: 138345
  derived and/or modified sequence opt3 from neuraminidase__InfluenzaA__ACC61967

SEQ ID NO: 138412 - RNA, 1413 nt, Artificial Sequence
  derived and/or modified sequence opt3 from neuraminidase__InfluenzaA__ACD11077
augaaccccaaucagaagaucauuaccauaggcagcaucugcauggccauugggaucauuucccugauccuccaaauaggaaacaucauuucuaucugggugucacacaguauucagacagguagccagaaucauacuggcaucuguaaccagagaauaauuacguacgaaaauuccaccugggucaaccaaacauauguuaauaucucuaacacuaaugugguagcugggaaagugaccacaucgaugacccuugcaggaaacucaagccugugcccuauuaggggcugggccaucuacaguaaggacaauuccauccggauugguucuaaaggggaugucuucgugauacgcgaaccauuuaucagcuguucccacuuggagugccgaacuuucuuuuuaacacagggagcgcugcuaaacgacaagcauucaaauggcaccguuaaagaucguaguccguauagagcucucaugagcugucccauuggcgaagccccuucuccauacaacuccagguucgagucaguggcauggagcgccagugcuugccacgacgggaugggauggcugacgaucgguauaucuggccccgaugacggggcagucgccgugcuuaaguauaauggaauuaucacugaaaccaucaaguccuggcggaaacagauucugcgcacacaggagagcgaguguguaugcguuaacggcucguguuuuacuaucaugaccgaugguccuucugacgggccagcuuccuacagaauuuucaagauagaaaaaggaaagaucacaaaaucaauugaguuggaugcccccaacagucauuaugaagagugcagcuguuacccugacaccggcacggugaugugcgucugcagggauaauuggcacggcuccaaccggccaugggugucuuuuaaucaaaaccucgacuaccagaucggguauaucuguagcggaguguucggugauaauccgcgccccaaggacggcaaggggucaugcgacccugucaacguugauggagcggacggcgugaaagguuuuaguuaccgauaugggaauggcguauggauuggaagaacuaaguccaacaauagcaggaaaggcuucgagaugauaugggauccaaacggguggacagacaccgauucuaauuuucuggugaagcaggacgucguggcaaugacugauuggucaggauacagugguagcuucguucagcaccccgaacugacaggccucgacuguaugcggccuugcuuuuggguggaguuaauccgugggcgcccaagagagaaaaccacgauuuggaccuccggaucuucgaucagcuucuguggcgucaacuccgauacagugaauuggucauggcccgacggugccgagcugccgcuuacuauugauaaguga

SEQ ID NO: 138413 - RNA, 1413 nt, Artificial Sequence
  derived and/or modified sequence opt3 from neuraminidase__InfluenzaA__ACD11078
augaaccccaaucagaagaucauuaccauaggcagcaucugcauggccauugggaucauuucccugauccuccaaauaggaaacaucauuucuaucugggugucacacaguauucagacagguagccagaaucauacuggcaucuguaaccagagaauaauuacguacgaaaauuccaccugggucaaccaaacauauguuaauaucucuaacacuaaugugguagcugggaaagacaccacaucgaugacccuugcaggaaacucaagccugugcccuauuaggggcugggccaucuacaguaaggauaauuccauccggauugguucuaaaggggacguguucgucauacgcgaaccauuuaucagcuguucccacuuggagugccgaacuuucuuuuuaacacagggagcgcugcuaaacgauaagcauucaaauggcaccgugaaagaccguaguccguauagagcucucaugagcugucccauuggcgaagccccuucuccauacaacuccagguucgagucaguugcauggagcgccagugcuugccacgaugggaugggauggcugacgaucgguauaucuggccccgacgauggggcaguggccguccuuaaguauaauggaauuaucacugaaaccaucaaguccuggcggaaacagauucugcgcacacaggagagcgagugugugugcguaaacggcucguguuuuacuaucaugaccgacgguccuucugaugggccagcuuccuacagaauuuucaagauagaaaaaggaaagaucacaaaaucaauugaguuggacgcccccaacagucauuaugaagagugcagcuguuacccugauaccggcacgguuaugugcgugugcagggacaauuggcacggcuccaaccggccaugggucucuuuuaaucaaaaccucgauuaccagaucggguauaucuguagcggaguguucggugacaauccgcgccccaaggacggcaaggggucaugcgauccugugaacgucgacggagcggauggcguuaaagguuuuaguuaccgauaugggaauggcguguggauuggaagaacuaaguccaacagcucuaggaaaggcuucgagaugauaugggacccaaauggguggacagauaccgacucaaacuuucugguaaagcaggauguggucgcaaugacugacuggaguggauacagcgguuccuucgugcagcaccccgaacugacaggccucgauuguaugcggccuugcuuuuggguugaguuaauccgugggcgcccaagagagaaaaccacgauuuggaccucuggaucgagcaucuccuucuguggcgucaauucagacacagugaacuggaguuggcccgauggugccgagcugccgcuuacuauugacaaguga

SEQ ID NO: 138414 - RNA, 1413 nt, Artificial Sequence
  derived and/or modified sequence opt3 from neuraminidase__InfluenzaA__ACD11079
augaaccccaaucagaagaucauuaccauaggcagcaucugcauggccauugggaucauuucccugauccuccaaauaggaaacaucauuucuaucugggugucacacaguauucagacagguagccagaaucauacuggcaucuguaaccagagaauaauuacguacgaaaauuccaccugggucaaccaaacauauguuaauaucucuaacacuaaugugguagcugggaaagacaccacaucgaugacccuugcaggaaacucaagccugugcccuauuaggggcugggccaucuacaguaaggauaauuccauccggauugguucuaaaggggacguguucgucauacgcgaaccauuuaucagcuguucccacuuggagugccgaacuuucuuuuuaacacagggagcgcugcuaaacgauaagcauucaaauggcaccgugaaagaccguaguccguauagagcucucaugagcugucccauuggcgaagccccuucuccauacaacuccagguucgagucaguugcauggagcgccagugcuugccacgaugggaugggauggcugacgaucgguauaucuggccccgacgauggggcaguggccgucauuaaguauaauggaaucaucacugaaaccauuaaguccuggcggaaacagauccuucgcacacaggagagcgagugugugugcguaaacggcucguguuuuacuauuaugaccgacgguccuucugaugggccagcuuccuacagaauauucaagaucgaaaaaggaaagauuacaaaaucaaucgagcuggacgcccccaacagucauuaugaagagugcagcuguuacccugauaccggcacgguuaugugcgugugcagggacaauuggcacggcuccaaccggccaugggucucuuuuaaucaaaacuuggauuaccagaucggguauauuuguagcggaguguucggugacaauccgcgccccaaggacggcaaggggucaugcgauccugugaacgucgacggagcggauggcguuaaagguuuuaguuaccgauaugggaauggcguguggauaggaagaacuaaguccaacagcucuaggaaaggcuucgagaugaucugggacccaaauggguggacagauaccgacucaaacuuucucguaaagcaggauguggucgcaaugacugacuggaguggauacagcgguuccuucgugcagcaccccgaacugacaggccuggauuguaugcggccuugcuuuuggguugagcucauucgugggcgcccaagagagaaaaccacgaucuggaccucuggaucgagcauuuccuucuguggcgucaauucagacacagugaacuggaguuggcccgauggugccgaguuaccgcugacuaucgacaaguga

SEQ ID NO: 138415 - RNA, 1413 nt, Artificial Sequence; identical to SEQ ID NO: 138046
  derived and/or modified sequence opt3 from neuraminidase__InfluenzaA__ACD56116

SEQ ID NO: 138416 - RNA, 1413 nt, Artificial Sequence; identical to SEQ ID NO: 138046
  derived and/or modified sequence opt3 from neuraminidase__InfluenzaA__ACD56127

SEQ ID NO: 138417 - RNA, 1410 nt, Artificial Sequence; identical to SEQ ID NO: 137900
  derived and/or modified sequence opt3 from neuraminidase__InfluenzaA__ACD56261

SEQ ID NO: 138418 - RNA, 1410 nt, Artificial Sequence
  derived and/or modified sequence opt3 from neuraminidase__InfluenzaA__ACD56272
augaaccccaaucagaagaucauuaccauaggcagcgugucccugacaaucucuacuauuugcuucuuuaugcagaucgccauucucaucacgaccgucacacuucacuucaaacaguacgaguuuucaaguccuccaaacaaucagguuaugcugugugaaccgacuauaaucgagagaaacauuaccgaaaucguguauuugacaaauaccacuauugagaaggaaaucugccccaaauuagcugaguacaggaacuggagcaagccucagugugacauaacaggguucgcaccauuuuccaaagauaauucuauucggcugucggccggaggugacaucuggguaacccgcgagcccuaugugucaugcgauccugacaaguguuaccaauucgcgcuaggccaggggacgacucucaacaauguccauagcaacgauaccgugcacgaccgaacaccauaucguacucugcuuaugaaugaacugggaguucccuuucauuugggcaccaaacaggugugcauugcuuggaguuccucuagcugucacgaugguaaggccuggcuccaugucugcgugacaggggacgauaagaacgcaaccgccuccuucaucuacaauggaagacugguagacucaaucguuaguuggagcaaagagauucugaggacgcaggaaucugagugugugugcauaaacggcacuuguacagucgugaugaccgauggcuccgcuucagggaaggcagacacuaaaauccucuuuauugaggaaggaaagaucgugcacacaagcaccuuaagugguucugcccaacacgucgaggaaugcuccugcuauccucgguacccaggcguucgcugugugugcagagauaauuggaaggggagcaacaggccgauaguagacauuaacaucaaagacuacucgaucgugucucgguaugucuguuccggacuggugggcgauacgccccgcaagaaugacucaaguagcuccucucauugccuugauccuaacaaugaggaaggugggcacggaguuaaaggcugggcuuucgacgauggcaacgacguguggauggggcgaaccauuagcgagaagucaagaaguggauacgagacauuuaaagucaucgaagguugguccaauccaaacagcaaguugcagauuaauaggcaagugauaguagaucggggcaaccguucuggguauucaggaaucuucaguguugagggcaaaagcuguauuaaucgcugcuuuuacguggaacugaucagagguaggaaggaggaaacugagguccuauggaccuccaacucuaucguggucuucugugggacaucgggcacuuauggaaccggcagcuggcccgacggggccgauauuaaucucaugccuauauga

SEQ ID NO: 138419 - RNA, 1413 nt, Artificial Sequence
  derived and/or modified sequence opt3 from neuraminidase__InfluenzaA__ACD56283
augaaccccaaucagaagaucauuaccauaggcagcaucuccauggccauugggaucauuucucugaugcuccaaaucggaaacauaaucucaauuugggcuagucacagcauccagacagguucccagaaucauacuggcauuugcaaccagagaaucauaacguacgaaaauucuaccugggugaaccacacauaugucucgauuaauaacacuaauguuguggcagggaaagacaagaccucaguaacacuugccggaaacagcagucuguguuccaucucuggcugggcgauuuacaccaaagauaauagcaucaggaucgguuccaagggggacguguucgucauucgggagccuuuuauaucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgaucgguauuagcggcccagacaauggggccguggcuguccugaaauauaacggaaucauaacugaaaccauuaagucguggaaaaagagaaucuugaggacacaggagucugagugcguguguguaaacggcuccugcuuuacuaucaugaccgauggucccucaaauggggccgcgaguuacaaaauuuucaagaucgaaaagggaaaaguuacaaagagcauugagcucaacgcaccuaauuuucacuaugaagaguguuccugcuacccagacaccggcacggugaugugugucugccgggauaacuggcacggcucuaaucgccccugggugagcuucaaccagaaucuggacuaccagauaggguauaucugcucaggaguguuuggugauaacccuagaccaaaagacggcaaggggaguuguaauccggucacuguugauggagccgacggcgugaaagguuucuccuacaaguaugggaacggcguauggauuggaaggacaaaaagcaaucggcugcgcaagggcuuugagaugaucugggaccccaacggguggaccgauacugacucugauuucucagugaagcaagacgucguggcuaucacagauuggaguggauacagcgguuccuuuguucagcauccugaacucaccggcuuagacugcauucgaccauguuucuggguggagcuggucagagggcuucccagggaaaauacgaccauauggacaucuggaucgagcaucuccuucugcggcguggauucagacacugccaacuggaguuggccugauggugcagaguugccauuuaccauugacaaauga

SEQ ID NO: 138420 - RNA, 1410 nt, Artificial Sequence
  derived and/or modified sequence opt3 from neuraminidase__InfluenzaA__ACD56305
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgauuaucauagagagaaauaucacugaaauuguguacuugaacaauaccacaaucgagaaggaaauuugucccgaggucguggaguauaggaacuggaguaaaccucagugccaaaucaccggguucgccccauuuagcaaggauaauuccauacgguuaucugcgggaggugacauuuggguuacucgcgaacccuacgugucgugugauccuggcaaaugcuaucaguucgcucuggggcagggaacaacccuagacaacaagcacucaaaugauacgauccaugaccguauuccacaccgaacucuccugaugaacgagcuuggcguccccuuucaucuggguaccagacagguguguguagccuggagcaguuccucuugccacgaugggaaggcaugguugcacguuugugugacaggagacgauaaaaaugccacugcuagcuucaucuacgacggcaggcucgucgauuccaucggcucauggagucaaaacauucugcggacccaggaaagcgagugcguguguauaaaugggacaugcaccguggucaugacggacggaucugcauccggucgcgccgauacuagaauccuguuuauugaggaaggcaagaucguucauauaucaccucucagcgggagugcucagcacguggaggaaugcucuuguuauccaagguacccggacguacggugcauuugucgcgacaacuggaaaggauccaaucgacccgugaucgauaucaacauggaggacuauagcauugauucgucuuacgucugcuccggcuuagugggugacacaccuagaaacgaugacaggucaaguaauagcaacugucgggauccaaauaacgaacgugggaaucccggaguuaagggcugggccuucgacaacggcgaugacguguggauggggcgcaccaucuccaaagaucugagaucuggauacgagacuuuuaaggucauugguggcuggagcacaccuaauucaaagagucagauaaacaggcaagugaucguagacuccaauaacuggagcggguauucuggaauuuucucaguugagggcaaaaguugcaucaaucgguguuuuuacguggaacuuauccgaggucgccagcaggagaccagagucugguggacgagcaacuccauuguggucuucugcgggaccucuggcacauauggaacuggcucguggccagacggggcgaauauaaacuuuaugcccaucuga

SEQ ID NO: 138421 - RNA, 1410 nt, Artificial Sequence
  derived and/or modified sequence opt3 from neuraminidase__InfluenzaA__ACD56316
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgauuaucauagagagaaauaucacugaaauuguguacuugaacaauaccacaaucgagaaggaaauuugucccgaggucguggaguauaggaacuggaguaaaccucagugccaaaucaccggguucgccccauuuagcaaggauaauuccauacgguuaucugcgggaggugacauuuggguuacucgcgaacccuacgugucgugugauccuggcaaaugcuaucaguucgcucuggggcagggaacaacccuagacaacaagcacucaaaugauacgauccaugaccguauuccacaccgaacucuccugaugaacgagcuuggcguccccuuucaucuggguaccagacagguguguguagccuggagcaguuccucuugccacgaugggaaggcaugguugcacguuugugugacaggagacgauaaaaaugccacugcuagcuucaucuacgacggcaggcucauggauuccaucggcucauggagucaaaacauucugcggacccaggaaagcgagugcgucuguauaaaugggacaugcaccguggugaugacggacggaucugcauccggucgcgccgauacuagaauccuguuuauugaggaaggcaagaucguccauauaucaccucucagcgggagugcucagcacguugaggaaugcucuuguuauccaagguacccggacgugcggugcauuugucgcgacaacuggaaaggauccaaucgacccguaaucgauaucaacauggaggacuauagcauugauucgucuuacgugugcuccggcuuagucggugacacaccuagaaacgaugacaggucaaguaauagcaacugucggaauccaaacaaugaacgugggaaccccggagugaagggcugggccuucgauaauggcgacgauguuuggauggggcgcaccaucuccaaagaccugagaucuggauacgagacuuuuaaggugauugguggcuggagcacaccuaacucaaagagucagauaaauaggcaagucaucguggauuccaacaauuggagcggguauucuggaauuuucucaguagagggcaaacggugcaucaaccgauguuuuuacguugaacuuauccgcgguagacagcaggagaccagggugugguggacgaguaauagcauugucguguucugcgggaccuccggcacauauggaacuggcucuuggccagacggggcgaacauaaauuuuaugcccaucuga

SEQ ID NO: 138422 - RNA, 1410 nt, Artificial Sequence
  derived and/or modified sequence opt3 from neuraminidase__InfluenzaA__ACD56327
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuucaaaaugccaccaguucgcccugggccaggggacaacccuagagaacaagcauagcaauggaacgaagcacgaccgaaucccacaucguacucuccugaugaacgaacuuggcgugcccuuucaccuggguaccaaacaggucuguguggcauggaguuccucuagcugccacgaugggaaggccugguugcauguauguguuacaggagacgauagaaaugcuacugcauccuucauuuauggcggcaggcucguggacucaaucgucaguuggagccaaaacauccugcggacccaggagucugagugcguguguauuaaugggacaugcaccguggucaugacggauggauccgccucaggucgcgcugacacuagaauacuguuuaucaaagaaggcaagauuguucacaucagcccucucagugggucugcccagcauauagaggaaugcuccuguuacccaagguauccggaugugcggugcauuugucgcgacaacuggaaaggaagcaaucgacccguaaucgauaucaacauggaggacuacucgauugacucuuccuaugugugcucaggcuuagucggugauacaccuagaaacgacgauaguagcuccaauucuaacuguagggacccaaauaacgaacgggggaaucccggagugaagggcugggcguucgauaacggcgacgauguuuggauggggcguaccaucagcaaggacucacgcaguggauacgagacuuuuaaagugauugguggcugguccacaccuaauagcaagucucaggucaacagacaagugauaguagauucaaauaacuggaguggguacagcggaaucuucuccguugagggcaaaucuugcauuaauagguguuuuuauguggaacugauccggggucgaccacaggagacccgcgucugguggacgucgaacagcaucguggucuucugcgggaccuccggcacauacggaacuggcucauggcccgacggggcaaauauuaacuuuaugccgauauga

SEQ ID NO: 138423 - RNA, 1410 nt, Artificial Sequence
  derived and/or modified sequence opt3 from neuraminidase__InfluenzaA__ACD85190
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgauuaucauagagagaaauaucacugaaauuguguacuugaacaauaccacaaucgagaaggaaauuugucccaaagucguggaguauaggaacuggaguaagccucagugccaaaucaccggguucgccccauuuagcaaagauaauuccauacgguuaucugcgggaggugacauuuggguuacucgcgagcccuacgugucgugugauccuggcaagugcuaucaguucgcucuggggcagggaacaacccuagacaacaagcacucaaaugauacgauccaugaccgaaucccacaccguacucuccugaugaacgaacuuggcguccccuuucaucuggguaccagacagguguguauugccuggagcaguuccucuugccacgaugggaaagcaugguugcacguauguguuacaggagacgauaagaaugccacugcuagcuucaucuacgacggcaggcucguggauuccauuggcucauggagucaaaacauacugcggacccaggagagcgaaugcgucuguaucaaugggacaugcaccguggugaugacggacggaucugcauccggucgcgccgauacuaggauucuguuuaucgaggagggcaaaauaguccauauuucaccucucagcgggagugcucagcacguugaagagugcucuuguuauccaagauacccggacgugcggugcaucugucgcgacaacuggaagggauccaaucgacccaucauugauaucaacauggaagacuauagcauugauucgucuuacguaugcuccggcuuagugggugacacaccuagaaacgaugacaggucaaguaauagcaacugucggaauccaaacaaugagcgugggaaccccggagucaaaggcugggccuucgauaauggcgacgauguguggauggggcgcaccauauccaaggaccugagaucuggauacgaaacuuuuaagguuaucgguggcuggagcacaccuaacucaaaaagucagauuaauaggcaagugaucgucgauuccaacaauuggagcggguauucuggaaucuucucaguggagggcaagaguugcauuaaccgguguuuuuacguagagcuuauacgaggucgccagcaggaaaccagaguuugguggacgagcaauuccaucguggucuucugcgggaccucuggcacauauggaacuggcucguggccagacggggcgaacauuaauuuuaugcccaucuga

SEQ ID NO: 138424 - RNA, 1410 nt, Artificial Sequence
  derived and/or modified sequence opt3 from neuraminidase__InfluenzaA__ACD85201
augaaccccaaucagaagaucauuaccauaggcagcgugucccugacaaucgccacugucugcuuccucaugcaaauugcuauccuuguuacgaccgugacacugcacuuuaaacagcaugagugugacucuccugcaucaaaccagguaaugccaugcgaaccgauuaucauagagagaaauaucacugaaauuguguacuugaacaauaccacaaucgagaaggaaauuugucccaaagucguggaguauaggaacuggaguaagccucagugccaaaucaccggguucgccccauuuagcaaagauaauuccauacgguuaucugcgggaggugacauuuggguuacucgcgagcccuacgugucgugugauccuggcaagugcuaucaguucgcucuggggcagggaacaacccuagacaacaagcacucaaaugauacgauccaugaccgaaucccacaccguacucuccugaugaacgaacuuggcguccccuuucaucuggguaccagacagguguguauugccuggagcaguuccucuugccacgaugggaaagcaugguugcacguauguguuacaggagacgauaagaaugccacugcuagcuucaucuacgacggcaggcucguggauuccauuucaaguuggagccaaaacauacugcggacccaggagucugaaugcgucuguaucaauggcacaugcaccguggugaugacggacggguccgcaucaggacgcgccgauacuaggauucuguuuaucgaggaggguaaaauaguccauauuagcccucucaguggcucugcucagcacguugaagagugcuccuguuauccaagauacccggacgugcggugcaucugucgcgacaacuggaaggggagcaaucgacccguaaucgauauuaacauggaagacuauucgaucgauucuuccuacgugugcucaggauuagucggcgacacaccuagaaacgaugacaggaguagcaauuccaacugucggaauccaaacaaugagcgugguaaccccggggugaaaggaugggccuucgauaauggcgacgauguuuggaugggccgcaccauuucuaaggaccugagaagcggguacgaaacuuuuaaggugauaggagguuggucaacaccuaacaguaaaucccagaucaauaggcaagucauuguggauagcaacaauuggucuggcuauucagggaucuucaguguagagggaaagagcugcaucaaccgguguuuuuacguugagcuuauucgaggccgccagcaggaaaccagagugugguggacguccaauucuauagucguguucugcgguaccucggggacauauggcacuggaagcuggccagacggcgcgaacaucaauuuuaugcccauuuga

SEQ ID NO: 138425 - RNA, 1410 nt, Artificial Sequence
  derived and/or modified sequence opt3 from neuraminidase__InfluenzaA__ACD85212
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucaaggaaauuguauacuugaacaauacuaccaucgagaaagaaauuugucccgagguggucgaguauaggaacuggaguaagccucagugccaaaucacaggguucgcgccauuuagcaaagauaauuccauacgguuaucugcuggaggugacauuugggugacccgcgaacccuacguuucgugugauccuggcaagugcuaucaguucgcccuggggcagggaacuacacuagacaacaagcacucaaauggcaccauccaugaucguauuccacaccgaacgcuccugaugaacgagcuuggugugcccuuucaucuggggacuaaacaggucuguguggcauggagcaguuccucuugccacgacggaaaggccugguugcacguauguguuaccggcgaugacagaaaugcuacagccagcuucaucuacgauggcaggcucguggacuccaucgggucauggagucaaaacauucugcggacucaggaaagcgagugcgucuguauaaauggaaccugcacaguggugaugaccgaugguucugcauccggccgcgcugacacgagaauccuguuuauuaaagaggggaagaucguccauauaucaccucucagcggaagugcccagcacauugaagagugcucuuguuauccaagguacccggauguucggugcaucugucgcgacaacuggaaaggcuccaaucgacccgugaucgacauuaacauggaagauuauagcaucgacucgucuuacguaugcuccgguuuagugggggauacuccuagaaacgacgauucaaguagcaauuccaacuguagggacccaaauaacgagcggggaaaucccggcgucaagggcugggcguucgauaacggggacgauguguggaugggacguacaauuaauaaggacucucgcagcgguuacgaaaccuuuaaaguuauaggcggguggucaacuccuaacaguaagucccaggugaauagacaagucaucguggauaacaauaacuggagcggauauucuggcauuuucucaguagaggguaaaaguugcaucaauagguguuuuuacguugagcugauccgggggcgaccacaggaaacacgcgugugguggaccagcaacuccauugucguguucugcggcacgucuggaaccuauggcacagggucguggcccgacggagcaaauauaaacuuuaugccgaucuga

SEQ ID NO: 138426 - RNA, 1410 nt, Artificial Sequence
  derived and/or modified sequence opt3 from neuraminidase__InfluenzaA__ACD85223
augaaccccaaucagaagaucauuaccauaggcagcgugucccugacaaucgccacugcuugcuuccucaugcaaauugcaauccuugucacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccaaaguggucgaguauaggaacuggaguaagccucagugccaaaucaccggguucgcgccauuuagcaaagauaauuccauacgguuaucugcuggaggugacauuugggugacucgcgagcccuacguuucgugugauccuggcaagugcuaucaguucgcccuggggcagggaacaacccuagacaacaagcacucaaaugauacgauccaugaccgaaucccacaccguacucuccugaugaacgaacuuggcgugcccuuucaucuggguaccagacaggucuguauugcauggagcaguuccucuugccacgaugggaaagccugguugcacguguguguaacaggagacgauaagaaugcuacugccagcuucaucuacgacggcaggcucguugauuccauuggcucauggagucaaaacauacugcggacccaggagagcgaaugcguguguaucaaugggacaugcaccgucgugaugacggacggaucugcauccggucgcgcugauacuaggauucuguuuaucgaggagggcaaaauagugcauauuucaccucucagcgggagugcccagcacgucgaagagugcucuuguuauccaagauacccggacguucggugcaucugucgcgacaacuggaagggauccaaucgacccaucauugauaucaacauggaagacuauagcauugauucgucuuacgugugcuccggcuuaguaggugacacaccuagaaacgaugacaggucaaguaauagcaacugucggaauccaaacaaugagcgugggaaccccggagugaaaggcugggcguucgauaauggcgacgaugucuggauggggcgcaccauauccaaggaccugagaucuggauacgaaacuuuuaaggugaucgguggcuggagcacaccuaacucaaaaagucagauuaauaggcaaguuaucguggauuccaacaauuggagcggguauucuggaaucuucucagucgagggcaagaguugcauuaaccgguguuuuuacguggagcuuauacgaggucgccagcaggaaaccagaguaugguggacgagcaauuccaucguuguguucugcgggaccucuggcacauauggaacuggcucguggccagacggggcaaacauuaauuuuaugcccaucuga

SEQ ID NO: 138427 - RNA, 1410 nt, Artificial Sequence
  derived and/or modified sequence opt3 from neuraminidase__InfluenzaA__ACD85234
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcugacggagauauuugggugacucgcgaacccuacguuucgugugacccugguaaaugcuaucaguucgcccugggccaggggacaacccuagauaacaagcacucaaauggaacgauccaugaccguauuccacaccgaacucuccugaugaacgagcuuggcgugcccuuucaucuggguaccaagcaggucuguguggcauggagcaguuccucuugccacgaugggaaagccugguugcacguauguguuacaggagacgauagaaaugcuacugccagcuucaucuacgacggcaggcucguggauuccaucggcucauggagucaaaacauucugcggacccaggaaagcgagugcgucuguauaaaugggacaugcaccguggugaugacggacggaucugcauccggucgcgcugauacuagaauccuguuuauuaaggagggcaaaaucguccauauaucaccucucagcgggagugcccagcacauugaagagugcucuuguuauccaagguacccggacguucggugcaucugucgcgacaacuggaagggauccaaucgacccgugaucgauauuaacauggaagacuauagcaucgauucgucuuacguaugcuccggcuuagugggugacacaccuagaaacgaugacucaaguagcaauuccaacuguagggauccaaauaacgagcgggggaaucccggagucaaaggcugggcguucgacaacggcgaugacguguggauggggcguaccauuucuaaggaucugcgcagcggauacgaaacuuuuaagguuauagguggcuggucaacaccuaauaguaaaucccaggugaacagacaagucaucguggacaauaacaauuggagcggguauucuggaauuuucucaguagagggcaagaguugcaucaacagguguuuuuacguugagcuuauccggggucgaccacaggaaacccgcgugugguggacgagcaauuccauugucguguucugcgggaccucuggcacauauggaacuggcucguggcccgacggggcaaacauaaauuuuaugccgaucuga

SEQ ID NO: 138428 - RNA, 1410 nt, Artificial Sequence
  derived and/or modified sequence opt3 from neuraminidase__InfluenzaA__ACD85245
augaaccccaaucagaagaucauuaccauaggcagcgugucccugaucauugccacagucugcuuccucaugcaaaucgcuauucuuguuacuacggugacccugcacuuuaaacagcaugagugugacucuccugcaucaaaccagguaaugccaugcgaaccgaucauaaucgagagaaauauuacagaaaucguguacuugaacaauacuaccauugagaaggaaaucugucccagggucguggaguaucggaacuggaguaaaccucagugccaaauaacaggguucgccccauuuagcaaggauaauuccauucgcuuaucugcgggaggugacaucuggguuacccgagagcccuacgugucgugugauccuggcaaaugcuaucaguucgcucuggggcagggaacuacacuagacaacaagcacucaaaugauaccauucaugaccguaucccacacagaacgcuccugaugaacgaacuuggcguccccuuucaucuggguacuaggcaaguguguaucgccuggagcaguuccucuugccacgaugggaaggcaugguugcacguauguauuaccggagacgauaaaaaugccacagcuagcuucauauacgacggccggcucguugauuccaucggcucauggagucagaacauucugcgcacucaggagagcgaaugcguguguaucaaugggaccugcacagucgugaugaccgacggaucugcauccgguagagccgauacgaggauacuguuuauugaggagggcaagaucgugcauaucucaccucucagcgggagugcucagcacgucgaagagugcucuuguuauccacgguacccgggaguucgcugcauuugucgagacaacuggaaaggcuccaauagacccgugguagacaucaacauggaagauuauagcauugacucgucuuacgugugcuccgguuuagucggggauacuccuaggaacgacgaucggucaaguaauagcaacugucguaauccaaacaaugagcgcggaaaccagggcgugaagggcugggccuucgacaauggggaugacguuuggaugggaagaacaauauccaaagaucugaggucugguuacgaaaccuuuaaggugaucggcggguggagcacucccaacucaaagagucaaauuaaucggcaggucaucguggacuccgaugaccgaagcggauauucuggcaucuucucaguagaggguaaaaguugcauuaaccgcuguuuuuacguugagcuuauaagagggaggaagcaggaaacacgggugugguggaccagcaauuccaucgucguguucugcggcacgucuggaaccuauggcacagggucguggccugacggagcgaacauuaauuuuaugccaaucuga

SEQ ID NO: 138429 - RNA, 1410 nt, Artificial Sequence
  derived and/or modified sequence opt3 from neuraminidase__InfluenzaA__ACD85454
augaaccccaaucagaagaucauuaccauaggcagcgugucccugacaaucucuacuauuggguucuuuaugcaaacggccauccucauuaccacagucacucuucacuucaaacaguacgaguuuaacucaccuccaaauaaccagguuaugcugugcgaaccgaccaucauagagagaaauaucacagaaauuguguauuugaccaacacuacaaucgagaaggaaauuugucccaaauuagcugaguacaggaauuggaguaagccucagugcgacaucaccggauucgcaccauuuagcaaagauaacuccauacggcugucugccgguggcgacauuuggguaacgcgcgagcccuaugugucgugugauccugacaagugcuaccaauucgcgcuagggcagggaacuacccucaauaacguccauucaaaugauacagugcgaaaccguacuccauauagaacccugcuuaugaaugaacugggcguucccuuucacuuggguacaaaacagguguguaucgcuuggagcaguuccucuugccaugacgggaaggccuggcuccacgucuguauuaccggagaugacaagaacgcaacggccagcuucaucuacaauggcaggcugguggauuccaucguaucauggaguaaagagauucugcggacucaggaaagcgagugcguuuguauaaacggcacaugcaccguggucaugacugacgggucugcuuccggaaaggcagauacaaaaauccucuuuauugaggaagguaagaucgugcauaccucaacguuaagcggcagugcccaacacguggaggaauguucuugcuauccucgcuacccaggggucagaugcguuuguagggacaacuggaagggauccaaucggccgauaguggauauuaacaucaaagaccacagcaucguaucgucuuacgugugcuccggccuggucggugacacaccccgcaagaaugauucaaguagcuccucucauugucuugacccuaacaaugaggaagggggacacggcgugaaaggcugggcuuucgaugacgggaacgauguuuggaugggacgaaccauuagcgagaagucaagauuggguuaugagacuuuuaaagugaucgaaggcuggaguaauccaaaguccaaacugcagauuaacaggcaggucauaguggaccgggggaaucguagcggauacucuggcaucuucucaguagaggguaagaguugcauuaaccgcuguuuuuauguugaacuaaucagagggaggaaggaggaaaccgaggugcucuggacaagcaauuccaucgucguguucugcggcacuucuggaaccuacggcacagggucguggcccgauggagccgacauuaaccugaugccuauauga

SEQ ID NO: 138430 - RNA, 1410 nt, Artificial Sequence
  derived and/or modified sequence opt3 from neuraminidase__InfluenzaA__ACD85465
augaaccccaaucagaagaucauuaccauaggcagcgugucccugacaaucucuacuauuggguucuuuaugcaaacggccauccucauuaccacagucacucuucacuucaaacaguacgaguuuaacucaccuccaaauaaccagguuaugcugugcgaaccgaccaucauagagagaaauaucacagaaauuguguauuugaccaacacuacaaucgagaaggaaauuugucccaaauuagcugaguacaggaauuggaguaagccucagugcgacaucaccggauucgcaccauuuagcaaagauaacuccauacggcugucugccgguggcgacauuuggguaacgcgcgagcccuaugugucgugugauccugacaagugcuaccaauucgcgcuagggcagggaacuacccucaauaacguccauucaaaugauacagugcgagaccguacuccauauagaacccugcuuaugaacgaacugggcguucccuuucacuuggguacaaaacagguguguaucgcuuggagcaguuccucuugccaugaugggaaggccuggcuccacgucuguauuaccggagacgauaagaaugcaacggccagcuucaucuacaacggcaggcugguggacuccaucguaucauggaguaaagagauucugcggacucaggaaagcgagugcguuuguauaaauggcacaugcaccguggucaugacugaugggucugcuuccggaaaggcagacacaaaaauccucuuuauugaggaagguaagaucgugcauaccucaacguuaagcggcagugcccaacacguggaggaauguucuugcuauccucgcuacccaggggucagaugcguuuguagggauaacuggaagggauccaaccggccgauaguggacauuaauaucaaagaccacagcaucguaucgucuuacgugugcuccggccuggucggugauacaccccgcaagaacgacucaaguagcuccucucauugucuugauccuaauaacgaggaagggggacacggcgugaaaggcugggcuuucgacgaugggaaugacguuuggaugggacgaaccauuagcgagaagucaagauuggguuaugagacuuuuaaagugaucgaaggcuggaguaacccaaaguccaaacugcagauuaauaggcaggucauaguggaucgggggaaccguagcggauacucuggcaucuucucaguagaggguaagaguugcauuaaucgcuguuuuuauguugaacuaaucagagggaggaaggaggaaaccgaggugcucuggacaagcaacuccaucgucguguucugcggcacuucuggaaccuacggcacagggucguggcccgacggagccgauauuaaucugaugccuauauga

SEQ ID NO: 138431 - RNA, 1410 nt, Artificial Sequence
  derived and/or modified sequence opt3 from neuraminidase__InfluenzaA__ACD85487
augaaccccaaucagaagaucauuaccauaggcagcgugucccugaucauuucuacaaucugcuucuuuaugcaaacugccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgaaaccguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccauuguaucauggaguaaagagauacugcggacgcaggaaagcgaguguguuugcaucaacggcacuuguacaguggucaugaccgacggcucugcuuccgggaaggcagauacuaaaauucucuuuaucgaggaaggaaagauagugcauacaucaaccuuaagcgguagugcccaacacguggaggaaugcucuugcuauccucgcuacccaggcgucagauguguuugcagggacaacuggaagggguccaaucggccgauuguggauaucaacaucaaagaccacagcauuguaucgucuuacguguguuccggacuggucggcgacacgccccgcaagaaugauucaaguagcuccucucauugccuugacccuaacaaugaggaaggugggcacggagugaaaggcugggcuuucgaugacggcaacgauguuuggauggggcgaaccaucagcgagaagucaagauugggauaugagacauuuaaagugauugaagguuggaguaauccaaacuccaagcugcagauaaauaggcaggucaucguggaccggggcaaccguagcggguacucuggaauuuucucaguagagggcaaaaguuguaucaaucgcugcuuuuauguugaacuaaucagagguaggaaggaggaaacugaggugcucuggaccagcaacuccauugucguguucugugggacaucuggcacuuacggaaccggcucguggcccgauggggccgacauaaaucugaugccuaucuga

SEQ ID NO: 138432 - RNA, 1410 nt, Artificial Sequence
  derived and/or modified sequence opt3 from neuraminidase__InfluenzaA__ACD85498
augaaccccaaucagaagaucauuaccauaggcagcgugucccugaucauuucuacaaucugcuucuuuaugcaaacugccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaagggguccaaccggccgauuguggacaucaauaucaaagaccacagcauuguaucgucuuacguguguuccggacuggucggcgauacgccccgcaagaacgacucaaguagcuccucucauugccuugauccuaauaacgaggaaggugggcacggagugaaaggcugggcuuucgacgauggcaaugacguuuggauggggcgaaccaucagcgagaagucaagauugggauaugagacauuuaaagugauugaagguuggaguaacccaaaguccaaacugcagauaaauaggcaggucaucguggaucggggcaaccguagcggguacucuggaauuuucucaguagagggcaagaguuguaucaaucgcugcuuuuauguugaacuaaucagagguaggaaggaggaaacugaggugcucuggaccagcaacuccauugucguguucugugggacaucuggcacuuacggaaccggcucguggcccgacggggccgauauaaaucugaugccuaucuga

SEQ ID NO: 138433 - RNA, 1410 nt, Artificial Sequence
  derived and/or modified sequence opt3 from neuraminidase__InfluenzaA__ACD85509
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaaugauacagugcgaaaccguacuccauauagaacccugcuuaugaaugaacugggaguucccuuucacuugggcacaaaacaggugugcaucgcuuggagcaguuccucuugucaugacgguaaggccuggcuccacgucugcauuaccggggaugacaagaacgcaacggccagcuucaucuacaauggaaggcugguggauuccaucguaucauggaguaaagagauucugcggacucaggaaagcgaguguguuugcauaaacggcacauguaccguggucaugacugacggcucugcuuccgggaaggcagauacaaaaauccucuuuauugaggaaggaaagaucgugcauaccucaacguuaagcgguagugcccaacacguggaggaaugcucuugcuauccucgcuacccaggcgucagauguguuugcagggacaacuggaagggguccaaucggccgauaguggauauuaacaucaaagaccacagcaucguaucgucuuacguguguuccggacuggucggcgacacaccccgcaagaaugauucaaguagcuccucucauugccuugacccuaacaaugaggaagguagccgaggggugaaaggaugggcuuucgaugacggcaacgauguuuggaugggcagaaccauuucagagaagaguagguugggguaugagacuuuuaaagugaucgaaggaugguccaauccaaagagcaaacugcagauuaaccggcaggucauaguggaccgugguaaucgcucuggcuacucagggaucuucaguguagagggaaagagcuguauuaacagaugcuuuuauguugaacuaaucaggggccggaaggaggaaaccgaggugcucuggacauccaauucuaucgucguguucugugguacuucggggaccuacggcacaggaagcuggcccgauggcgccgacauuaaccugaugccuauauga

SEQ ID NO: 138434 - RNA, 1410 nt, Artificial Sequence
  derived and/or modified sequence opt3 from neuraminidase__InfluenzaA__ACD85520
augaaccccaaucagaagaucauuaccauaggcagcgugucccugaucauuucuacaaucggguucuuuaugcaaacugccauucucaucacgaccgucacacuucacuucaaacaguacgaguuuaacucaccuccaaauaaccagguuaugcugugcgaaccgacuauaaucgagagaaauauuaccgaaaucguguauuugacaaacaccacuauugagaaggaaaucugucccaaauuagcugaguacaggaauuggaguaagccucagugcgacauaacaggauucgcaccauuuagcaaagauaacuccauucggcugucugccgguggcgacaucuggguaacccgcgagcccuaugugucgugugauccugacaagugcuaccaauucgcgcuagggcagggaacgacucucaauaacguccauucaaaugauaccgugcgagaccguacaccauauagaacucugcuuaugaacgaacugggcguucccuuucacuuggguaccaaacagguguguauugcuuggagcaguuccucuugccaugaugggaaggccuggcuccacgucuguaucacaggagacgauaagaaugcaaccgccagcuucaucuacaacggcaggcugguggacuccauuguaucauggaguaaagagauacugcggacgcaggaaagcgagugcguuuguaucaauggcacuugcacaguggucaugaccgaugggucugcuuccggaaaggcagacacuaaaauucucuuuaucgaggaagguaagauagugcauacaucaaccuuaagcggcagugcccaacacguggaggaauguucuugcuauccucgcuacccaggggucagaugcguuuguagggauaacuggaagggauccaaccggccgauuguggacaucaauaucaaagaccacagcauuguaucgucuuacgugugcuccggccuggucggugauacgccccgcaagaacgacucaaguagcuccucucauugucuugauccuaauaacgaggaagggggacacggcgugaaaggcugggcuuucgacgaugggaaugacguuuggaugggacgaaccaucagcgagaagucaagauuggguuaugagacauuuaaagugauugaaggcuggaguaacccaaaguccaaacugcagauaaauaggcaggucaucguggaucgggggaaccguagcggauacucuggcauuuucucaguagaggguaagaguugcaucaaucgcuguuuuuauguugaacuaaucagagggaggaaggaggaaacugaggugcucuggaccagcaacuccauugucguguucugcggcacaucuggaacuuacggcaccgggucguggcccgacggagccgauauaaaucugaugccuaucuga

SEQ ID NO: 138435 - RNA, 1410 nt, Artificial Sequence; identical to SEQ ID NO: 138430
  derived and/or modified sequence opt3 from neuraminidase__InfluenzaA__ACD85553

SEQ ID NO: 138436 - RNA, 1410 nt, Artificial Sequence
  derived and/or modified sequence opt3 from neuraminidase__InfluenzaA__ACD85564
augaaccccaaucagaagaucauuaccauaggcagcgugucccugaucauuucuacaaucugcuucuuuaugcaaacugccauucucaucacgaccgucacacuucacuucaaacaguacgaguuuaacucaccuccaaauaaccagguuaugcugugugaaccgacuauaaucgagagaaauauuaccgaaacagcucauuugaccaacacuacaaucgagaaggaaauuugccccaaauuagcagaguauaggaauuggaguaagccucagugugacaucaccggguucgccccauuuagcaaagauaacuccauacggcugucugcgggaggugacauuugggugacgcgcgagcccuacguaucgugcgauccugacaaguguuaucaauucgcucuaggccaggggacuacccucaauaacgugcacucaaaugauacaguccgagaccguacuccauacagaacccugcuuaugaacgaacugggagugcccuuucauuugggcacaaagcagguuugcaucgccuggagcaguuccucuugucacgaugguaaagcauggcuccaugugugcauuaccggggacgauaagaaugccacggcuagcuucaucuauaacggaaggcuggucgacuccaucgugucauggaguaaagagauucugcggacucaggaaagcgaguguguaugcauaaauggcacauguaccguugugaugacugauggcucugcauccgggaaggccgacacaaaaauccucuuuauugaggaaggaaagaucguccacaccucaacguuaagcgguagugcucaacacguggaggaaugcucuugcuacccucgcuauccaggcgugagaugugucugcagggauaacuggaagggguccaaccggccgauaguugacauuaauaucaaagaccauagcaucgugucgucuuacguauguuccggacuggugggcgauacccccaggaagaacgacucaaguagcuccucucacugccuugauccuaauaacgaggaaggugggcauggagucaaaggcugggccuucgacgauggcaaugacguguggauggggcgaacaauuagcgagaagucaagauugggauacgagacuuuuaaaguuaucgaagguuggaguaacccaaaguccaaacugcagauuaaucgccaggugauagucgaucggggcaaccguagcggguauucuggaaucuucucaguggagggcaagaguuguauuaaucgcugcuuuuacguagaacuaaucagagguaggaaggaggaaaccgagguucucuggacaagcaacuccaucguggucuucugugggacuucuggcaccuauggaacaggcucguggcccgacggggcggauauuaaucugaugccuauauga

SEQ ID NO: 138437 - RNA, 1410 nt, Artificial Sequence
  derived and/or modified sequence opt3 from neuraminidase__InfluenzaA__ACD85575
augaaccccaaucagaagaucauuaccauaggcagcgugucccugaucauuucuacaaucugcuucuuuaugcaaacugccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaagggguccaaccggccgauuguggacaucaauaucaaagaccacagcauuguaucgucuuacguguguuccggacuggucggcgauacgccccgcaagaacgacucaaguagcuccucucauugccuugauccuaauaacgaggaaggugggcacggagugaaaggcugggcuuucgacgauggcaaugacguuuggauggggcgaaccaucagcgagaagucaagauugggauaugagacauuuaaagugauugaagguuggaguaaccauaaguccaaacugcagauaaauaggcaggucaucguggaucggggcaaccguagcggguacucuggaauuuucucaguagagggcaagaguuguaucaaucgcugcuuuuauguugaacuaaucagagguaggaaggaggaaacugaggugcucuggaccagcaacuccauugucguguucugugggacaucuggcacuuacggaaccggcucguggccagacggggccgauauaaaucugaugcccaucuga

SEQ ID NO: 138438 - RNA, 1410 nt, Artificial Sequence
  derived and/or modified sequence opt3 from neuraminidase__InfluenzaA__ACD85586
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaaugauacagugcgagaccguacuccauauagaacccugcuuaugaacgaacugggaguucccuuucacuugggcacaaaacaggugugcaucgcuuggagcaguuccucuugucaugaugguaaggccuggcuccacgucugcauuaccggggacgauaagaaugcaacggccagcuucaucuacaacggaaggcugguggacuccaucguaucauggaguaaagagauucugcggacucaggaaagcgaguguguuugcauaaauggcacauguaccguggucaugacugauggcucugcuuccgggaaggcagacacaaaaauccucuuuauugaggaaggaaagaucgugcauaccucaacguuaagcgguagugcccaacacguggaggaaugcucuugcuauccucgcuacccaggcgucagauguguuugcagggauaacuggaagggguccaaccggccgauaguggacauuaauaucaaagaccacagcaucguaucgucuuacguguguuccggacuggucggcgauacaccccgcaagaacgacucaaguagcuccucucauugccuugauccuaauaacgaggaaggugggcgaggagugaaaggcugggcuuucgacgauggcaaugacguuuggauggggagaaccauuagcgagaagucaagguugggauaugagacuuuuaaagugaucgaagguuggaguaacccaaaguccaaacugcagaccaaucggcaggucauuguggaucguggcaaccgcagcggguacucuggaauauucucaguagagggcaagaguuguaucaauagaugcuuuuauguugaacuaauuaggggucggaaggaggaaacagaggugcucuggacuagcaacuccaucgucguguucugugggaccucuggcacauacggaaccggcucguggcccgacggggccgauaucaaucugaugccuauuuga

SEQ ID NO: 138439 - RNA, 1410 nt, Artificial Sequence
  derived and/or modified sequence opt3 from neuraminidase__InfluenzaA__ACD93582
augaaccccaaucagaagaucauuaccauaggcagcgugucccugacaaucucuacuauuugcuucuuuaugcaaaucgccauucucgcuacgaccgucacacuucacuucaaacaguacgaguuuaacucaccuccaaauaaccagguuaugcugugugaaccgacuaucauagagagaaauaucaccgaaauuguguauuugacaaacaccacuaucgagaaggaaauuugccccaaauuagcagaguacaggaauuggaguaagccucagugugacaucacaggguucgccccauuuagcaaagauaacuccauacggcugucugcgggaggugacauuuggguaacccgcgagcccuaugugucgugcgauccugacaaguguuaccaauucgcucuaggccaggggacgacucucaauaacguccauucaaaugauaccgugcgaggacguacaccauauagaacucugcuuaugaacgaacugggcguucccuuucacuuggguaccaaacaggugugcaucgccuggagcaguuccucuugucaugacgggaaggcauggcuccacgucugcauuacaggagaugacaagaaugccaccgcuagcuucaucuacaacggcaggcugguggauuccaucguaucauggaguaaagagauucugcggacgcaggaaagcgaguguguuugcauaaauggcacuuguacaguggucaugaccgacgggucugcauccggaaaggccgauacuaaaauccucuuuauugaggaagguaagaucgugcauacaucaaccuuaagcggcagugcucaacacguggaggaaugcucuugcuauccucgcuacccaggggucagauguguuugcagggacaacuggaagggauccaaccggccgauaguggauauuaauaucaaagaccacagcaucguaucgucuuacguguguuccggccuggucggugacacgccccgcaagaacgauucaaguagcuccucucauugccuugacccuaauaacgaggaagggggacacggcgugaaaggcugggccuucgaugacgggaaugauguuuggaugggacgaaccauuagcgagaagucaagauuggguuaugagacauuuaaagugaucgaaggcuggaguaacccaaaguccaaacugcagauuaauaggcaggucauaguggacaaggggaaccggagcggauacucuggcaucuucucaguagaggguaagaguuguauuaaucguugcuuuuauguugaacuaauccgcgggagaaaagaggaaacugaggugcucuggaccagcaacuccaucgucguguucuguggcacaucuggaacuuacggcaccgggucguggcccgauggagcggacauuaaucugaugccuauauga

SEQ ID NO: 138440 - RNA, 1410 nt, Artificial Sequence; identical to SEQ ID NO: 136728
  derived and/or modified sequence opt3 from neuraminidase__InfluenzaA__ACF09403

SEQ ID NO: 138441 - RNA, 1410 nt, Artificial Sequence; identical to SEQ ID NO: 137945
  derived and/or modified sequence opt3 from neuraminidase__InfluenzaA__ACF22151

SEQ ID NO: 138442 - RNA, 1410 nt, Artificial Sequence; identical to SEQ ID NO: 136111
  derived and/or modified sequence opt3 from neuraminidase__InfluenzaA__ACF22246

SEQ ID NO: 138443 - RNA, 1410 nt, Artificial Sequence; identical to SEQ ID NO: 136111
  derived and/or modified sequence opt3 from neuraminidase__InfluenzaA__ACF22257

SEQ ID NO: 138444 - RNA, 1410 nt, Artificial Sequence; identical to SEQ ID NO: 136111
  derived and/or modified sequence opt3 from neuraminidase__InfluenzaA__ACF22279

SEQ ID NO: 138445 - RNA, 1410 nt, Artificial Sequence; identical to SEQ ID NO: 136111
  derived and/or modified sequence opt3 from neuraminidase__InfluenzaA__ACF22290

SEQ ID NO: 138446 - RNA, 1410 nt, Artificial Sequence; identical to SEQ ID NO: 136111
  derived and/or modified sequence opt3 from neuraminidase__InfluenzaA__ACF22301

SEQ ID NO: 138447 - RNA, 1410 nt, Artificial Sequence; identical to SEQ ID NO: 136111
  derived and/or modified sequence opt3 from neuraminidase__InfluenzaA__ACF22312

SEQ ID NO: 138448 - RNA, 1410 nt, Artificial Sequence
  derived and/or modified sequence opt3 from neuraminidase__InfluenzaA__ACF22323
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccauaugaaccgauuaucauagagagaaauaucacugaaauuguguacuugaacaauaccacaaucgagaaggaaauuugccccaaagucguggaguauaggaacuggaguaagccucagugucaaaucaccggguucgccccauuuagcaaagauaauuccauacgguuaucugcgggaggugacauuuggguuacucgcgagcccuacgugucgugcgaucauggcaaguguuaucaguucgcucuggggcagggaacaacccuagacaacaagcacucaaaugauacgauccaugaccguauuccucaccgaacucuccugaugaacgaacuuggcgucccauuucaucuggguaccagacaggugugcaucgccuggagcaguuccucuugucacgaugggaaagcaugguugcacguaugcaucacaggagacgauaagaaugccacugcuagcuucauuuacgacggcaggcucguugauuccauaggcucauggagucaaaacauccugcggacccaggagagcgaaugugugugcauuaaugggacauguaccgucgugaugacggacggaucugcauccggucgcgccgauacuagaauccuguuuauagaggagggcaaaauugugcauaucucaccccucagcgggagugcucagcacgucgaagagugcucuugcuauccuagguacccaggaguucgguguaucugccgcgacaacuggaagggcuccaaucgaccggugguagacauuaacauggaagauuacagcaucgacucgucuuauguguguuccgguuuagucggggauacacccagaaacgacgauaggucaaguaauagcaacugccggaauccuaacaaugagcguggaaaccagggcgugaaaggcugggccuucgacaauggggaugacguuuggaugggacgcaccauuuccaaggaucugagaucugguuacgaaacuuuuaaggugauaggcggguggagcacaccaaacucaaaaagucaaaucaauaggcaggucauuguggacuccgauaaccggagcggauauucuggcaucuucucaguagaggguaagaguuguaucaaucgaugcuuuuacguugagcuuauucgcgggagaaaacaggaaaccagggugugguggacgagcaacuccauagucguguucuguggcaccucuggaacauauggcacugggucguggcccgacggagcgaauaucaacuuuaugccuauuuga

SEQ ID NO: 138449 - RNA, 1410 nt, Artificial Sequence; identical to SEQ ID NO: 136111
  derived and/or modified sequence opt3 from neuraminidase__InfluenzaA__ACF22334

SEQ ID NO: 138450 - RNA, 1410 nt, Artificial Sequence; identical to SEQ ID NO: 136111
  derived and/or modified sequence opt3 from neuraminidase__InfluenzaA__ACF22367

SEQ ID NO: 138451 - RNA, 1410 nt, Artificial Sequence
  derived and/or modified sequence opt3 from neuraminidase__InfluenzaA__ACF22378
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugaucauggcaagugcuaccaguucgcucuggggcagggaacaacccuagacaacaagcacucaaaugauacgauccaugaccguauuccucaccgaacucuccugaugaacgaacuuggcgucccauuucaucuggguaccagacagguguguaucgccuggagcaguuccucuugccacgaugggaaagcaugguugcacguauguaucacaggagacgauaagaaugccacugcuagcuucauuuaugacggcaggcucguugauuccauaggcucauggagucaaaacauccugcggacccaggagagcgaaugcguguguauuaaugggacaugcaccgucgugaugacggacggaucugcauccggucgcgccgauacuagaauccuguuuauagaggagggcaaaauugugcauaucucaccccucagcgggagugcucagcacgucgaagagugcucuuguuacccuagguauccaggaguucggugcaucugucgcgacaacuggaagggcuccaaucgaccggugguagacauuaacauggaagauuacagcaucgacucgucuuacgugugcuccgguuuagucggggauacacccagaaacgacgauaggucaaguaauagcaacuguaaaaauccuaacaaugagcggggaaaccagggcgugaagggcugggccuucgacaauggggaugacguuuggaugggacguaccauuuccaaggaucugcgcucugguuaugaaacuuuuaaagugauaggcggguggagcacaccaaacucaaagagucaaaucaauagacaggucauuguggacuccgauaacaggagcggauacucuggcaucuucucaguagaggguaaaaguugcaucaaucgguguuuuuauguugagcuuauucgagggcgcaagcaggaaaccagagugugguggacgagcaacuccauagucguguucugcggcaccucuggaacauacggcacugggucguggcccgacggagcgaauaucaacuuuaugccuauuuga

SEQ ID NO: 138452 - RNA, 1410 nt, Artificial Sequence
  derived and/or modified sequence opt3 from neuraminidase__InfluenzaA__ACF22389
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucguuccauuuagcaaagauaauuccauacgguuaucugccggaggugacauuugggugacucgcgagcccuaugucucgugugaucauggcaagugcuaccaguucgcgcuggggcagggaacaacccuagacaacaagcacucaaaugauacgauccaugacaggauuccucaccguacucuccugaugaacgaacuuggcgugccauuucaucuggguaccagacagguauguaucgcuuggagcaguuccucuugccacgaugggaaagccugguugcacguuuguaucacaggagacgauaagaaugcaacugccagcuucauuuaugacggcaggcucguggauuccauaggcucauggagucaaaacauccugcggacccaggagagcgaaugcgucuguauuaaugggacaugcaccguggugaugacggacggaucugcuuccggucgcgcagauacuagaauccuguuuauagaggagggcaaaauuguccauaucucaccccucagcgggagugcccagcacguugaagagugcucuuguuacccuagguauccaggagugcggugcaucugucgcgacaacuggaagggcuccaaucgaccgguaguggacauuaacauggaagauuacagcaucgacucgucuuacgucugcuccgguuuagugggggauacacccagaaacgacgauaggucaaguaauagcaacugucggaauccuaacaaugagcguggaaaccagggcguuaaaggcugggcuuucgacaauggggaugacguguggaugggacgcaccauuuccaaggaucugagaucugguuaugaaacuuuuaaggucauaggcggguggagcacaccaaacucaaaaagucaaaucaaucgacaggugauuguagacuccgauaaccggagcggauacucuggcaucuucucaguugaggguaagaguugcaucaaucgauguuuuuauguggagcuuauucgcgggagaaaacaggaaaccagggucugguggacgagcaacuccauaguggucuucugcggcaccucuggaacauacggcacugggucguggcccgacggagccaauaucaacuuuaugccuauuuga

SEQ ID NO: 138453 - RNA, 1410 nt, Artificial Sequence
  derived and/or modified sequence opt3 from neuraminidase__InfluenzaA__ACF22400
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugaucauggcaagugcuaccaguucgcucuggggcagggaacaacccuagacaacaagcacucaaaugauacgauccaugacaggauuccucaccguacucuccugaugaacgaacuuggcgucccauuucaucuggguaccagacagguguguaucgccuggagcaguuccucuugccacgaugggaaagcaugguugcacguauguaucacaggagacgauaagaaugccacugcuagcuucauuuaugacggcaggcucauggauuccauaggcucauggagucaaaacauccugcggacccaggagagcgaaugcguuuguauuaaugggacaugcaccguggucaugacggacggaucugcauccggucgcgccgauacuagaauccuguuuauagaggagggcaaaauugugcauaucucaccccucagcgggagugcucagcacguggaagagugcucuuguuacccuagguauccaggaguccggugcaucugucgcgacaacuggaagggcuccaaucgaccgguuguggacauuaacauggaagauuacagcaucgacucgucuuacguaugcuccgguuuagugggggauacacccagaaacgacgauaggucaaguaauagcaacugucggaauccuaacaaugagcguggaaaccagggcgucaaaggcugggccuucgacaauggggaugacguguggaugggacgcaccauuuccaaggaucugagaucugguuaugaaacuuuuaagguuauaggcggguggagcacaccaaacucaaaaagucaaaucaaucgacaggugauugucgacuccgauaaccggagcggauacucuggcaucuucucaguggaggguaagaguugcaucaaucgauguuuuuauguagagcuuauucgcgggagaaaacaggaaaccaggguuugguggacgagcaacuccauaguggucuucugcggcaccucuggaacauacggcacugggucguggcccgacggagcgaauaucaacuuuaugccuauuuga

SEQ ID NO: 138454 - RNA, 1410 nt, Artificial Sequence; identical to SEQ ID NO: 138082
  derived and/or modified sequence opt3 from neuraminidase__InfluenzaA__ACF22411

SEQ ID NO: 138455 - RNA, 1413 nt, Artificial Sequence
  derived and/or modified sequence opt3 from neuraminidase__InfluenzaA__ACF33772
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccccuguaacacuugccggaaauucgucacuguguagcauuaguggcugggcgaucuacaccaaagauaacuccaucaggauugguucuaagggggacguguucgucauacgggagccauuuaucagcugcucccauuuggaguguaaaacuuucuuuuuaacacaaggagcucugcuaaaugauaagcacucaaacggcaccgugaaggaccgcaguccguaucgagcccucaugagcugcccccugggcgaagcaccuucuccauacaauuccaaauucgagucaguugccuggagcgcuagugcaugucaugaugggauuggauggcuuacgaucgguauaucuggccccgacaacggggccguggcuguccugaaguauaacggaauuaucacuggcaccaucaaauccuggaagaaacagauuuugcguacacaggaaagcgagugcguguguaugaaugguucgugcuuuacuaucaugaccgaugggccuucuaacggagccgcguccuacaagauuuucaagauagagaaaggcaagguaacaaaaucaauggaacucaaugcaccaaacuuuuauuacgaggaauguaguugcuaccccgacaccggcacgguuaugugugugugcagagauaauuggcacgggagcaacaggccuugggucuccuucaaucagaaccuggacuaucaaaucggauacauuugcucugguguguuuggcgauaauccacggccgaaggacggggagggaagcuguaaccccgugacugucgauggcgccaaugguguuaaaggguucucauauaaguacggcaacggaguguggaucggccgcacaaaaaguaauagaaucaggaagggguuugagaugauuugggacccuaacggauggaccaauacugacuccgauuucagcguaaagcaggacauaguggcuaucacagauuggucugguuauucaggcaguuuuguccagcacccagaacugaccgggcucgacugcauucggcccuguuucuggguggaguuaguucgcggacugccucgagaaaacacgaccaucuggacaagcggcuccucuauuucguucugcggugugaacagcgauaucgccaauugguccuggccagacggggcagagcuucccuuuacuauagauaaauga

SEQ ID NO: 138456 - RNA, 1410 nt, Artificial Sequence
  derived and/or modified sequence opt3 from neuraminidase__InfluenzaA__ACF33778
augaaccccaaucagaagaucauuaccauaggcagcgugucccugacaaucucuacuauuugcuucuuuaugcaaaucgccauucucaucacgaccgucacacuucacuucaaacaguacgaguuuucaaguccuccaaacaaucagguuaugcugugugaaccgacuauaaucgagagaaacauuaccgaaaucguguauuugacaaauaccacuauugagaaggaaaucugccccaaauuagcugaguacaggaacuggagcaagccucagugugacauaacaggguucgcaccauuuuccaaagauaauucuauucggcugucggccggaggugacaucuggguaacccgcgagcccuaugugucaugcgauccugacaaguguuaccaauucgcgcuaggccaggggacgacucucaacaauguccauagcaacgauaccgugcacgaccgaacaccauaucguacucugcuuaugaaugaacugggcauucccuuucauuugggaaccaagcagguuugcaucgcuuggaguuccucuagcugucacgaugguaaagccuggcuccaugugugcgucacaggggacgauaagaacgcaaccgccuccuucaucuacaauggaagacugguggacucaauuguaaguuggagcaaagagauacugaggacgcaggaaucugaguguguuugcaucaacggcacuuguacaguggucaugaccgauggcuccgcuucagggaaggcagacacuaaaauucucuuuaucgaggaaggaaagauagugcacacaagcaccuuaagugguucugcccaaaauguggaggaaugcuccugcuauccucgguacccaggcguccgcuguguuugcagagauaacuggaaggggagcaacaggccgauuguggacaucaauaucaaagacuacucgauuguaucucgguauguguguuccggacuggucggcgauacgccccgcaagaacgacucaaguagcuccucucacugccuuaauccuaacaaugaggaaggugggcauggagugaaaggcugggcuuucgaugacggcaacgauguuuggauggggcgaaccaucagcgagaagucaagaaguggauacgagacauuuaaagugauugaagguugguccaauccaaacagcaaguugcagauaaauaggcaggucaucguggaccggggcaaccguucuggguauucaggaauuuucaguguagagggcaaaagcuguaucaaucgcugcuuuuacguugaacugaucagagguaggaaggaggaaacugaggugcuauggaccuccaacucuauugucguguucugugggacaucgggcacuuauggaaccggcagcuggcccgauggggccgacauaaaucucaugccuaucuga

SEQ ID NO: 138457 - RNA, 1410 nt, Artificial Sequence
  derived and/or modified sequence opt3 from neuraminidase__InfluenzaA__ACF33785
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaugugccccaaauuagcugaguacaggaauuggaguaagccucagugugacaucacaggguucgcaccauuuagcaaagauaacuccauacggcugucugccggaggugacauuuggguaacccgcgagcccuaugugucgugcgauccugacaaguguuaccaauucgcgcuaggccaggggacgacucucaauaacguccauucaaaugauaccgugcacguucgaacaccauaucguacucugcuuaugaacgaacugggagugcccuuucauuugggcaccaagcaggucugcaucgcuuggagcaguuccucuugucacgacgguaaagccuggcuccaugugugcguaacaggggaugacaagaaugcaaccgccagcuucauuuacaacggaagacugguugauuccaucgugucauggaguaaagacauccugaggacgcaggagagcgaaugugucugcauuaauggcacuuguacaguggugaugaccgauggcucugcuuccgggaaggcagacacuaaaauacucuuuaucgaggagggaaagauuguccacacaucaaccuuaagcgguagugcccaacacguugaagagugcucuugcuauccucgguacccaggcgugcgcuguguaugcagagauaacuggaagggguccaacaggccgaucguggacauaaauauuaaagacuacagcaucgucucgucuuauguguguuccggacugguuggcgauacgccccggaagaccgacucaaguagcuccucucauugccuugauccuaacaaugaagagggugggcacggagugaaaggcugggcuuucgacgauggcaacgacgucuggauggggcgcacaaucagcgaaaaguugcgacugggauacgagacuuuuaaagugauugaggguuggucaaauccaaacaguaagcuacagaucaauagacagguaauuguugauaggggcaaccgguccggguauagcggaauauucucuguggaaggcaaaucauguaucaaucguugcuuuuacgucgagcucauucgcgguagaaaggaagagaccgaagugcuguggacaaguaacagcaucgucguguucugugggacuuccggcaccuauggaacaggcucuuggcccgacggggccgauaucaaucuuaugccuauuuga

SEQ ID NO: 138458 - RNA, 1413 nt, Artificial Sequence
  derived and/or modified sequence opt3 from neuraminidase__InfluenzaA__ACF33787
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccccuguaacacuugccggaaauucgucacuguguagcauuaguggcugggcgaucuacaccaaagauaacuccaucaggauugguucuaagggggacguguucgucauacgggagccauuuaucagcugcucccauuuggaguguaaaacuuucuuuuuaacacaaggagcucugcuaaaugauaagcacucaaacggcaccgugaaggaccgcaguccguaucgagcccucaugagcugcccccugggcgaagcaccuucuccauacaauuccaaauucgagucaguugccuggagcgcuagugcaugucaugaugggauuggauggcuuacgaucgguauaucuggccccgacaacggggccguggcuguccugaaguauaacggaauuaucacuggcaccaucaaauccuggaagaaacagauuuugcguacacaggaaagcgagugcguguguaugaaugguucgugcuuuacuaucaugaccgaugggccuggaaacggcgccgcgucuuacaagauuuucaagauagagaaaggcaagguaacaaaauccauggaacucaaugcaccaaacuuucacuaugaggaauguucaugcuaccccgacaccgggacgguuaugugugugugcagagauaauuggcacggaaguaacaggccuugggucagcuucaaucagaaccuggacuaccaaaucgguuauauuugcuccggcguguuuggggauaauccacggccgaaggacggagagggcucuuguaaccccgugacugucgauggugccaaugggguuaaaggcuucagcuacaaguauggaaacggcguguggaucgggcgcacaaaaucaaauagaaucaggaagggauuugagaugauuugggacccuaacgguuggaccaauacugacagugauuucuccguaaagcaggacauaguggcuaucacagauuggagcggcuacucugggucauuuguccagcauccagaacugaccggacucgacugcauucggcccuguuucuggguggaguuaguucgcggccugccuaaagaaaacacgaccaucuggacaagugguagcuccauuucuuucugcggggugaacucgggcaucgccaauuggagcuggccagauggagcagagcuucccuuuacuauagacaaguga

SEQ ID NO: 138459 - RNA, 1410 nt, Artificial Sequence; identical to SEQ ID NO: 137900
  derived and/or modified sequence opt3 from neuraminidase__InfluenzaA__ACF33798

SEQ ID NO: 138460 - RNA, 1410 nt, Artificial Sequence; identical to SEQ ID NO: 138073
  derived and/or modified sequence opt3 from neuraminidase__InfluenzaA__ACF41672

SEQ ID NO: 138461 - RNA, 1413 nt, Artificial Sequence; identical to SEQ ID NO: 138046
  derived and/or modified sequence opt3 from neuraminidase__InfluenzaA__ACF41683

SEQ ID NO: 138462 - RNA, 1410 nt, Artificial Sequence
  derived and/or modified sequence opt3 from neuraminidase__InfluenzaA__ACF41749
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugggauuguguauuugaacaauaccacaaucgaaaaggagauuugucccaaagucguggaauacaggaacuggaguaagccucagugccaaaucaccggauucgccccauuuagcaaagauaauuccauacgguuaucugcggguggcgacauuuggguuacucgcgagcccuaugugucgugugaucaugggaagugcuaccaguucgcucugggacagggcacaacccuagacaacaagcacucaaaugauacgauccaugaccguauuccucaccgaacucuccugaugaacgagcuuggugucccauuucaucuggggaccagacagguguguaucgccuggagcaguuccucuugccacgauggaaaagcaugguugcacguauguaucacaggcgacgauaagaaugccacugcuagcuucauuuaugacggcaggcucguugauuccauagggucauggagucaaaacauccugcggacccaggaaagcgagugcguguguauuaauggaacaugcaccgucgugaugacggacgguucugcauccggccgcgccgauacuagaauccuguuuauagaagaggggaaaauugugcauaucucaccccucagcggaagugcucagcacgucgaggaaugcucuuguuacccuagguauccaggcguucggugcaucugucgcgacaacuggaaggguuccaaucgaccggugguagacauuaacauggaggauuacagcaucgacucgucuuacgugugcuccggguuagucggagauacacccagaaacgacgauaggucaaguaauagcaacugucggaauccuaacaaugaacguggcaaccagggcgugaaagggugggccuucgacaauggagaugacguuuggaugggucgcaccauuuccaaggaucugagaucuggcuaugagacuuuuaaggugauagggggauggagcacaccaaacucaaaaagucaaaucaauaggcaggucauuguggacuccgauaaccggagcggcuacucugguaucuucucaguagaagggaagaguugcaucaaucgauguuuuuauguugagcuuauucgcggcagaaaacaggagaccagggugugguggacgagcaacuccauagucguguucugcggaaccucuggcacauacgggacuggaucguggcccgacggugcgaauaucaacuuuaugccuauuuga

SEQ ID NO: 138463 - RNA, 1410 nt, Artificial Sequence
  derived and/or modified sequence opt3 from neuraminidase__InfluenzaA__ACF41760
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugaucgaggcaagugcuaccaguucgcucuggggcagggaacaacccuagacaacaagcauucaaaugauacgauccacgaccguauuccucauagaacucuccugaugaacgaacuuggcgucccauuucaccuggguaccaggcaaguguguaucgccuggagcaguuccucuugccaugaugggaaagcaugguugcacguauguaucacaggagacgauaagaaugccacugcuagcuucauuuaugacggccggcucguugauuccauaggcucauggagucagaacauccugcgcacccaggagagcgaaugcguguguauuaaugggacaugcaccgucgugaugacggacggaucugcauccgguagagccgauacuaggauccuguuuauagaggagggcaaaauugugcacaucucaccccucagcgggagugcucagcaugucgaagagugcucuuguuacccucgguauccaggaguucgcugcaucugucgagacaacuggaagggcuccaauagaccggugguagacauuaacauggaagauuacagcaucgacucgucuuacgugugcuccgguuuagucggggauacacccaggaacgacgaucggucaaguaauagcaacugucguaauccuaacaaugagcgcggaaaccagggcgugaaaggcugggccuucgacaauggggaugacguuuggaugggaagaaccauuuccaaggaucugaggucugguuaugaaacuuuuaaggugauaggcggguggagcacaccaaacucaaaaagucaaaucaaucggcaggucauuguggacuccgauaaccgaagcggauacucuggcaucuucucaguagaggguaagaguugcaucaaucgcuguuuuuauguugagcuuauuagagggaggaaacaggaaacccgggugugguggacgagcaacuccauagucguguucugcggcaccucuggaacauacggcacugggucguggcccgacggagcgaauaucaacuuuaugccuauuuga

SEQ ID NO: 138464 - RNA, 1410 nt, Artificial Sequence
  derived and/or modified sequence opt3 from neuraminidase__InfluenzaA__ACF41771
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugaucauggcaagugcuaccaguucgcucuggggcagggaacaacccuagacaacaagcacucaaaugauacgauccaugaccguauuccucaccgaacucuccugaugaacgaacuuggcgucccauuucaucuggguaccagacagguguguaucgccuggagcaguuccucuugccacgaugggaaagcaugguugcacguauguaucacaggagacgauaagaaugccacugcuagcuucauuuaugacggcaggcucguugauuccauaggcucauggagucaaaacauccugcggacccaggagagcgaaugcguguguauuaaugggacaugcaccgucgugaucacggacggaucugcauccggucgcgccgauacuagaauacuguuuauugaggagggcaaaaucgugcauaucucaccccucagcgggagugcucagcacgucgaagagugcucuuguuacccuagguauccaggaguucggugcauuugucgcgacaacuggaagggcuccaaucgaccggugguagacaucaacauggaagauuacagcauugacucgucuuacgugugcuccgguuuagucggggauacacccagaaacgacgauaggucaaguaauagcaacugucggaauccuaacaaugagcguggaaaccagggcgugaaaggcugggccuucgacaauggggaugacguuuggaugggacgcaccauauccaaggaucugagaucugguuaugaaacuuuuaaggugaucggcggguggagcacaccaaacucaaaaagucaaauuaauaggcaggucaucguggacuccgauaaccggagcggauacucuggcaucuucucaguagaggguaagaguugcauuaaucgauguuuuuauguugagcuuauacgcgggagaaaacaggaaaccagggugugguggacgagcaacuccaucgucguguucugcggcaccucuggaacauacggcacugggucguggcccgacggagcgaauauuaacuuuaugccuaucuga

SEQ ID NO: 138465 - RNA, 1410 nt, Artificial Sequence; identical to SEQ ID NO: 136111
  derived and/or modified sequence opt3 from neuraminidase__InfluenzaA__ACF41793

SEQ ID NO: 138466 - RNA, 1410 nt, Artificial Sequence; identical to SEQ ID NO: 136111
  derived and/or modified sequence opt3 from neuraminidase__InfluenzaA__ACF41804

SEQ ID NO: 138467 - RNA, 1410 nt, Artificial Sequence; identical to SEQ ID NO: 136111
  derived and/or modified sequence opt3 from neuraminidase__InfluenzaA__ACF41826

SEQ ID NO: 138468 - RNA, 1365 nt, Artificial Sequence; identical to SEQ ID NO: 137735
  derived and/or modified sequence opt3 from neuraminidase__InfluenzaA__ACF41837

SEQ ID NO: 138469 - RNA, 1413 nt, Artificial Sequence
  derived and/or modified sequence opt3 from neuraminidase__InfluenzaA__ACF41881
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugguagcagggaaagacaagaccucggugacacuugccggaaauucaagccuguguaguaucuccggcugggcgauuuacaccaaagauaacucuaucaggaucgguagcaagggggacgucuucgugauucgggagccuuuuauauccugcucacauuuggagugucgcacuuucuuuuuaacacaaggagcucugcuaaaugauaaacacaguaacggcaccguuaaggaccgaagcccauaucgugcccucaugucuugcccgcugggcgaagcacccuccccuuacaauucaaaguucgagagcguggccuggagugcuucugcaugucaugaugggaugggauggcuuacgaucgguauuuccggcccagacaacggggccgucgcugugcugaaauauaacggaaucauaacugaaaccauuaagagcuggaaaaagagaaucuugaggacacaggagucggagugcguauguguuaauggcucuugcuuuacuaucaugaccgauggucccuccaacggggccgcgucauacaaaauuuucaagaucgaaaagggaaaagugacaaagaguauugagcucaaugcaccuaacuuucacuaugaagaguguagcugcuacccagacaccggcacggucaugugugugugccgggauaauuggcacggcuccaaccgccccugggugucuuucaaucagaaccuggacuaccagauaggguauaucugcagcggagucuuuggugauaauccuagaccaaaagacggcgaggggucauguaacccgguuacuguggauggagccgacggcguaaaggguuucaguuacaaauaugggaauggcguguggauuggaaggacaaaguccaaccggcugcgcaaaggcuuugaaaugaucugggaccccaauggguggaccgauacugacagcgauuucucugucaagcaagacgugguugcuaucacagauuggucaggauacagugguagcuuugugcagcauccugagcucaccggcuuagacugcauucgaccauguuucugggucgaacuggugagagggcuucccagggagaacacgaccauauggacauccggaucuucgaucagcuucugcggcguaaauuccgauacugccaacuggucauggccugacggugcagaauugccauuuaccauugauaaguga

SEQ ID NO: 138470 - RNA, 1410 nt, Artificial Sequence; identical to SEQ ID NO: 137945
  derived and/or modified sequence opt3 from neuraminidase__InfluenzaA__ACF41892

SEQ ID NO: 138471 - RNA, 1410 nt, Artificial Sequence; identical to SEQ ID NO: 136343
  derived and/or modified sequence opt3 from neuraminidase__InfluenzaA__ACF41903

SEQ ID NO: 138472 - RNA, 1410 nt, Artificial Sequence
  derived and/or modified sequence opt3 from neuraminidase__InfluenzaA__ACF41914
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguaccugggcguucgcugugugugcagagacaacuggaagggguccaauaggccaauaguagauauuaacaucaaagacuacagcaucgugucgucuuaugucuguuccggacuugugggcgacacgccgcggaagaaugauucaaguagcuccucucauugcuuggaccccaacaaugaggaaggugggcacggaguuaaaggcugggcuuucgaugacggcaacgauguguggauggggcgcaccauuagcgagaagcugcgaucaggauacgagacauuuaaagucaucgaagguuggaguaauccuaacuccaagcuacagauuaauagacaggugauaguagacaggggcaaccggagcggguauucuggaaucuucucaguugagggcaaaaguuguauuaaucguugcuuuuacguggaacucauccgcgguagaaaggaggaaacugagguccuguggaccagcaacuccaucguggucuucugugggacaucuggcacuuauggaaccggcucguggccagauggggccgacauuaaucuuaugcccauauga

SEQ ID NO: 138473 - RNA, 1413 nt, Artificial Sequence
  derived and/or modified sequence opt3 from neuraminidase__InfluenzaA__ACF41925
augaaccccaaucagaagaucauuaccauaggcagcaucuccauggccauugggaucauuucucugauccuccaaauaggaaacaucauuucaaucugggcuagucacagcauucagacagguucccagaaucauacuggcaucugcaaccagagaauaauuacguacgaaaauucuaccugggugaaccaaacauaugucaauaucaacaauacuaacguuguggcagggaaagacaagaccucgguaacacuugccggaaauucaagccuguguccuauuaggggcugggcgaucuacaccaaagauaacaguauccggauugguuccaagggggacguguucgucauacgcgagccauuuaucucuugcagccacuuggagugucgaacuuucuuuuuaacacagggagcucugcuaaaugauaaacauuccaacggcaccgugaaggaccguucaccguauagagcccucaugaguugcccccugggcgaagcaccuagcccauacaauucuagguucgaguccguugccuggucagcuagcgcaugucacgaugggaugggauggcuuacgauugguaucaguggccccgacaacggggccguggcuguccugaaguauaacggaauaauuacugaaaccaucaaaucuuggaagaaacggaucuugcgcacacaggaguccgagugcguguguguaaauggcagcugcuuuacuauuaugaccgaugguccuucgaacggggccgcgucuuacagaaucuucaagauugaaaaaggaaagguuacaaaguccauagagcucgacgcaccaaauuaucauuacgaagaguguucaugcuaccccgauaccggcacggugaugugugucugcagggacaacuggcacggcaguaaucggccuugggugagcuuuaaccagaaucuggauuaucaaaucggguacauuugcuccggaguguucggugacaacccacgcccgaaagauggcgaggggucuuguaaucccgucacuguugacggagccgacggcgugaaggguuuuagcuaucgauacgggaacggcguauggaucggaagaacaaaaucaaauaggcugcggaagggcuucgaaaugaucugggauccuaacggguggaccgacacugauagugacuuuuccgugaaacaggaugucguggcuaugacagacuggagcggauauucugguucauucguucagcacccagagcucaccggcuuagauugcaugcgucccuguuuuuggguggaacugauucgcgggagaccuagggagaauacgaccauauggacaaguggaagcuccaucucuuucugcggcgucaacucggacacugccaauuggagcuggccagauggugcagaacuucccuucaccauugacaaguga

SEQ ID NO: 138474 - RNA, 1413 nt, Artificial Sequence; identical to SEQ ID NO: 138473
  derived and/or modified sequence opt3 from neuraminidase__InfluenzaA__ACF41936

SEQ ID NO: 138475 - RNA, 1410 nt, Artificial Sequence
  derived and/or modified sequence opt3 from neuraminidase__InfluenzaA__ACF54392
augaaccccaaucagaagaucauuaccauaggcagcgugucccugacaacugccacggcuugcuuccucacccaaaucgcaauucuugucacaacuguuacccugcacuuuaaacagcaugagugugacucuccugccucaaaccaggugaugccaugcgaaccgaucauuaucgagagaaauauaacagaaaucguauacuugaacaauaccacuauugagaaggaaaucugucccaaaguggucgaguauaggaacuggaguaagccucagugccaaauuacaggguucgcgccauuuagcaaagauaauuccauccgguuaucugcuggaggugacauaugggugacccgcgagcccuacguuucgugugauucaggcaagugcuaucaguucgcccuggggcagggaacgacucuagacaacaagcacagcaaugauaccauucaugaccgaaucccucaccguacacuccugaugaacgaacuuggcgugccauuucaucuggguacuagacaggucuguauugcauggaguuccucuagcugccacgaugggaaagccugguugcacguguguaucaccggagacgauaagaaugcuacagcauccuucaucuacgacggcaggcucguagauucaauuggcaguuggagccaaaacauacugcggacccaggagucugaaugcguuuguaucaaugggacgugcacuguggucaugacagacggauccgccucaggucgcgcugauaccaggauucuguuuaucgaggagggcaaaauagugcauauuagcccccucagugggucugcccagcacguggaagagugcuccuguuauccuagguacccaggaguccggugcaucugucgcgacaacuggaagggcagcaaucgaccgguuguggacaucaacauggaagauuauucgauugacucuuccuacguaugcucagguuuagugggggauacucccagaaacgacgauagguucaguaauagcaacugucggaauccuaacaaugagcguggaaaccagggcgucaaaggcugggcguuugacaauggggaugacguguggaugggacgcacaaucuccaaggaucugagaucugguuacgaaaccuucaagguuauuggcggguggagcacgccaaacucaaaaagucaaauaaauagacaggugaucgucgacuccgauaaccggagcggauauucuggcaucuuuucaguggaggguaagaguugcauuaaucgauguuucuacguagagcuuauccgcgggagaaaacaggaaaccaggguuugguggacaagcaacuccauuguggucuuuugcggcacuucuggaaccuauggcacagggucguggcccgacggagcaaauauaaacuucaugccuaucuga

SEQ ID NO: 138476 - RNA, 1410 nt, Artificial Sequence; identical to SEQ ID NO: 136111
  derived and/or modified sequence opt3 from neuraminidase__InfluenzaA__ACF54403

SEQ ID NO: 138477 - RNA, 1410 nt, Artificial Sequence; identical to SEQ ID NO: 136111
  derived and/or modified sequence opt3 from neuraminidase__InfluenzaA__ACF54414

SEQ ID NO: 138478 - RNA, 1410 nt, Artificial Sequence; identical to SEQ ID NO: 136111
  derived and/or modified sequence opt3 from neuraminidase__InfluenzaA__ACF54425

SEQ ID NO: 138479 - RNA, 1410 nt, Artificial Sequence; identical to SEQ ID NO: 136111
  derived and/or modified sequence opt3 from neuraminidase__InfluenzaA__ACF54436

SEQ ID NO: 138480 - RNA, 1410 nt, Artificial Sequence
  derived and/or modified sequence opt3 from neuraminidase__InfluenzaA__ACF54447
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugaucauggcaagugcuaccaguucgcucuggggcagggaacaacccuagacaacaagcacucaaaugauacgauccaugaccguauuccucaccgaacucuccugaugaacgaacuuggcgucccauuucaucuggguaccaaacagguguguaucgccuggagcaguuccucuugccacgaugggaaggcaugguugcacguauguaucacaggagacgauaaaaaugccacugcuagcuucauuuaugacggcagacucguugauuccauaggcucauggagucaaaacauccugaggacccaggagagcgaaugcguguguauuaaugggacaugcaccgucgugaugacggacggaucugcauccggucgggccgauacucgcauccuguuuauagaggagggcaagauugugcauaucucaccccucagcgggagugcucagcacgucgaagagugcucuuguuacccuagauauccaggaguuaggugcaucugucgggacaacuggaaaggcuccaaucgcccggugguagacauuaacauggaagauuacagcaucgacucgucuuacgugugcuccgguuuagucggggauacaccccgaaacgacgauagaucaaguaauagcaacuguaggaauccuaacaaugagcggggaaaccagggcgugaagggcugggccuucgacaauggggaugacguuuggaugggacguaccauuuccaaggaucugcgcucugguuaugaaacuuuuaaagugauaggcggguggagcacaccaaacucaaagagucaaaucaauagacaggucauuguggacuccgauaacaggagcggauacucuggcaucuucucaguagaggguaaaaguugcaucaaucgguguuuuuauguugagcuuauucgagggcgcaagcaggaaaccagagugugguggacgagcaacuccauagucguguucugcggcaccucuggaacauacggcacugggucguggcccgacggagcgaauaucaacuuuaugccuauuuga

SEQ ID NO: 138481 - RNA, 1410 nt, Artificial Sequence
  derived and/or modified sequence opt3 from neuraminidase__InfluenzaA__ACF54469
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugaucauggcaagugcuaccaguucgcucuggggcagggaacaacccuagacaacaagcacucaaaugauacgauccaugaccgaaucccucaccguacucuccugaugaacgaacuuggcgucccauuucaucuggguaccagacagguguguauggccuggagcaguuccucuugccacgaugggaaagcaugguugcacguauguauuacaggagacgauaagaaugccacugcuagcuucaucuaugacggcaggcucguugauuccauuggcucauggagucaaaacauacugcggacccaggagagcgaaugcguguguaucaaugggacaugcaccgucgugaugacggacggaucugcauccggucgcgccgauacuaggauucuguuuaucgaggagggcaaaauagugcauauuucaccccucagcgggagugcucagcacgucgaagagugcucuuguuacccuagauauccaggaguucggugcaucugucgcgacaacuggaagggcuccaaucgaccggugguagacaucaacauggaagauuacagcauugacucgucuuacgugugcuccgguuuagucggggauacacccagaaacgacgauaggucaaguaauagcaacugucggaauccuaacaaugagcguggaaaccagggcgugaaaggcugggccuucgacaauggggaugacguuuggaugggacgcaccaucuccaaggaucugagaucugguuaugaaacuuuuaaggugauuggcggguggagcacaccaaacucaaaaagucaaauaaauaggcaggucaucguggacuccgauaaccggagcggauacucuggcauuuucucaguagaggguaagaguugcaucaaucgauguuuuuauguugagcuuauccgcgggagaaaacaggaaaccagggugugguggacgagcaacuccauugucguguucugcggcaccucuggaacauacggcacugggucguggcccgacggagcgaauauaaacuuuaugccuaucuga

SEQ ID NO: 138482 - RNA, 1410 nt, Artificial Sequence; identical to SEQ ID NO: 137776
  derived and/or modified sequence opt3 from neuraminidase__InfluenzaA__ACF54480

SEQ ID NO: 138483 - RNA, 1410 nt, Artificial Sequence
  derived and/or modified sequence opt3 from neuraminidase__InfluenzaA__ACF54502
augaaccccaaucagaagaucauuaccauaggcagcgugucccugacaaucgccacugucugcuuccucaugcaaauugcuauccuugcaacgaccguuacacugcacuuuaaacagcaugagugugacucuccugccucaaaccaggugaugccaugcgaaccgauuaucauagagagaaauaucacugaaauuguauacuugaacaauaccacaaucgagaaggaaauuugucccgagguggucgaguauaggaacuggaguaaaccucagugccaaaucaccggguucgcgccauuuagcaaggauaauuccauacgguuaucugcuggaggugacauuugggugacucgcgaacccuacguuucgugugauccuggcaaaugcuaucaguucgcccuggggcagggaacaacccuagacaacaagcacucaaauggcacgauccaugaucguauuccacaccgaacucuccugaugaacgagcuuggugugagcuuucaucuggggaccaagcaggucuguguggcauggaguuccucuagcugccacgacggaaaagccugguugcacguauguguuacaggcgaugacagaaaugcuacugcauccuucaucuacgauggcaggcucguggacucaaucgggaguuggagccaaaacauucugcggacccaggaaucugagugcgucuguauaaauggaacaugcaccguggugaugacggaugguuccgccucaggccgcgcugacacuagaauccuguuuauuaaggaggggaaaaucguccauauaagcccccucaguggaucugcccagcacauugaagagugcuccuguuauccuagguacccagauguucggugcaucugucgcgacaacuggaagggcagcaaucgaccggugaucgacauuaacauggaagauuauucgaucgacucuuccuacguaugcucagguuuagugggggauacacccagaaacgacgauaguagcuccaauucuaacuguagggacccuaauaacgagcggggaaauccaggcgucaaaggcugggcguucgauaacggggacgauguguggaugggacguaccauuaauaaggacagccgcucagguuacgaaacuuuuaagguuauaggcggguggaguacacccaacuccaaaagccaggugaauagacaagucaucguggauaacaauaacuggucuggauauucaggcauuuucaguguagaggguaagagcugcaucaauagguguuuuuacguugagcugauccgggggcgaccucaggaaacccgcgugugguggacguccaacucuauugucguguucugcggcaccucgggaacauauggcacugggagcuggccagacggagcaaauauaaacuuuaugcccaucuga

SEQ ID NO: 138484 - RNA, 1410 nt, Artificial Sequence; identical to SEQ ID NO: 138483
  derived and/or modified sequence opt3 from neuraminidase__InfluenzaA__ACF54513

SEQ ID NO: 138485 - RNA, 1410 nt, Artificial Sequence
  derived and/or modified sequence opt3 from neuraminidase__InfluenzaA__ACF54524
augaaccccaaucagaagaucauuaccauaggcagcgugucccugacaaucgccacugucugcuucuuuaugcaaauugcuauccucgcaacgaccguuacacuucacuucaaacagcaugagugugacucuccugccucaaaccaggugaugccaugcgaaccgauuaucauagagagaaauaucacugaaauuguauaccugaacaauaccacaaucgagaaggaaauuugucccgagguggucgaguauaggaacuggaguaaaccucagugccaaaucaccggguuugcgccauucagcaaggauaauuccauacgguugucugcuggaggugacauuugggugacucgcgaacccuacguuucgugugauccuggcaaaugcuaucaguuugccuuagggcagggaacaacccuggacaacaagcacucaaauggcacgauccaugaucguauuccacaccgaacucuacucaugaacgagcugggugugagcuuccaucuugggaccaagcaggucuguguggcauggaguuccucuagcugccacgacggaaaagccuggcugcacguauguguuacaggcgaugacagaaaugcuacugcauccuuuaucuacgauggcagguugguggacucaaucgggaguuggagccaaaacauucuccggacccaggaaucugagugcgucuguauaaauggaacaugcaccguggugaugacggaugguuccgccucaggccgcgcugacacuagaauccuguucauuaaggaggggaaaaucguccauauaagcccccugaguggaucugcccagcacauugaagagugcuccuguuauccuagguacccagauguucggugcaucugucgcgacaacuggaagggcagcaaucgaccggugaucgacauuaacauggaagauuauucgaucgacucuuccuacguaugcucaggucucgugggggauacacccagaaacgacgauaguagcuccaauucuaacuguagggacccuaauaacgagcggggaaauccaggcgucaaaggcugggcguuugauaacggggacgauguguggaugggacguaccauuaauaaggacagccgcucagguuacgaaacuuucaagguuauaggcggguggaguacacccaacuccaaaagccaggugaauagacaagucaucguggauaacaauaacuggucuggauauucaggcauuuuuaguguagaggguaagagcugcaucaauagguguuucuacguugaguuaauccgggggcgaccucaggaaacccgcgugugguggacguccaacucuauugucguguuuugcggcaccucgggaacauauggcacugggagcuggccagacggagcaaauauaaacuucaugcccaucuga

SEQ ID NO: 138486 - RNA, 1410 nt, Artificial Sequence
  derived and/or modified sequence opt3 from neuraminidase__InfluenzaA__ACF54535
augaaccccaaucagaagaucauuaccauaggcagcgugucccugaucauuucuacaaucugcuucuuuaugcaaacugccauucucaucacgaccgucacacuucacuucaaacaguacgaguuuaacucaccuccaaauaaccagguuaugcugugugaaccgacuauaaucgagagaaauauuaccaagaucguguauuugacaaacaccacuauugaaaaagagaucugccccaaguuagcugaauacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgagcugggaguucccuuucacuugggcaccaaacaggugugcauugcuuggagcaguuccucuugucaugaugguaaggccuggcuccacgucugcaucacaggggacgauaaaaaugcaaccgccagcuucaucuacaacggaaggcugguggacuccauuguaucauggaguaaggaaauacugcggacgcaggagagcgaauguguuugcaucaauggcacuuguacaguggucaugaccgauggcucugcuuccgggaaagcagacacuaagauucucuuuaucgaggagggaaagauagugcauacaucaaccuuaagcgguagugcccaacacguggaagagugcucuugcuauccucgcuacccaggcgucagauguguuugcagggauaacuggaaaggguccaaccggccgauuguggacaucaauaucaaggaccacagcauuguaucgucuuacguguguuccggacuggucggcgauacgccccgcaaaaacgacucaaguagcuccucucauugccuugauccuaauaacgaagagggugggcacggagugaagggcugggcuuucgacgauggcaaugacguuuggauggggcgaaccaucagcgaaaaaucaagauugggauaugagacauuuaaggugauugaggguuggaguaacccaaaauccaagcugcagauaaauaggcaggucaucguggaucggggcaaccguagcggguacucuggaauuuucucaguagaaggcaagaguuguaucaaucgcugcuuuuauguugagcuaaucagagguaggaaagaagagacugaagugcucuggaccagcaacuccauugucguguucugugggacaucuggcacuuacggaaccggcucguggcccgacggggccgauauaaaucugaugccuaucuga

SEQ ID NO: 138487 - RNA, 1410 nt, Artificial Sequence; identical to SEQ ID NO: 136300
  derived and/or modified sequence opt3 from neuraminidase__InfluenzaA__ACF54557

SEQ ID NO: 138488 - RNA, 1410 nt, Artificial Sequence; identical to SEQ ID NO: 137945
  derived and/or modified sequence opt3 from neuraminidase__InfluenzaA__ACF54568

SEQ ID NO: 138489 - RNA, 1410 nt, Artificial Sequence
  derived and/or modified sequence opt3 from neuraminidase__InfluenzaA__ACF54579
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaucaccgacggcucugcuuccgggaaggcagauacuaaaauucucuuuaucgaggaaggaaagauagugcacacaucaaccuuaagcgguagugcccaacacgucgaggaaugcucuugcuauccucgguacccaggcguucgcugugugugcagagacaacuggaagggguccaauaggccgauuguagauaucaacaucaaagacuacagcauugugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccaucagcgagaaguugcgaucaggauacgagacauuuaaagucauugaagguuggaguaauccaaacuccaagcugcagauaaauagacaggugaucguagacaggggcaaccggagcggguauucuggaauuuucucaguugagggcaaaaguuguaucaaucguugcuuuuacguggaacuaauccgcgguagaaaggaggaaacugagguccucuggaccagcaacuccauuguggucuucugugggacaucuggcacuuauggaaccggcucguggcccgauggggccgacauaaaucugaugccuaucuga

SEQ ID NO: 138490 - RNA, 1362 nt, Artificial Sequence
  derived and/or modified sequence opt3 from neuraminidase__InfluenzaA__ACF54601
augaaccccaaucagaagaucauuaccauaggcagcaucugcaugguggucgggauuaucucccugauucuccaaaucggaaacauaaucucuauuuggaucucacacaguauucagacagguaaucagaaccauacuggcaucuguaaucaggggagcauaacguacaaaguuguggccggacaagacuccaccucuguaauucuuacaggcaacucgucacugugcccuaucagagguugggcuauucacagcaaggauaaugggaucaggaucggaaguaaaggcgacguguucgucauucgggagccauuuauauccuguucucauuuggaaugccgcacuuucuuuuuaacccagggcgcacugcuaaacgauaagcacagccgagggacauucaaagaccguuccccguauagagcccucaugucaugucccgugggagaggcgccuaguccauacaauagcagguuugaaucuguugcuugguccgccucagcaugccaugaugguaugggcuggcugaccaucgggauuagcggacccgacgauggcgccguggcuguccuuaaguauaacgguaucauaacugagacaauuaagaguuggcggaaaaauauccugcgcacccaggaaucugaguguacgugcgugaacggguccuguuucacuaucaugaccgacggaccuagcgauggcuuggcaucguacaagauuuuuaaaaucgagaagggcaaaguaacaaagucuauugaacucaaugccccaaacucccacuaugaggaaugcucauguuaccccgacacugggaagguuaugugcgugugcagagauaauuggcacggaaguaacaggccuugggucagcuucgaccagaaccuggauuauaaaauagguuacaucuguuccggcguguuuggggacaauccacggccgaaggacggaaccggcucuugcggucccgugagcgcugauggggccaacggcgucaaaggauucucauacaaguauggcaaugggguuuggauuggacgcacaaaaagugacuccagccgacaugguuuugagaugaucugggauccuaacggcuggaccgagacggacucuagauucucaaugaggcaagaugugguagcgaugacugaccggaguggguacagcggauccuuugugcagcacccagaacugacaggccucgauuguaugcgucccugcuucugggucgaguuaauccgcggucugccugaagagaaugcaauuuggaccucugggucgauaaucagcuucuguggcgugaacuccgacacuguugauuggucauggccagacggagccgaacuucccuuuacaauugauaaguga

SEQ ID NO: 138491 - RNA, 1350 nt, Artificial Sequence
  derived and/or modified sequence opt3 from neuraminidase__InfluenzaA__ACG50700
augaaccccaaucagaagaucauuaccauaggcagcaucugcauggugauugggaucgucucccugaugcuccaaauuggaaacaugaucucuauauggguuucacacaguauccagacagguaaucagcaucaggccgagccuauuagcaacacuaauuuccuuacggaaaaagcuguggcauccguaacccuggccggcaacucuccauuguguccgaucucggggugggcggugcacucaaaggacaauagcauuagaaucggaaguaaaggcgaugucuuugugauaagggagcccuucauuuccugcucucauuuagaaugucggacauuuuuccugacucaaggugcucuacucaacgacaagcacagcaaugggaccguuaaagaucgcuccccucaucgaacacugaugucaugcccagugggagaggcccccaguccuuacaacagccguuuugaaucugucgcaugguccgccucagcuugucacgacggcaccagcuggcuuacuaucggcauuagugggccagauaauggagcaguggccguacugaaguauaacgguaucaucacagacaccauuaagucuuggagaaauaacauauugaggacgcaggaguccgagugcgcuuguguuaauggcagcugcuucacugugaugaccgaugggcccucgaacggacaggccucuuacaaaaucuuuaagauggaaaaaggcaaggucgugaaauccguggagcucgacgcgccuaacuaucacuacgaagaguguucaugcuauccagaugcaagugaggucacauguguuugccgggacaauuggcaugguagcaaccgcccguggguguccuucaaucagaaccuggaauaccaaauuggguauaucugcucuggaguauuuggcgauaaucccagaccuaacgacggcacugggagcuguggaccagugucaaccaauggugccuacggcgucaagggguucaguuuuaaguacggaaacggcguguggauagguaggacaaaauccaccaauagccggucuggguucgagaugauuugggauucaaacggcuggacgggaacugacaguagcuuuuccguuaagcaggacaucguggcuaucacagauuggucuggcuauucggggagcuucguccagcaccccgaacugaccggacucgacugcauucgcccuuguuucuggguggaguuaauccgagguagaccaaaagaauccacuauuuggacaucaggcaguucuaucagcuuuugcgggguaaauuccgauaccguuggauggucauggcccgacggcgccgagcugccguucacgauagauaaguga

SEQ ID NO: 138492 - RNA, 1410 nt, Artificial Sequence; identical to SEQ ID NO: 138073
  derived and/or modified sequence opt3 from neuraminidase__InfluenzaA__ACG70145

SEQ ID NO: 138493 - RNA, 1410 nt, Artificial Sequence; identical to SEQ ID NO: 137900
  derived and/or modified sequence opt3 from neuraminidase__InfluenzaA__ACG70156

SEQ ID NO: 138494 - RNA, 1410 nt, Artificial Sequence
  derived and/or modified sequence opt3 from neuraminidase__InfluenzaA__ACG80407
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagaugaugcugugugaaccgacuauaaucgagagaaauauuaccgaaaucguuuauuugacaaacaccacuauugagaaggaaaucugccccaaauuagcuaaguacaggaauuggaguaaaccucagugugacauaacaggguucgcaccauuuagcaaggauaacuccauucggcugucugccggaggugacaucugggugacccgcgagcccuauguaucgugcgauccugacaaguguuaccaauucgcgcuaggccaggggacgacucucaauaacgugcauucaaaugauaccgcucgaggacguacaccauauagaacucugcuuaugaacgagcugggcguccccuuucacuuggguaccaaacaggugugcauugccuggagcaguuccucuugucaugacgggaaggcauggcuccacguuugcaucacaggagaugacaaaaaugccaccgcuagcuucaucuacaacggcaggcugguggauuccgucgugucauggaguaaggaaauucugcggacgcaggagagcgaauguguaugcauaaauggcacuuguacaguugugaugaccgacgggucugcauccggagaggccgauacuaaaauccucuuuauugaggaagguaagaucguccauacaucaaccuuaagcggcagugcucaacacguggaggaaugcucuugcuauccucgcuacccaggggugagaugugucugcagggacaacuggaagggauccaaccggccgauaguugauauuaauaucaaagaccacagcaucgugucgucuuacguauguuccggccuggugggugacacgccccgcaagaacgauucaaguagcuccucucauugccuugacccuaauaacgaggaagggggacacggcgucaaaggcugggccuucgaugacgggaaugauguguggaugggacgaaccauuagcgagaagucaagauuggguuaugagacauuuaaaguuaucgaaggcuggaguaacccaaaguccaaacugcagauuaauaggcaagugauagucgaccgggggaaccguagcggauacucuggcaucuucucaguggaggguaagaguuguauuaaucgcugcuuuuauguagaacuaaucagagggaggaaggaggaaacugagguucucuggaccagcaacuccaucguggucuucuguggcacaucuggaacuuacggcaccgggucguggcccgauggagcggacauuaaucugaugccuauauga

SEQ ID NO: 138495 - RNA, 1410 nt, Artificial Sequence
  derived and/or modified sequence opt3 from neuraminidase__InfluenzaA__ACG80411
auggacagcaacuccaagaucauuaccauaggcucugugucacugacaaucaguacuauuugcuucuuuaugcagaucgccauucucaucacgaccgucacacuucacuucaaacaauacgaguuuaauagcccucccaacaaucagaugaugcugugugaaccaacuauaaucgagagaaacauuaccgaaaucguuuauuugacaaauaccacuauugagaaggaaaucugcccgaaauuagcugaguacaggaacugguccaagccccagugugauauaacaggguucgcaccuuuuucuaaagacaauucgauucggcugucagccggaggugauaucugggugacccgcgagccauauguaagcugcgaccccgauaaguguuaccaguucgcgcuaggccaagggacgacucucaacaaugugcauaguaacgacaccgcuggaggccgaacaccuuaucguacucugcuuaugaaugaacugggugucccauuucacuuggggaccaaacaggugugcauugccugguccucuagcuccugucaugauggaaaggcauggcuccacguuugcaucacaggcgacgauaagaacgccaccgcuucauucaucuacgacggcagacugguggauggggucgugaguuggagcaaagagauucugaggacgcaggaaucugaguguguaugcauaaauggaacuuguacaguugugaugaccgacgguuccgcaucaggcgaggccgauacuaagauccucuuuauugaagaggggaaaaucguccauacaagcaccuuaaguggaucugcucagcacguggaagagugcuccugcuauccccgguacccuggcgugcgcugugucugcagagacaacuggaaggguagcaauaggccaauaguugacauuaacaucaaggaucacucgaucgugucuuccuacguauguucagggcuggugggagacacgccgcggaaaaacgauaguagcuccucuagccauugccuugaccccaauaacgaagagggcggccacggggucaagggaugggccuucgaugacgguaaugauguguggaugggccgcaccauuucagagaaaagucgauugggguaugaaacauuuaagguuaucgagggaugguccaacccuaaaagcaagcugcaaauuaauagacaggugauagucgacaggggcaaccggucugguuacucagggaucuucaguguggaaggcaaaagcuguauuaaucguugcuuuuauguagagcuaauccgcggaagaaaggaagagacugagguucucuggaccuccaacucuaucguggucuucuguggcacaucggggacuuacggaaccgguagcuggccagauggcgcggacauuaaucugaugcccauauga

SEQ ID NO: 138496 - RNA, 1407 nt, Artificial Sequence
  derived and/or modified sequence opt3 from neuraminidase__InfluenzaA__ACG80421
augaaccccauccagaagauuauaaccaucggcagcgugucccugacaauuucuacuaucugcuucuuuaugcagauugccauccucauaacgaccgucacacuucacuucaaacaguacgaguuuaauucaccuccaaacaaucagaugaugcugugugaaccgacuaucauugagagaaacaucaccgaaauuguuuauuugacaaauaccacuaucgagaaggaaauaugccccaaauuagcugaguacaggaacuggaguaagccucagugugacauuacaggguucgcaccauuuagcaaagauaauuccauccggcugucugccggaggugacauuugggugacccgcgagcccuauguaucgugcgauccugacaaguguuaccaauucgcgcuaggccaggggacgacucucaacaaugugcauucagauaccgcucgagaccguacaccauauagaacucugcuuaugaacgaacugggaguccccuuucacuugggcaccaaacaggugugcaucgccuggagcaguuccucuugucaugaugguaaggcauggcuccacguuugcaucacaggggacgauaagaaugccaccgcuagcuucauuuacaacggaaggcugguggacuccgucgugucauggaguaaagagauacugcggacgcaggaaagcgaguguguaugcaucaauggcacuuguacaguugugaugaccgauggcucugcauccggggaggccgacacuaagauucucuuuaucgaagagggaaaaauaguccauacaucaaccuuaagcgguagugcucaacacguggaagagugcucuugcuauccucgcuacccaggcgugagaugugucugcagggauaacuggaagggguccaaucggccgauuguugacaucaacaucaaggaccacagcauugugucgucuuacguauguuccggacuggugggcgauacgccccgcaaaaacgacucaaguagcuccucucauugccuugauccuaauaacgaagagggugggcacggagucaagggcugggccuucgacgauggcaaugacguguggauggggcgaaccaucagcgagaaaucaagauugggauaugaaacauuuaagguuauugaggguuggaguaacccaaaauccaagcugcagauaaauaggcaagugaucgucgaucggggcaaccguagcggguacucuggaauuuucucaguggaaggcaaaaguuguaucaaucgcugcuuuuauguagagcuaaucagagguaggaaggaagagacugagguucucuggaccagcaacuccauuguggucuucugugggacaucuggcacuuacggaaccggcucguggcccgacggggcggauauaaaucugaugccuaucuga

SEQ ID NO: 138497 - RNA, 1407 nt, Artificial Sequence
  derived and/or modified sequence opt3 from neuraminidase__InfluenzaA__ACG80427
auggaccccaacagcaagaucauuaccauaggcuccgugucucugacaaucucaacuauuugcuucuuuaugcagaucgccauucucaucacgaccgucacacuucacuucaaacaguacgaguuuaauaguccuccaaacaaucagaugaugcugugugaaccgacuauaaucgagagaaacauuaccgaaaucguuuauuugacaaauaccacuauugagaaggaaaucugccccaaauuagcugaguacaggaacuggagcaagccucagugugauauaacaggguucgcaccauuuuccaaagacaauucuauucggcugucggccggaggugauaucugggugacccgcgagcccuauguaucaugcgacccugauaaguguuaccaguucgcgcuaggccaagggacgacucucaacaaugugcauagcgacaccgcucgagaucguacaccauauagaacucugcuuaugaacgaacugggaguccccuuucacuugggcaccaaacaggugugcauugccuggaguuccucuagcugucaugacgguaaggcauggcuccacguuugcaucacaggggaugacaagaaugccaccgcuuccuucaucuacaacggaaggcugguggauucagucgugaguuggagcaaagagauucugcggacgcaggaaucugaguguguaugcauaaauggcacuuguacaguugugaugaccgacggcuccgcaucaggggaggccgauacuaagauccucuuuauugaagagggaaaaaucguccauacaagcaccuuaagugguucugcucagcacguggaagagugcuccugcuauccucgcuacccaggcgugagaugugucugcagggacaacuggaaggggagcaaucggccgauaguugacauuaacaucaaggaucacucgaucgugucuuccuacguauguucaggacuggugggcgacacgccccgcaaaaacgauaguagcuccucuagccauugccuugacccuaauaacgaagagggugggcacggagucaagggcugggccuucgaugacggcaaugauguguggauggggcgaaccauuucagagaaaaguagauugggauaugaaacauuuaagguuaucgaggguugguccaacccaaaaagcaagcugcaaauuaauaggcaagugauagucgaccggggcaaccguucuggguacucaggaaucuucaguguggaaggcaaaagcuguauuaaucgcugcuuuuauguagagcuaaucagagguaggaaggaagagacugagguucucuggaccuccaacucuaucguggucuucugugggacaucgggcacuuacggaaccggcagcuggcccgauggggcggacauuaaucugaugccuauauga

SEQ ID NO: 138498 - RNA, 1410 nt, Artificial Sequence
  derived and/or modified sequence opt3 from neuraminidase__InfluenzaA__ACG80437
augaaccccaaucagaagaucauuaccauaggcagcgugucccugacaaucucuacuauuugcuucuuuaugcaaaucgccauucucaucacgaccgucacacuucacuucaaacaguacgaguuuaacucaaguccuaauaaccagguuaugcugugugaaccaacuauaaucgagagaaauauuaccgaaaucguguauuugacaaacaccacuauugagaaggaaaucugcccgaaauuagcugaguacaggaauuggagcaagccccagugugacauaacaggguucgcaccuuuuuccaaagauaacucuauucggcugucggccggaggugacaucuggguaacccgcgagccauaugugucaugcgaucccgacaaguguuaccaauucgcgcuaggccaggggacgacucucaauaacguccauagcaauaacaccgugcgagaucguacaccuuauagaacucugcuuaugaaugaacugggaguuccauuucacuugggcaccaaacaggugugcauugcuuggaguuccucuagcugucaugacgguaaggccuggcuccacgucugcaucacaggggaugacaagaacgcaaccgccaauuucaucuacaacggaaggcugguggauuccauuguaucauggaguaaagagauauuucggacgcaggaaagcgaguguguuugcaucaacggcacuuguacaguggucaugaccgacggcucugcuuccgggaaggcagauacuaaaauucuguucaucgaggaaggaaagauagugcauacaucaacccucagcgguagugcccaacacguggaggaaugcucuugcuauccccgcuacccuggcgucagauguguuugcagggacaauuggaagggguccaaccggccaauuguggauaucaauaucaaagaccacagcauuguaucgucuuacguguguuccggauuagucggcgacacgccgcgcaagaacgauucaaguagcuccucucauugccuggaccccaauaacgaggaaggugggcacggagugaaaggcugggcuuuugaugacggcaaugauguuuggauggggcgaaccaucagcgagaagucaagaaguggauaugagacauucaaagugauugaagguugguccaacccuaagagcaaacuucagauaaauaggcaggucaucguggaccggggcaaccguucuggguacucaggaauuuuuaguguagagggcaagagcuguaucaaucgcugcuucuauguugaauugaucagagguaggaaggaggaaacugaggugcuguggaccuccaacucuauugucguguucugugggacaucgggcacuuacggaaccggcagcuggccagauggggccgacauaaaucuaaugcccaucuga

SEQ ID NO: 138499 - RNA, 1407 nt, Artificial Sequence
  derived and/or modified sequence opt3 from neuraminidase__InfluenzaA__ACG80446
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagaugaugcugugugaaccgacuauaaucgagagaaauauuaccgaaaucguuuauuugacaaacaccacuauugagaaggaaaucugccccaaauuagcugaguacaggaauuggaguaagccucagugugacauaacaggguucgcaccauuuagcaaagauaacuccauucggcugucugccggaggugacaucugggugacccgcgagcccuauguaucgugcgauccugacaaguguuaccaauucgcgcuaggccaggggacgacucucaauaacgugcauucagauaccgcucgagaccguacaccauauagaacucugcuuaugaaugaacugggaguccccuuucacuugggcaccaaacaggugugcauugccuggagcaguuccucuugucaugaugguaaggcauggcuccacguuugcaucacaggggacgauaagaacgccaccgcuagcuucaucuacaauggaaggcugguggacuccgucgugucauggaguaaagagauucugcggacgcaggaaagcgaguguguaugcauaaacggcacuuguacaguugugaugaccgauggcucugcauccggggaggccgacacuaagauccucuuuauugaagagggaaaaaucguccauacaucaaccuuaagcgguagugcucaacacguggaagagugcucuugcuauccucgcuacccaggcgugagaugugucugcagggauaauuggaagggguccaaccggccgauaguugacauuaacaucaaggaccacagcaucgugucgucuuacguauguuccggacuggugggcgauacgccccgcaaaaaugacucaaguagcuccucucauugccuugauccuaacaaugaagagggugggcacggagucaagggcugggccuucgacgauggcaacgacguguggauggggcgaaccauuagcgagaaaucaagauugggauaugaaacauuuaagguuaucgaggguuggaguaauccaaaauccaagcugcagauuaacaggcaagugauagucgaucggggcaaucguagcggguacucuggaaucuucucaguggaaggcaaaaguuguauuaaccgcugcuuuuauguagagcuaaucagagguaggaaggaagagacugagguucucuggaccagcaauuccaucguggucuucugugggacaucuggcacuuacggaaccggcucguggcccgacggggcggauauuaaccugaugccuauauga

SEQ ID NO: 138500 - RNA, 1410 nt, Artificial Sequence
  derived and/or modified sequence opt3 from neuraminidase__InfluenzaA__ACG80455
augaaccccaaucagaagaucauuaccauaggcagcguguccuucaucauuucuucaaucugcuuuuucaugcagauugccauccugauaacaacugucacgcuccacuuuaaacaguacgaguucaacaguccuccaaauaaccagaugaugcuuugugaaccgaccaucauugagagaaauaucacagaaauuguuuaucugacuaacaccacaaucgagaaggaaauaugccccaaauuggcugaguacaggaauuggagcaagccucagugugacauuaccggguuugcaccauucuccaaagauaacucuauccgguuaucggccggaggugacauuugggugacucgcgagcccuauguaucaugcgauccugacaaguguuaccaauuugcgcugggccaggggacaacccuaaauaacgugcauagcaaugauacggcucgaggacguacuccauauagaacccuccugaugaacgaacuuggcguccccuuccaccuggguacaaaacaggugugcaucgccuggaguuccucuagcugucaugacgggaaggcaugguugcacguuugcaucacuggagaugacaagaaugccaccgcuuccuuuauuuacgauggcaggcucguggacucagucgugaguuggagcaaagagauacugcggacacaggaaucugaguguguaugcaucaacggcaccuguacgguugugaugacugauggguccgcaucaggagaggccgacacaaagauucuguucaucgaagaggguaaaauaguccauaccagcacucucaguggcucugcucaacacguggaagagugcuccugcuauccucgcuacccaggggugagaugugucugcagggauaauuggaagggaagcaaccggccgauuguugacaucaacaucaaggaccacucgauugugucuuccuacguauguucaggcuuagugggugauacaccccgcaaaaaugacaguagcuccucuagccauugccuggauccuaacaaugaagaagggggacacggcgucaagggcugggccuuugacgaugggaacgacguguggaugggacgaaccaucucagagaaaaguagacuugguuaugagacguucaagguuauugagggcugguccaauccaaaaagcaaguugcagauaaacaggcaagugaucgucgaucgggggaaucguucuggauacucaggcauuuuuaguguggaagguaaaagcuguaucaaccgcugcuucuauguagagcugaucagagggaggaaggaagagaccgagguucuauggacauccaauucuauuguggucuucuguggcacuucgggaaccuacggcacagggagcuggcccgacggagcggauauaaaccucaugccuaucuga

SEQ ID NO: 138501 - RNA, 1407 nt, Artificial Sequence; identical to SEQ ID NO: 138499
  derived and/or modified sequence opt3 from neuraminidase__InfluenzaA__ACG80464

SEQ ID NO: 138502 - RNA, 1410 nt, Artificial Sequence
  derived and/or modified sequence opt3 from neuraminidase__InfluenzaA__ACG80473
auggaccccauccagaagauuauaaccaucggcagcgugucccugacaauuucuacuaucugcuucuuuaugcagauugccauccucauaacgaccgucacacuucacuucaaacaguacgaguuuaacucaccuccaaauaaccagaugaugcugugugaaccgacuaucauugagagaaauaucaccgaaauuguuuauuugacaaacaccacuaucgagaaggaaauaugccccaaauuagcugaguacaggaauuggaguaagccucagugugauauuacaggguucgcaccauuuagcaaagacaacuccauccggcugucugccggaggugauauuugggugacccgcgagcccuauguaucgugcgacccugauaaguguuaccaauucgcgcuaggccaggggacgacucucaauaacgugcauucaaaugacaccgcucgaggacguacaccauauagaacucugcuuaugaacgaacugggcguccccuuucacuuggguaccaaacaggugugcaucgccuggagcaguuccucuugucaugaugggaaggcauggcuccacguuugcaucacaggagacgauaagaaugccaccgcuagcuucauuuacgacggcaggcugguggauuccgucgugucauggaguaaagagauacugcggacgcaggaaagcgaguguguaugcaucaacggcacuuguacaguugugaugaccgacgggucugcauccggagaggccgauacuaagauucucuuuaucgaagaggguaaaauaguccauacaucaaccuuaagcggcagugcucaacacguggaagagugcucuugcuauccucgcuacccaggggugagaugugucugcagggacaauuggaagggauccaaccggccgauuguugacaucaauaucaaggaucacagcauugugucgucuuacguauguuccggccuggugggugacacgccccgcaaaaacgauucaaguagcuccucucauugccuugacccuaacaaugaagaagggggacacggcgucaagggcugggccuucgaugacgggaacgauguguggaugggacgaaccaucagcgagaaaucaagauuggguuaugagacauuuaagguuauugagggcuggaguaauccaaaauccaagcugcagauaaacaggcaagugaucgucgaccgggggaaucguagcggauacucuggcauuuucucaguggaagguaaaaguuguaucaaccgcugcuuuuauguagagcuaaucagagggaggaaggaagagacugagguucucuggaccagcaauuccauuguggucuucuguggcacaucuggaacuuacggcaccgggucguggcccgauggagcggacauaaaccugaugccuaucuga

SEQ ID NO: 138503 - RNA, 1410 nt, Artificial Sequence; identical to SEQ ID NO: 136728
  derived and/or modified sequence opt3 from neuraminidase__InfluenzaA__ACH69559

SEQ ID NO: 138504 - RNA, 1410 nt, Artificial Sequence
  derived and/or modified sequence opt3 from neuraminidase__InfluenzaA__ACH69570
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaauaacgauucaaguagcuccucucauugccuugacccuaauaacgaggaaggugggcacggaguuaagggcugggcuuucgaugacggcaaugauguguggauggggcgcaccauuagcgagaaauugcgaucaggauacgagacauuuaaggucaucgaagguuggaguaacccaaauuccaaacugcagauuaacagacaggugauaguagacaggggcaaucggagcggguauucuggaaucuucucaguugagggcaagaguuguauuaaccguugcuuuuacguggaacuaauccgcgguagaaaagaggaaacugagguccucuggaccagcaauuccaucguggucuucugugggacaucuggcacuuauggaaccggcucguggcccgauggggccgacauuaaccugaugccuauauga

SEQ ID NO: 138505 - RNA, 1410 nt, Artificial Sequence; identical to SEQ ID NO: 136728
  derived and/or modified sequence opt3 from neuraminidase__InfluenzaA__ACH69581

SEQ ID NO: 138506 - RNA, 1410 nt, Artificial Sequence
  derived and/or modified sequence opt3 from neuraminidase__InfluenzaA__ACH69592
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccccucugucagggagcgcucaacacguggaggaaugcaguuguuauccacgguacccgggaguccgcugcguuuguagagacaacuggaagggcucuaauaggcccaucguggauauaaacguaaaagacuacuccauugugagcucguaugucugcucuggucuugugggggacaccccucggaagaaugauuccucaaguagcucccauuguuuggacccaaacaaugaggaaggaggccacggcguuaaagggugggccuucgaugacggaaacgauguguggaugggucgcacgaucucugaaaagagccgaucaggcuacgagaccuuuaaagucaucgagggguggaguaagcccaauuccaaacugcagauuaacagacaggugaucguagacaggggaaaucggagcggcuauucugguauuuucucaguugaggggaagaguugcauaaaccaguguuuuuacguggaacuaauccguggccgcaagcaagagacagaaguccucuggacuagcaauuccauuguggucuucugcggaaccucuggcacauaugggacuggaucguggccugauggugcggaccugaaccuuaugccaaucuga

SEQ ID NO: 138507 - RNA, 1410 nt, Artificial Sequence
  derived and/or modified sequence opt3 from neuraminidase__InfluenzaA__ACH69603
augaaccccaaucagaagaucauuaccauaggcagcgugucccugacaaucgccacuauuugcuuccucaugcaaaucgucauucuuguuacgaccgugacacugcacuuuaaacaguacgaguguaacucuccuccaaauaaccagguaauguugugcgaaccgacuaucauagagagaaauaucaccgaaauuguguauuuaacaaacaccacuaucgagaaggaaauuugucccaaacuggcugaguacaggaauuggucaaagccucagugcaacaucacaggguucgcaccauuuaguaaagacaauagcauacggcuauccgccggaggugauauuugggucacccgcgagcccuaugugucuugugacccugauaagugcuaccaauucgcgcucggccaggggacgacucugaacaauggacauucgaacgacaccguucacgaucgaacaccauaucguacucuucugaugaaugaauugggcgugcccuuucaucucgguaccaagcaggucuguaucgcuuggucaagcaguuccugccacgacgggaaagccuggcugcauguguguguaacaggagaugacgagaacgcaaccgccucuuucauuuacaauggcagacugguugauagcaucggcuccuggucaaagaaaauccucaggacgcaggaaagugagugcguguguauuaacgggacuugcacagucgugaugaccgacggaagcgcuucugguaaggcagauacuaaaauauuauuuaucgaggaaggcaagauugugcacacauccccucugucagggagcgcccaacacgucgaggaaugcaguuguuauccacgguacccgggaguucgcugcguguguagagacaacuggaagggcucuaauaggcccaucguagauauaaacgugaaagacuacuccauugucagcucguaugugugcucuggucuuguuggggacaccccucggaagaaugauuccucaaguagcucccauuguuuggacccaaacaaugaggaaggaggccacggcgugaaagggugggcuuucgaugacggaaacgaugucuggaugggucgcacgaucucugaaaagagccgaucaggcuacgagaccuuuaaagugaucgagggguggaguaagcccaauuccaaacugcagauuaacagacagguaaucguugacaggggaaaucggagcggcuauucugguauuuucucaguggaggggaagaguugcauaaaccguuguuuuuacgucgaacuaauccgcggcagaaagcaggagacagaagugcucuggacuagcaauuccauugucguguucugcggaaccucuggcacauaugggacuggaucguggccugauggugccgaccugaaccuuaugccaaucuga

SEQ ID NO: 138508 - RNA, 1410 nt, Artificial Sequence
  derived and/or modified sequence opt3 from neuraminidase__InfluenzaA__ACH69614
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccccucugucagggagcgcucaacacguggaggaaugcaguuguuauccacgguacccgggaguccgcugcguuuguagagacaacuggaagggcucuaauaggcccaucguggauauaaacguaaaagacuacuccauugugagcucguaugucugcucuggucuugugggggacaccccucggaagaaugauuccucaaguagcucccauuguuuggacccaaacaaugaggaaggaggccacggcguuaaagggugggccuucgaugacggaaacgauguguggaugggucgcacgaucucugaaaagagccgaucaggcuacgagaccuuuaaagucaucgagggguggaguaagcccaauuccaaacugcagauuaacagacaggugaucguagacaggggaaaucggagcggcuauucugguauuuucucaguugaggggaagaguugcauaaaccguuguuuuuacguggaacuaauccgcggcagaaagcaggagacagaaguccucuggacuagcaauuccauuguggucuucugcggaaccucuggcacauaugggacuggaucguggccugauggugcggaccugaaccuuaugccaaucuga

SEQ ID NO: 138509 - RNA, 1413 nt, Artificial Sequence
  derived and/or modified sequence opt3 from neuraminidase__InfluenzaA__ACI22525
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgagaauagcaccugggugaacaauacauaugucaacaucaauaacacuaauguuguggcagaaaaagacaagaccucgguaacacuugccgggaacucaagccuguguaguauuuccggaugggcgaucuacaccaaagauaauucuaucaggauuggcagcaagggugacguguucgucauacgggagccuuuuaucuccugcucacacuuggaaugucgcacuuucuuuuuaacacaaggggcucugcuaaacgauaaacauaguaauggaaccgugaaggaccgaagcccauaucgugcccucaugucuugcccgcugggcgaggcacccuccccuuacaacucaaaguucgaaagcguugccuggagugcuucugcaugucacgauggcaugggguggcuuacgauuggaaucuccgguccagacaacggcgccguggcuguccugaaauauaaugggauaauuacugagaccaucaagagcuggaaaaagagaaucuugaggacacaggagucggaaugcguguguaugaacggaucuugcuuuacuauuaugaccgauggccccuccaauggugccgcgucauacaaaaucuucaagauugagaaggggaaaguaacaaagaguauagaacucaacgcaccuaauuuucauuaugaggaguguagcugcuacccagacaccggaacgguuaugugugugugccgggauaacuggcacggcuccaaucgccccugggucucuuucaaccagaaucuggacuaccagaucggcuauauuugcagcgggguguuuggagauaacccuagaccaaaagacggugaaggcucauguaauccggugacugucgauggggccgacggaguuaagggcuucaguuacaaauaugguaacgggguguggaucggcaggacaaaguccaaucggcugcgcaaaggauuugagaugaucugggaccccaacggcuggaccaauacugauagcgacuucucuguaaagcaagauguggucgcuauuacagacuggucaggguacaguggaucuuuugugcagcacccugaacucaccgguuuagauugcauacgaccauguuucuggguugagcuggugagaggccuucccagggaaaacacgaccaucuggacauccgggucuucgauuagcuucugcggagucaacuccgacacugccaauuggucauggccugauggcgcagaguugccauuuaccaucgacaaguga

SEQ ID NO: 138510 - RNA, 1413 nt, Artificial Sequence; identical to SEQ ID NO: 138509
  derived and/or modified sequence opt3 from neuraminidase__InfluenzaA__ACI22526

SEQ ID NO: 138511 - RNA, 1413 nt, Artificial Sequence; identical to SEQ ID NO: 138509
  derived and/or modified sequence opt3 from neuraminidase__InfluenzaA__ACI22527

SEQ ID NO: 138512 - RNA, 1413 nt, Artificial Sequence; identical to SEQ ID NO: 138509
  derived and/or modified sequence opt3 from neuraminidase__InfluenzaA__ACI22528

SEQ ID NO: 138513 - RNA, 1413 nt, Artificial Sequence; identical to SEQ ID NO: 138509
  derived and/or modified sequence opt3 from neuraminidase__InfluenzaA__ACI22529

SEQ ID NO: 138514 - RNA, 1413 nt, Artificial Sequence; identical to SEQ ID NO: 138509
  derived and/or modified sequence opt3 from neuraminidase__InfluenzaA__ACI22530

SEQ ID NO: 138515 - RNA, 1413 nt, Artificial Sequence
  derived and/or modified sequence opt3 from neuraminidase__InfluenzaA__ACI22532
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaacaauacauaugucaacaucaauaacacuaauguuguggcagggaaagacaagaccucgguaacacuugccggaaacucaagccuguguaguauuuccggcugggcgaucuacaccaaagauaauucuaucaggauugguagcaagggggacguguucgucauacgggagccuuuuaucuccugcucacacuuggagugucgcacuuucuuuuuaacacaaggagcucugcuaaacgauaaacauaguaauggcaccgugaaggaccgaagcccauaucgugcccucaugucuugcccgcugggcgaagcacccuccccuuacaacucaaaguucgagagcguugccuggagugcuucugcaugucacgaugggaugggauggcuuacgauugguaucuccggcccagacaacggggccguggcuguccugaaauauaauggaauaauuacugaaaccaucaagagcuggaaaaagagaaucuugaggacacaggagucggagugcguguguaugaacggcucuugcuuuacuauuaugaccgauggucccuccaauggggccgcgucauacaaaaucuucaagauugaaaagggaaaaguaacaaagaguauagagcucaacgcaccuaauuuucauuaugaagaguguagcugcuacccagacaccggcacgguuaugugugugugccgggauaacuggcacggcuccaaucgccccugggucucuuucaaccagaaucuggacuaccagaucggguauauuugcagcggaguguuuggugauaacccuagaccaaaagacggcgaggggucauguaauccggugacugucgauggagccgacggcguuaaggguuucaguuacaaauaugggaacggcguguggaucggaaggacaaaguccaaucggcugcgcaaaggcuuugaaaugaucugggaccccaacggguggaccaauacugauagcgacuucucuguaaagcaagauguggucgcuauuacagacuggucaggauacagugguagcuuugugcagcacccugagcucaccggcuuagauugcauacgaccauguuucuggguugaacuggugagagggcuucccagggagaacacgaccaucuggacauccggaucuucgauuagcuucugcggcgucaacuccgacacugccaauuggucauggccugauggugcagaauugccauuuaccaucgacaaguga

SEQ ID NO: 138516 - RNA, 1413 nt, Artificial Sequence; identical to SEQ ID NO: 138515
  derived and/or modified sequence opt3 from neuraminidase__InfluenzaA__ACI22533

SEQ ID NO: 138517 - RNA, 1413 nt, Artificial Sequence; identical to SEQ ID NO: 138509
  derived and/or modified sequence opt3 from neuraminidase__InfluenzaA__ACI22534

SEQ ID NO: 138518 - RNA, 1410 nt, Artificial Sequence
  derived and/or modified sequence opt3 from neuraminidase__InfluenzaA__ACI25727
augaaccccaaucagaagaucauuaccauaggcagcgugucccugacaaucgccacugucugcuuccucaugcaaauugcuauccuuguuacgaccgugacacugcacuuuaaacagcaugaguguaacucuccugcaucaaaucagguaaugccaugcgaaccgauuaucauagagagaaacaucacugaaauuguguacuugaauaacaccacaaucgagaaggaaauuugucccaaagucguggaguauaggaauuggaguaagccucagugccaaaucaccggguucgccccauuuagcaaagacaacuccauacgguuaucugcgggaggugauauuuggguuacucgcgagcccuacgugucgugugacccuggcaagugcuaucaguucgcucuggggcagggaacaacccuagauaauaagcacucaaacgacacgauccaugaucguauuccacaccgaacucuccugaugaaugaacuuggcguccccuuucaucuggguaccagacagguguguaucgccuggagcaguuccucuugccacgacgggaaagcaugguugcacguauguaucacaggagaugacaagaacgccacugcuagcuucauuuacgauggcaggcucguugacuccauaggcucauggagucaaaauauccugcggacccaggagagcgaaugcguguguauuaacgggacaugcaccgucgugaugacggauggaucugcauccggucgcgccgacacuagaauccuguuuauaaaagagggcaagauugugcauaucucaccucucagcgggagugcucagcacgucgaggaaugcucuuguuauccaagguacccgggaguucggugcaucugucgcgauaauuggaaaggcuccaaccgacccgugguagacauuaacauggaggacuauagcaucgauucgucuuacgugugcuccgguuuagucggggacacaccuagaaaugaugacaggucaaguaacagcaauugucggaacccaaauaacgaacguggaaaucagggcgugaagggcugggccuucgauaacggggacgauguuuggaugggacgcaccauuuccaaggaccugagaucugguuacgagacuuuuaaagugauaggcggguggagcacacccaauucaaagagucaaaucaacaggcaggucauuguggauuccgacaaucggagcggauauucuggcaucuucucaguagaagguaaaaguugcaucaaccgauguuuuuacguugagcuuauucgcgggagaaagcaggagaccagggugugguggacgagcaauuccauagucguguucugcggcaccucuggaacauauggcacugggucguggccugauggagcgaacaucaauuuuaugccaauuuga

SEQ ID NO: 138519 - RNA, 1410 nt, Artificial Sequence
  derived and/or modified sequence opt3 from neuraminidase__InfluenzaA__ACI25749
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugaucauggcaagugcuaccaguucgcucuggggcagggaacaacccuagacaacaagcacucaaaugauacgauccaugaccguauuccucaccgaacucuccugaugaacgaacuuggcgucccauuucaucuggguaccagacagguguguaucgccuggagcaguuccucuugccacgaugggaaagcaugguugcacguauguaucacaggagacgauaagaaugccacugcuagcuucauuuaugacggcaggcucguugauuccauaggcucauggagucaaaacauccugcggacccaggagagcgaaugcguguguauuaaugggacaugcaccgucgugaugacggacggaucugcauccggucgcgccgauacuagaauccuguuuauagaggagggcaaaauugugcauaucucaccccucagcgggagugcucagcacgucgaagagugcucuuguuacccuagguauccaggaguucggugcaucugucgcgacaacuggaagggcuccaaucgaccggugguagacauuaacauggaagauuacagcaucgacucgucuuacgugugcuccgguuuagucggggauacacccagaaacgacgauaggucaaguaauagcaacugucggaauccuaacaaugagcguggaaaccagggcgugaaaggcugggccuucgacaauggggaugacguuuggaugggacgcaccauuuccaaggaucugagaucugguuaugaaacuuuuaaggugauaggcggguggagcacaccaaacucaaaaagucaaaucaauaggcaggucauuguggacuccgauaaccggagcggauacucuggcaucuucucaguagaggguaagaguugcaucaaucgauguuuuuauguugagcuuauucgcgggagaaaacaggaaaccagggugugguggacgagcaacuccauagucguguucugcggcaccucuggaacauacggcacugggucguggcccgacggagcgaauaucaacuuuaugcauauuuga

SEQ ID NO: 138520 - RNA, 1410 nt, Artificial Sequence; identical to SEQ ID NO: 138519
  derived and/or modified sequence opt3 from neuraminidase__InfluenzaA__ACI25760

SEQ ID NO: 138521 - RNA, 1410 nt, Artificial Sequence; identical to SEQ ID NO: 138519
  derived and/or modified sequence opt3 from neuraminidase__InfluenzaA__ACI25771

SEQ ID NO: 138522 - RNA, 1410 nt, Artificial Sequence; identical to SEQ ID NO: 136111
  derived and/or modified sequence opt3 from neuraminidase__InfluenzaA__ACI25782

SEQ ID NO: 138523 - RNA, 1410 nt, Artificial Sequence
  derived and/or modified sequence opt3 from neuraminidase__InfluenzaA__ACI25793
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucuguuggaggugacauuugggugacucgcgagcccuaugucucgugugaucauggcaagugcuaccaguucgcgcuggggcagggaacaacccuagacaacaagcacucaaaugauacgauccaugacaggauuccucaccguacucuccugaugaacgaacuuggcgugccauuucaucuggguaccagacagguauguaucgcuuggagcaguuccucuugccacgaugggaaagccugguugcacguuuguaucacaggagacgauaagaaugcaacugccagcuucauuuaugacggcaggcucguggauuccauaggcucauggagucaaaacauccugcggacccaggagagcgaaugcgucuguauuaaugggacaugcaccguggugaugacggacggaucugcuuccggucgcgcagauacuagaauccuguuuauagaggagggcaaaauuguccauaucucaccccucagcgggagugcccagcacguugaagagugcucuuguuacccuagguauccaggagugcggugcaucugucgcgacaacuggaagggcuccaaucgaccgguaguggacauuaacauggaagauuacagcaucgacucgucuuacgucugcuccgguuuagugggggauacacccagaaacgacgauaggucaaguaauagcaacugucggaauccuaacaaugagcguggaaaccagggcguuaaaggcugggcuuucgacaauggggaugacguguggaugggacgcaccauuuccaaggaucugagaucugguuaugaaacuuuuaaggucauaggcggguggagcacaccaaacucaaaaagucaaaucaaucgacaggugauuguagacuccgauaaccggagcggauacucuggcaucuucucaguugaggguaagaguugcaucaaucgauguuuuuauguggagcuuauucgcgggagaaaacaggaaaccagggucugguggacgagcaacuccauaguggucuucugcggcaccucuggaacauacggcacugggucguggcccgacggagccaauaucaacuuuaugccuauuuga

SEQ ID NO: 138524 - RNA, 1410 nt, Artificial Sequence
  derived and/or modified sequence opt3 from neuraminidase__InfluenzaA__ACI25804
augaaccccaaucagaagaucauuaccauaggcagcgugucccugacaaucgccacugucugcuuccucaugcaaauugcuauccuuguuacgaccgugacacugcacuuuaaacaguacgagugugacucuccugcaucaaaccagguaaugccaugcgaaccgauuaucauagagagaaauaucacugaaauuguguauuugaacaauaccacaaucgagaaggaaauuugucccaaagucguggaguacaggaacuggaguaagccucagugccaaaucaccggguucgccccauuuagcaaagauaauuccauacgguuaucugcgggaggugacauuuggguuacucgcgagcccuaugugucgugugaucauggcaagugcuaccaguucgcucuggggcagggaacaacccuagacaacaagcacucaaaugauacgauccaugaccguauuccucaccgaacucuccugaugaacgaacuuggcgucccauuucaucuggguaccagacagguguguaucgccuggagcaguuccucuugccacgaugggaaagcaugguugcacguauguaucacaggagacgauaagaaugccacugcuagcuucauuuaugacggcaggcucguugauuccauaggcucauggagucaaaacauccugcggacccaggagagcgaaugcguguguauuaaugggacaugcaccgucgugaugacggacggaucugcauccggucgcgccgauacuagaauccuguuuauagaggagggcaaaauugugcauaucucaccccucagcgggagugcucagcacgucgaagagugcucuuguuacccuagguauccaggaguucggugcaucugucgcgacaacuggaagggcuccaaucgaccggugguagacauuaacauggaagauuacagcaucgacucgucuuacgugugcuccgguuuagucggggauacacccagaaacgacgauaggucaaguaauagcaacugucggaauccuaacaaugagcguggaaaccagggcgugaaaggcugggccuucgacaauggggaugacguuuggaugggacgcaccauuuccaaggaucugagaucugguuaugaaacuuuuaaggugauaggcggguggagcacaccaaacucaaaaagucaaaucaauaggcaggucauuguggacuccgaucaucggagcggauacucuggcaucuucucaguagaggguaagaguugcaucaaccgauguuuuuauguugagcuuauucgcgggagaaaacaggaaaccagggugugguggacgagcaauuccauagucguguucugcggcaccucuggaacauacggcacugggucguggcccgacggagcgaacaucaauuuuaugccuauuuga

SEQ ID NO: 138525 - RNA, 1410 nt, Artificial Sequence; identical to SEQ ID NO: 138483
  derived and/or modified sequence opt3 from neuraminidase__InfluenzaA__ACI26277

SEQ ID NO: 138526 - RNA, 1410 nt, Artificial Sequence; identical to SEQ ID NO: 136343
  derived and/or modified sequence opt3 from neuraminidase__InfluenzaA__ACI26299

SEQ ID NO: 138527 - RNA, 1410 nt, Artificial Sequence
  derived and/or modified sequence opt3 from neuraminidase__InfluenzaA__ACI26321
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaagggguccaaccggccgauuguggacaucaauaucaaagaccacagcacgguaucgucuuacguguguuccggacuggucggcgauacaccccgcaagaacgacucaaguagcuccucucauugccuugauccuaauaacgaggaaggugggcacggagugaaaggcugggcuuucgacgauggcaaugacguuuggauggggcgaaccauuagcgagaagucaagauugggauaugagacuuuuaaagugaucgaagguuggaguaacccaaaguccaaacugcagauuaauaggcaggucauaguggaucggggcaaccguagcggguacucuggaaucuucucaguagagggcaagaguuguauuaaucgcugcuuuuauguugaacuaaucagagguaggaaggaggaaaccgaggugcucuggacaagcaacuccaucgucguguucugugggacuucuggcaccuacggaacaggcucguggcccgacggggccgauauuaaucugaugccuauauga

SEQ ID NO: 138528 - RNA, 1410 nt, Artificial Sequence
  derived and/or modified sequence opt3 from neuraminidase__InfluenzaA__ACI26354
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaauggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaacuggaagggguccaaccggccgauaguagacauuaauaucaaagaccacagcaucgugucgucuuacgucuguuccggacuggugggcgauacgccccgcaagaacgacucaaguagcuccucucauugccuugauccuaauaacgaggaaggugggcacggaguuaaaggcugggcuuucgacgauggcaaugacguguggauggggcgaaccauuagcgagaagucaagauugggauaugagacauuuaaagucaucgaagguuggaguaacccaaaguccaaacugcagauuaauaggcaagugauaguagaucggggcaaccguagcggguacucuggaaucuucucaguugagggcaagaguuguauuaaucgcugcuuuuauguggaacuaaucagagguaggaaggaggaaacugagguccucuggaccagcaacuccaucguggucuucugugggacaucuggcacuuacggaaccggcucguggcccgacggggccgauauuaaucugaugccuauauga

SEQ ID NO: 138529 - RNA, 1410 nt, Artificial Sequence
  derived and/or modified sequence opt3 from neuraminidase__InfluenzaA__ACI26365
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaauggcacuuguacagucgugaugaccgauggcucugcuuccgggaaggcagacacuaaaauccucuuuauugaggaaggaaagaucgugcauacaucaaccuuaacggguagcgcccaacacgucgaggaaugcaguugcuauccucgcuacccaggcguuagaugugugugcagggauaacuggaaggggucuaaccggccgauaguagacauuaauaucaaagaccacuccaucgugagcucguacgucuguucuggacuggugggcgauacaccccgcaagaacgacuccucaaguagcucccauugccuugauccuaauaacgaggaagguguucacggggugaaaggaugggcuuucgacgauggcaaugacgucuggaugggccgaaccauuucugaaaagagcagauugggguaugagacuuuuaaagugaucgagggauggucaaacccaaagaguaaacugcagauuaauaggcagguaauaguugaucgggguaaccguuccggcuacagcgggaucuucucuguggagggaaagucauguauuaaucgcugcuuuuaugucgaacuaaucagaggcaggaaggaggaaaccgaggugcucuggacaaguaacagcaucgucguguucugugguacuuccgggaccuacggcacaggaucuuggcccgacggcgccgauauuaaucugaugccuauauga

SEQ ID NO: 138530 - RNA, 1410 nt, Artificial Sequence; identical to SEQ ID NO: 138528
  derived and/or modified sequence opt3 from neuraminidase__InfluenzaA__ACI26376

SEQ ID NO: 138531 - RNA, 1410 nt, Artificial Sequence; identical to SEQ ID NO: 138420
  derived and/or modified sequence opt3 from neuraminidase__InfluenzaA__ACI26387

SEQ ID NO: 138532 - RNA, 1410 nt, Artificial Sequence; identical to SEQ ID NO: 138432
  derived and/or modified sequence opt3 from neuraminidase__InfluenzaA__ACI26420

SEQ ID NO: 138533 - RNA, 1410 nt, Artificial Sequence; identical to SEQ ID NO: 136343
  derived and/or modified sequence opt3 from neuraminidase__InfluenzaA__ACI26431

SEQ ID NO: 138534 - RNA, 1413 nt, Artificial Sequence
  derived and/or modified sequence opt3 from neuraminidase__InfluenzaA__ACI26442
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggaguguaaaacuuucuuuuuaacacaaggagcucugcuaaaugauaagcacaguaacggcaccgugaaggaccgcagcccauaucgagcccucaugucuugcccgcugggcgaagcacccuccccuuacaauucaaaauucgagagcguugccuggagugcuucugcaugucaugaugggaugggauggcuuacgauugguaucuccggcccagacaacggggccguggcuguccugaaguauaacggaauaauuacuggcaccaucaaaagcuggaagaaacagaucuugcguacacaggaaucggagugcguguguaugaaugguucuugcuuuacuauuaugaccgaugggcccuccaacggagccgcgucauacaagaucuucaagauugagaaaggcaagguaacaaaaaguauagaacucaaugcaccuaacuuucacuaugaggaauguagcugcuacccagacaccggcacgguuaugugugugugcagagauaauuggcacggguccaacaggcccugggucucuuucaaucagaaccuggacuaccaaaucggauauauuugcagcgguguguuuggcgauaauccucggccaaaggaccgcgaggggucauguaacccggugacuaucgauggagccgacggcgucaaagguuucaguuacaaguaugggaauggcguuuggaucggaagaacaaaauccaacaggcugcggaagggcuuugagaugauuugggaccccaauggguggaccaacacugauagcgacuucucugugaagcaggauguaguggcuauaacagacuggucaggauacagugguagcuuuguccagcauccugaacucaccggcuuagauugcauccgcccauguuucuggguggagcugguucgagggcuucccagagaaaauacgaccauuuggacauccggaucuucgaucagcuucugcggcgugaacuccgacacugccaacuggucauggccugauggugcagaguugccauuuaccauugacaaauga

SEQ ID NO: 138535 - RNA, 1413 nt, Artificial Sequence; identical to SEQ ID NO: 138534
  derived and/or modified sequence opt3 from neuraminidase__InfluenzaA__ACI26453

SEQ ID NO: 138536 - RNA, 1410 nt, Artificial Sequence
  derived and/or modified sequence opt3 from neuraminidase__InfluenzaA__ACI26464
augaaccccaaucagaagaucauuaccauaggcagcgugucccugacaaucucuacuauuugcuucuuuaugcaaaucgccauucucaucgcuacggucacccuucacuucaaacaguacgaguuuaacucaccuccaaauaaccagguuaugcugugugaaccgacaauaaucgagagaaauauuacugaaaucguguauuugaccaacacaaccauugagaaggaaaucugccccaaauuagcagaguacaggaauuggaguaagccucagugugacauaacuggguucgccccauuuagcaaagauaacuccauucggcugucugcgggaggugacaucuggguaacacgcgagcccuaugugucgugcgauccugacaaguguuaccaauucgcucuaggccaggggaccacgcucaauaacguccauucaaaugauacugugcgagaccguaccccauauagaacacugcuuaugaacgaacugggaguucccuuucacuugggcacuaaacaggugugcauugccuggagcaguuccucuugucaugaugguaaggcauggcuccacgucugcaucaccggggacgauaagaaugccacagcuagcuucaucuacaacggaaggcugguggacuccauuguaucauggaguaaagagauacugcggacccaggaaagcgaguguguuugcaucaauggcacguguacuguggucaugacagauggcucugcauccgggaaggccgacaccaaaauucucuuuaucgaggaaggaaagauagugcauacuucaacauuaagcgguagugcucaacacguggaggaaugcucuugcuauccucgcuacccaggcgucagauguguuugcagggauaacuggaagggguccaaccggccgauuguggacaucaauaucaaagaccacagcaccguaucgucuuacguguguuccggacuggucggcgauacgccccgcaagaacgacucaaguagcuccucucauugccuugauccuaauaacgaggaaggugggcacggagugaaaggcugggccuucgacgauggcaaugacguuuggauggggcgaaccauuagcgagaagucaagauugggauaugagacauuuaaagugaucgaagguuggaguaacccaaaguccaaacugcagauuaauaggcaggucauaguggaucggggcaaccguagcggguacucuggaaucuucucaguagagggcaagaguuguauuaaucgcugcuuuuauguugaacuaaucagagguaggaaggaggaaacugaggugcucuggaccagcaacuccaucgucguguucugugggacaucuggcacuuacggaaccggcucguggcccgacggggcggauauuaaucugaugccuauauga

SEQ ID NO: 138537 - RNA, 1410 nt, Artificial Sequence; identical to SEQ ID NO: 138527
  derived and/or modified sequence opt3 from neuraminidase__InfluenzaA__ACI26475

SEQ ID NO: 138538 - RNA, 1410 nt, Artificial Sequence; identical to SEQ ID NO: 138528
  derived and/or modified sequence opt3 from neuraminidase__InfluenzaA__ACI26486

SEQ ID NO: 138539 - RNA, 1410 nt, Artificial Sequence; identical to SEQ ID NO: 138528
  derived and/or modified sequence opt3 from neuraminidase__InfluenzaA__ACI26497

SEQ ID NO: 138540 - RNA, 1410 nt, Artificial Sequence; identical to SEQ ID NO: 138528
  derived and/or modified sequence opt3 from neuraminidase__InfluenzaA__ACI26508

SEQ ID NO: 138541 - RNA, 1410 nt, Artificial Sequence
  derived and/or modified sequence opt3 from neuraminidase__InfluenzaA__ACI26519
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaauggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaacuggaagggguccaaccggccgauaguagacauuaauaucaaagaccacagcaucgugucgucuuacgucuguuccggacuggugggcgauacgccccgcaagaacgacucaaguagcuccucucauugccuugauccuaauaacgaggaaggugggcacggaguuaaaggcugggcuuucgacgauggcaaugacguguggauggggcgaaccauuagcgagaagucaagauugggauaugagacauuuaaagucaucgaagguuggaguaacccaaaguccaaacugcagauuaauaggcaagugauaguagaucggggcaaccguagcggguacucuggaaucuucucaguugagggcaagaguuguauuaaucgcugcuuuuauguggaacuaaucagagguaggaaggaggaaacugagguccucuggaccagcaacuccaucguggucuucugugggacaucuggcacuuacggaaccggcucguggcccgacggggccaauauuaaccugaugccuauauga

SEQ ID NO: 138542 - RNA, 1410 nt, Artificial Sequence; identical to SEQ ID NO: 138528
  derived and/or modified sequence opt3 from neuraminidase__InfluenzaA__ACI26530

SEQ ID NO: 138543 - RNA, 1410 nt, Artificial Sequence; identical to SEQ ID NO: 138528
  derived and/or modified sequence opt3 from neuraminidase__InfluenzaA__ACI26541

SEQ ID NO: 138544 - RNA, 1410 nt, Artificial Sequence
  derived and/or modified sequence opt3 from neuraminidase__InfluenzaA__ACI26552
augaaccccaaucagaagaucauuaccauaggcagcgugucccugacaaucgccacuaugugcuuccucaugcaaauugcuauccuugucacgaccguuacacugcacuuuaaacaguacgaguguucuucaccuccaaacaaucaggugaugccgugcgaacccacuauuaucgagagaaacauaaccgaaaucguauauuugacaaauaccacuauugagaaggaaaucuguccuaaauuaguggaguacaggaacuggaguaagccacagugcaaaauuacaggguucgcacccuuuagcaaggacaauuccauccggcugucugccggaggugauauaugggucacccgcgagccuuaugugucgugugacccaggcaagugcuaccaauucgcgcuagggcagggaacgacucucaacaaucgacauucaaacgauaccguucacgaccguacacccuauagaacucugcuuaugaaugaacugggcgugccuuuucauuuggguaccaaacaggucuguauugcuuggagcaguuccucuugccacgaugggaaggccuggcuccauguguguguaacaggacacgacaaaaacgcaaccgccagcuucaucuacgauggcaggcugguugacuccauuggcucauggaguaagaauauccugcggacgcaggagagcgaaugcguguguaucaacgggacuugcacagucgugaugaccgauggaucugcuuccgagcgcgcagacacuaaaauucucuuuauagaggaagguaagaucgugcacauuucaccauuaagcggcagugcccaacaugucgaggaaugcucuuguuauccgagauaccccgggguuaggugcgugugucgggauaauuggaagggauccaaccgcccuaucguagacauaaacgugaaagauuacagcauugucucgucuuaugugugcuccggccugguuggugacacaccacgaaagaaugacagaucaaguagcuccuacuguaggaaccccaauaacgagaaagggucucacggagugaagggcugggcuuucgaugacggcaaugaugucuggauggggcggaccaucagcgaggaacuucguucaggauaugagacguuuaaagugaucgguggcuggaguaccccuaacuccaaguugcagauuaaucgccagguaaucguugacagcgggaacagaucuggauacucaggcauuuucaguguggaagguaaaagcugcauaaauagguguuuuuaugucgagcugauccgggggcgagaacaggagacacgcgugugguggacuuccaacucuauugucguguucugcggcaccucgggaacauacggcacugggagcuggccagauggagccgacaucaaucuaaugcccaucuga

SEQ ID NO: 138545 - RNA, 1410 nt, Artificial Sequence
  derived and/or modified sequence opt3 from neuraminidase__InfluenzaA__ACI26574
augaaccccaaucagaagaucauuaccauaggcagcgugucccugacacucgccacuaucugcuuccuuaugcaaauugcuauccuggucacgaccguuacauugcacuuuaaacaguacgaguguucuucaccuccaaacaaucaggugaugccgugcgaacccacuauuaucgagagaaacauaaccgaaaucguauauuuaacaaauauuaccaucgagaaggaaauuuguccuaaacugguggaguacaggaacuggaguaagccacagugcaaaaucacuggguucgcacccuuuagcaaggacaauuccauacggcuaucugccggaggugauauuugggucacacgcgagccuuaugugucgugugacccaucaaagugcuaccaauucgcgcucggccaggggaccacgcugaacaaucgacauagcaacgauacuguucacgaccguacccccuauagaacacuucugaugaaugaauugggagugccuuuucaucucggcacuaggcaggucuguauggcuuggaguuccucuagcugccacgaugguaaagccuggcugcauguguguguaaccgggcacgacgagaacgcaacagccuccuucaucuacgauggacggcugguugacucaauuggcaguuggagcaagaauauccuccgcacccaggaaucugagugcguguguaucaacggcacgugcacugucgugaugacagauggguccgcuucagagagagcagacaccaaaauuuuauuuauagaagagggaaagaucgugcacauuagcccacugagugguucugcccaacaugucgaagagugcuccuguuauccgagguaccccggcguucggugcgugugucgcgauaauuggaaagggagcaaccgaccuaucguagacauaaacgugaaggauuacucgauugucucuuccuaugugugcucaggacuuguuggcgacacuccaagaaagaaugacaggaguagcuccucuuacugucggaaccccaauaacgaaaaagguagccacggggugaagggaugggcuuucgaugacggcaaugaugucuggaugggccguacaaucggggaggaguugcgcucaggauaugaaaccuuuaaagugaucgguggcuggaguacgccuaacuccaagcugcagauuaauagacagguaaucguugacagcgggaacaggucuggauacucaggcauuuucaguguggaggguaaaagcugcauaaaucgguguuuuuaugucgaacuaauccgagggcgcaagcaggagaccagagugugguggacauccaacucuauugucguguucugcggcacuucgggaaccuacggcacagggagcuggccagauggagccgacaucaaucucaugcccaucuga

SEQ ID NO: 138546 - RNA, 1410 nt, Artificial Sequence
  derived and/or modified sequence opt3 from neuraminidase__InfluenzaA__ACI26585
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugaugccgugcgaacccacuaucauagagagaaauaucaccgaaauuguauacuugacaaacaccacuaucgagaaggaaauuuguccuaaauuaguggaguauaggaauuggucaaagccacagugcaaaaucacaggguucgcacccuuuaguaaggacaacagcauacggcuguccgccggaggugauauuugggucacccgcgagccuuacgugucuugugacccaggcaagugcuaucaauucgcgcuagggcagggaacgacucucaauaaccgacacucgaaugauaccguucaugaccguacacccuacagaacucugcuuaugaacgaacugggcgugccuuuucacuuggguaccaaacaggucuguaucgcuuggucaagcaguuccugccaugaugggaaggccuggcuccacguguguguaacaggacacgacgagaaugcaaccgccucuuucauuuaugauggcaggcugguugacagcaucguguccuggaguaaaaacguccugcggacgcaggaaucagagugcguguguaucaauggcacuugcacaguggucaugaccgaugggagcgcuucugagcgcgcagacacuaagauucucuuuauagaagagggaaaaaucguucauauuuccccauuaucagguagcgcccaacacguggaagagugcaguuguuacccgagauaucccggcguaaggugcgugugucgggauaacuggaaggggucuaaccgcccuaucgucgacauaaaugugaaggauuacuccauuguuagcucguacgugugcucuggacuggucggcgacacaccacgaaagaacgacuccucaaguagcuccuauuguagaaaucccaacaaugaaaaagguucucauggggugaaaggaugggcuuucgaugacggcaacgauguauggaugggcaggaccaucggggaggagcuucggagcggauacgaaacguuuaagguuaucgguggcuggucaaccccuaauaguaaauugcagacaaaccgucaggugauugucgaccgcgggaauagauccggauauagcggcaucuucucuguggaggguaagucaugcauuaacagguguuuuuacgucgaacugauacgggggcgaaaacaggagacuaaggugugguggaccaguaauagcaucguuguguucugcggcacauccggaacuuauggcaccgggucuuggccagauggagccgacauuaaccuaaugcccaucuga

SEQ ID NO: 138547 - RNA, 1413 nt, Artificial Sequence
  derived and/or modified sequence opt3 from neuraminidase__InfluenzaA__ACI32764
augaaccccaaucagaagaucauuaccauaggcagcaucuccauggccauugggaucauuucucugaugcuccaaaucggaaacauaaucucaauuugggcuagucacagcauccagacagguucccagaaucauacuggcauuugcaaccagagaaucauaacguacgaaaauucuaccugggugaaccacacauaugucaauauuaacaauacuaacguuguggcagggaaagacaagaccucgguaacacuugccggaaauucaagccuguguaguaucuccggcugggcgauuuacaccaaagauaacucuaucaggaucgguagcaagggggacguguucgucauucgggagccuuuuauauccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgaucgguauuuccggcccagacaacggggccguggcuguccugaaauauaacggaaucauaacugaaaccauuaagagcuggaaaaagagaaucuugaggacacaggagucggagugcguguguguaaauggcucuugcuuuacuaucaugaccgauggucccuccaacggggccgcgucauacaaaauuuucaagaucgaaaagggaaaaguuacaaagaguauugagcucaaugcaccuaacuuucacuaugaagaguguagcugcuacccagacaccggcacggugaugugugucugccgggauaauuggcacggcuccaaccgccccugggugucuuucaaucagaaccuggacuaccagauaggguauaucugcagcggaguguuuggugauaauccuagaccaaaagacggcaaggggucauguaacccggucacuguugauggagccgacggcgugaaagguuucaguuacaaguaugggaauggcguauggauuggaaggacaaaauccaaccggcugcgcaagggcuuugagaugaucugggaccccaauggguggaccgauacugacagcgauuucucugugaagcaagacgucguggcuaucacagauuggucaggauacagugguagcuuuguucagcauccugaacucaccggcuuagacugcauucgaccauguuucuggguggagcuggucagagggcuucccagggaaaacacgaccauauggacauccggaucuucgaucagcuucugcggcguggauuccgacacugccaauuggucauggccugauggugcagaguugccauuuaccauugacaaauga

SEQ ID NO: 138548 - RNA, 1413 nt, Artificial Sequence
  derived and/or modified sequence opt3 from neuraminidase__InfluenzaA__ACI32765
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgagaauaacaccugggugaaucacacauaugucaacaucaauaacacuaauguuguggcaaggaaagacaagaccucuguaacacuugccgggaacucgucacuguguagcauuaguggaugggcgaucuacaccaaagauaauuccauccggauuggcucuaagggugacguguucgucauacgcgaaccuuuuaucagcugcucccauuuggagugucgaacuuucuuuaugacacaaggggcuuuacugaacgauaaacacucaaauggaaccgugaaggaccguaguccauauagagcccuaaugagcugcccgcucggcgaagcacccucuccuuacaacuccaaguucgagucaguugccuggagcgcuagugcaugucaugauggcaugggguggcugacgauuggaaucucugguccagacaacggcgccguggcuguccuuaaauauaaugggauaauuacugaaaccaucaaguccuggaaaaagaggauccugcggacacaggagagcgagugcguguguguaaacggaucgugcuuuacuauuaugaccgauggccccucuaauggugccgcguccuacaaaaucuucaagauugaaaaggggaaaguuacaaagucaguggaguugaacgcaccuaauuuucacuaugaagaguguaguugcuacccagacaccggaacggucaugugugugugccgcgauaacuggcacggcagcaauagacccuggguguccuucaaccagaaucucgacuaccagauaggcuauaucugcucuggggucuuuggagauaacccuaggccaaaagacgguaagggcagcuguaauccgguuacuguggauggggccgacggaguaaaaggcuucucauacaaguaugguaacgggguguggauuggccggacaaaaaguaaucgccugcgaaagggauuugagaugaucugggaccccaacggcuggaccgauacugacuccgauuucagcgucaagcaagacgugguugcuaucacagauuggucuggguacucaggaaguuuugugcagcauccugaacugaccggucucgacugcauuagaccauguuucugggucgaguuagugaggggccugccccgggaaaauacgaccauauggacaagcggguccucuaucucguucugcggaguagauagcgacacugccaacugguccuggccugauggcgcagagcuuccauuuaccauugacaaauga

SEQ ID NO: 138549 - RNA, 1413 nt, Artificial Sequence; identical to SEQ ID NO: 136402
  derived and/or modified sequence opt3 from neuraminidase__InfluenzaA__ACI32766

SEQ ID NO: 138550 - RNA, 1413 nt, Artificial Sequence
  derived and/or modified sequence opt3 from neuraminidase__InfluenzaA__ACI32767
augaaccccaaucagaagaucauuaccauaggcagcaucuccauugccaucgggauuaucucucugaugcuccaaauaggaaacaucauuucaaucugggcuagucacagcacacagacugguucccagaaucauacgggcauuugcaaccagagaaucauaaccuacgagaauagcacaugggugaaccacacuuaugucaauauuaacaauaccaacguuguggcagggaaagacaagacaucgguaacccuugccggaaauucaagccuguguaguaucuccggcugggcgauuuacacuaaagauaacucugugaggaucgguagcaagggggacgucuucgugauccgggaaccuuuuauuuccugcucacauuuggagugucgcacauucuuuuuaacccaaggagcucugcuaaaugauaaacacaguaacggcacgguuaaggaccgaagcccauaucgugcccucaugucuugcccgcugggcgaagcacccuccccuuacaauucaaaguucgagagcguggccuggagugcuucugcaugucaugaugggaugggauggcuuacuauagguaucuccggcccagacaacggggccgucgcugugcugaaauauaacggaauuaucaccgaaacaauaaagagcuggaaaaagagaauuuugaggacucaggagucggagugcguauguguuaauggcucuugcuuuaccaucaugacagauggucccuccaacggggccgcgucauacaaaaucuucaagauugaaaagggaaaagugaccaagaguaucgagcucaaugcaccuaacuuucacuaugaagaguguagcugcuacccagacacgggcacugucaugugugugugccgggauaauuggcacggcuccaaccgccccugggugucuuucaaucagaaccuggacuaccagauuggguauauaugcagcggagucuuuggugauaauccuagaccaaaagacggcaaggggucauguaacccgguuacaguggauggagccgacggcguaaaagguuucaguuacaaguaugggaauggcguguggaucggaaggaccaaauccaaccggcugcgcaagggcuuugagaugauuugggaccccaauggguggacugauacagacagcgauuucucugucaagcaagacgugguugcuaucaccgauuggucaggauacagugguagcuuugugcagcauccugaacucacgggcuuagacugcauccgaccauguuucugggucgagcuggugagagggcuucccagggaaaacaccacaauuuggacuuccggaucuucgauaucuuucugcggcguagauuccgacaccgccaauuggucauggccugauggugcagaguugccauuuacaaucgacaaauga

SEQ ID NO: 138551 - RNA, 1413 nt, Artificial Sequence
  derived and/or modified sequence opt3 from neuraminidase__InfluenzaA__ACI32768
augaaccccaaucagaagaucauuaccauaggcagcaucuccauugccaucgggauuaucucucugaugucacaaauaggaaacaucauuaguaucugggcuagccacuccauucagacagguucucagaaucauacuggcaucugcaaccagagaauaauuacguacgaaaauucgaccugggugaaccacacauaugucaauaucaacaauacuaacguuguggcagggaaagacaagaccucaguaacacucgccggaaauagcagucuuuguuccauuucuggcugggcgaucuacaccaaagauaacagcaucaggauugguuccaagggggacguguucgucauacgggagccuuuuaucucaugcagucaucuggagugucgcacuuucuuuuugacacaaggagcuuuacugaaugauaaacacagcaacggcaccgugaaggaccgaucuccauaucgugcccuaauguccugcccgcucggcgaagcacccucaccuuacaauagcaaguucgagaguguugccuggucugcuuccgcaugucaugaugggaugggauggcugacgauugguaucagcggcccagacaacggggccguggcuguccuuaaauauaacggaauaauuacugaaaccaucaagucguggaaaaagagaauccugaggacacaggagucugagugcguguguguaaauggcuccugcuuuacuauuaugaccgauggucccucaaacggggccgcgaguuacaaaaucuucaagauugaaaagggaaaaguuacaaagagcauagaguugaaugcaccuaacuuucacuaugaagaguguuccugcuacccagacaccggcacggugaugugugucugccgggauaauuggcacggcucuaaccgccccugggugagcuucaaucagaaccucgacuaccagaucggguauauuugcucaggaguguuuggugauaauccuagaccaaaagacggcaaggggaguuguaacccggucacuguugauggagccgacggcgugaaagguuucuccuacaaguaugggaauggcguauggaucggaaggacaaaaagcaaccggcugcgcaagggcuuugagaugaucugggaccccaauggguggaccgauacugacucugauuucucagugaagcaagacgucguggcuauuacagauuggaguggauacagcgguuccuuuguucagcauccugaacugaccggccucgacugcauacgaccauguuucuggguggaguuagucagagggcugcccagggaaaacacgaccaucuggacaucuggaucgagcauuuccuucugcggcguggauucagacacugccaauuggaguuggccugauggugcagagcuuccauuuaccaucgacaaauga

SEQ ID NO: 138552 - RNA, 1413 nt, Artificial Sequence
  derived and/or modified sequence opt3 from neuraminidase__InfluenzaA__ACI32769
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagauuucgguaacccuugccggaaauucaagccuguguaguaucuccggcugggcgaucuacacaaaagauaacucuauuaggauagguagcaagggggacguguucgucauccgggagccuuuuauuuccugcucacauuuggagugucgcaccuucuuuuuaacucaaggagcucugcuaaaugauaaacacaguaacggcacagugaaggaccgaagcccauaucgugcccucaugucuugcccgcugggcgaagcacccuccccuuacaauucaaaguucgagagcguugccuggagugcuucugcaugucaugaugggaugggauggcuuaccaucgguauauccggcccagacaacggggccguggcuguccugaaauauaacggaauuaucacggaaacuaucaagagcuggaaaaagagaauuuugaggacccaggagucggagugcguguguguaaauggcucuugcuuuacaaucaugacugauggucccuccaacggggccgcgucauacaaaauuuucaagauagaaaagggaaaaguuaccaagaguaucgagcucaaugcaccuaacuuucacuaugaagaguguagcugcuacccagacacaggcaccgugaugugugucugccgggauaauuggcacggcuccaaccgccccugggugucuuucaaucagaaccuggacuaccagauuggguauaucugcagcggaguguuuggugauaauccuagaccaaaagacggcaaggggucauguaacccggucacgguugauggagccgacggcgugaaagguuucaguuacaaguaugggaauggcguauggaucggaaggacuaaauccaaccggcugcgcaagggcuuugagaugauuugggaccccaauggguggacagauaccgacagcgauuucucugugaagcaagacgucguggcuauaacugauuggucaggauacagugguagcuuuguucagcauccugaacucacaggcuuagacugcauccgaccauguuucuggguggagcuggucagagggcuucccagggaaaacaccacgauuuggaccuccggaucuucgaucagcuucugcggcguggauuccgacacagccaauuggucauggccugauggugcagaguugccauuuacuauugacaaauga

SEQ ID NO: 138553 - RNA, 1413 nt, Artificial Sequence; identical to SEQ ID NO: 136402
  derived and/or modified sequence opt3 from neuraminidase__InfluenzaA__ACI32770

SEQ ID NO: 138554 - RNA, 1413 nt, Artificial Sequence
  derived and/or modified sequence opt3 from neuraminidase__InfluenzaA__ACI32771
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacaaaaauucuaccugggugaaccacacauaugucaauaucaacaauacuaacguuguggcagggaagggaaaaaccucgguaacacuugccggcaauucaagccuguguaguauuuccgguugggcgaucuacaccaaggacaacucuaucaggauugggagcaaaggagauguguucgucauacgggagccuuuuaucuccugcucacauuuggaaugucgcacuuucuuuuuaacacaaggcgcucugcuaaaugacaagcacaguaacggcaccgugaaggaucgaagcccauaucgugcccucaugucuugcccgcugggggaggcacccuccccuuacaauucaaaauucgaaagcguugccuggagugcuucugcaugucaugacggaauggguuggcuuacgauuggcaucuccgggccagauaacggagccguggcuguccugaaguauaacggcauaauuacugagaccaucaaaagcuggaagaaaagaaucuugaggacacaggaaucggagugcguguguguaaaugguucuugcuuuacuauuaugaccgacgggcccuccaacggagccgcgucauacaagaucuucaagauugagaaaggcaagguuacaaaaaguauagaacucaaugcaccuaacuuucacuaugaggaauguagcugcuacccagauaccggcacggugaugugugucugccgggacaauuggcacggguccaaccgccccugggugucuuucaaucagaaccuggauuaccagaucggauauauuugcagcgguguguuuggcgacaauccuagaccaaaggaugggaaaggaucauguaacccggucacuguugacggcgccgauggugugaagggguucaguuacaaauauggcaauggaguauggaucggcaggacaaaguccaaccggcugcgcaagggguuugagaugaucugggaccccaauggauggaccgacacugauagcgacuucucugugaaacaagaugucguggcuauuacagacuggucagguuacaguggcagcuuuguucagcauccugagcucaccggguuagauugcauacgaccauguuucuggguggaacuggucagaggacuucccagggagaacacgaccaucuggacauccgguucuucgauuagcuucugcggcguggacuccgauacugccaauuggucauggccugacggggcagaauugccauuuaccaucgauaaguga

SEQ ID NO: 138555 - RNA, 1413 nt, Artificial Sequence; identical to SEQ ID NO: 136402
  derived and/or modified sequence opt3 from neuraminidase__InfluenzaA__ACI32772

SEQ ID NO: 138556 - RNA, 1413 nt, Artificial Sequence; identical to SEQ ID NO: 136402
  derived and/or modified sequence opt3 from neuraminidase__InfluenzaA__ACI32773

SEQ ID NO: 138557 - RNA, 1413 nt, Artificial Sequence; identical to SEQ ID NO: 136402
  derived and/or modified sequence opt3 from neuraminidase__InfluenzaA__ACI32774

SEQ ID NO: 138558 - RNA, 1413 nt, Artificial Sequence; identical to SEQ ID NO: 136402
  derived and/or modified sequence opt3 from neuraminidase__InfluenzaA__ACI32775

SEQ ID NO: 138559 - RNA, 1413 nt, Artificial Sequence
  derived and/or modified sequence opt3 from neuraminidase__InfluenzaA__ACI32776
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacaaaaauucuaccugggugaaccacacauaugucaauaucaacaauacuaacguuguggcagggaaggacaaaaccucgguaacacuugccggaaauucaagccuguguaguauuuccggcugggcgaucuacaccaaggauaacucuaucaggauugguagcaaaggggacguguucgucauacgggagccuuuuaucuccugcucacauuuggaaugucgcacuuucuuuuuaacacaaggagcucugcuaaaugauaagcacaguaacggcaccgugaaggaccgaagcccauaucgugcccucaugucuugcccgcugggcgaggcacccuccccuuacaauucaaaauucgaaagcguugccuggagugcuucugcaugucaugaugggaugggauggcuuacgauugguaucuccggcccagacaacggggccguggcuguccugaaguauaacggaauaauuacugagaccaucaaaagcuggaagaaaagaaucuugaggacacaggaaucggagugcguguguguaaauggcucuugcuuuacuauuaugaccgauggucccuccaacggggccgcgucauacaagaucuucaagauugagaaaggaaagguuacaaaaaguauagaacucaaugcaccuaacuuucacuaugaggaauguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaggacggcaaagggucauguaacccggucacuguugauggagccgacggcgugaaggguuucaguuacaaauaugggaauggcguauggaucggaaggacaaaguccaaccggcugcgcaagggcuuugagaugaucugggaccccaauggguggaccgauacugacagcgauuucucugugaaacaagacgucguggcuauuacagauuggucaggauacagugguagcuuuguucagcauccugagcucaccggcuuagacugcauacgaccauguuucuggguggaacuggucagagggcuucccagggagaacacgaccaucuggacauccggaucuucgauuagcuucugcggcguggauuccgacacugccaauuggucauggccugauggugcagaauugccauuuaccaucgacaaguga

SEQ ID NO: 138560 - RNA, 1413 nt, Artificial Sequence
  derived and/or modified sequence opt3 from neuraminidase__InfluenzaA__ACI32777
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacaaaaauucuaccugggugaaccacacauaugucaauaucaacaauacuaacguuguggcagggaaggacaaaaccucgguaacacuugccggaaauucaagccuguguaguauuuccggcugggcgaucuacaccaaggauaacucuaucaggauugguagcaaaggggacguguucgucauacgggagccuuuuaucuccugcucacauuuggaaugucgcacuuucuuuuuaacacaaggagcucugcuaaaugauaagcacaguaacggcaccgugaaggaccgaagcccauaucgugcccucaugucuugcccgcugggcgaggcacccuccccuuacaauucaaaauucgaaagcguugccuggagugcuucugcaugucaugaugggaugggauggcuuacgauugguaucuccggcccagacaacggggccguggcuguccugaaguauaacggaauaauuacugagaccaucaaaagcuggaagaaaagaaucuugaggacacaggaaucggagugcguguguguaaauggcucuugcuuuacuauuaugaccgauggucccuccaacggggccgcgucauacaagaucuucaagauugagaaaggaaagguuacaaaaaguauagaacucaaugcaccuaacuuucacuaugaggaauguagcugcuacccagacaccggcacggugaugugugucugccgggauaauuggcacggcuccaaccgccccugggugucuuucaaucagaaccuggacuaccagaucggguauauuugcagcggaguguuuggugauaauccuagaccaaaggacggcaaagggucauguaacccggucacuguugauggagccgacggcgugaaggguuucaguuacaaauaugggaauggcguauggaucggaaggacaaaguccaaccggcugcgcaagggcuuugagaugaucugggaccccaauggguggaccgauacugacagcgauuucucugugaaacaagacgucguggcuauuacagauuggucaggauacagugguagcuuuguucagcauccugagcucaccggcuuagacugcauacgaccauguuucuggguggaacuggucagagggcuucccagggagaacacgaccaucuggacauccggaucuucgauuagcuucugcggcguggauuccgacacugccaauuggucauggccugauggugcagaauugccauuugcuaucgacaaguga

SEQ ID NO: 138561 - RNA, 1413 nt, Artificial Sequence; identical to SEQ ID NO: 136402
  derived and/or modified sequence opt3 from neuraminidase__InfluenzaA__ACI32778

SEQ ID NO: 138562 - RNA, 1413 nt, Artificial Sequence; identical to SEQ ID NO: 136402
  derived and/or modified sequence opt3 from neuraminidase__InfluenzaA__ACI32779

SEQ ID NO: 138563 - RNA, 1413 nt, Artificial Sequence; identical to SEQ ID NO: 136402
  derived and/or modified sequence opt3 from neuraminidase__InfluenzaA__ACI32780

SEQ ID NO: 138564 - RNA, 1413 nt, Artificial Sequence; identical to SEQ ID NO: 136402
  derived and/or modified sequence opt3 from neuraminidase__InfluenzaA__ACI32781

SEQ ID NO: 138565 - RNA, 1413 nt, Artificial Sequence
  derived and/or modified sequence opt3 from neuraminidase__InfluenzaA__ACI32782
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacuggcaccaucaagagcuggaaaaagcagaucuugagaacacaggaaucggagugcguguguaugaaugguucuugcuuuacuauuaugaccgaugggcccuccaacggagccgcgucauacaaaaucuucaagauugagaagggcaaagcaacaaagaguauagaacucaaugccccuaacuuucacuaugaggaauguagcugcuacccagacaccggcacgguaauguguguuugcagggauaauuggcacggguccaaccggcccugggugucuuucaaucagaaccuggacuaccaaaucggauauauuugcagcggugucuuuggcgauaauccucgcccaaaagacagaaaggggucauguaacccggugacuguggauggagcugacggcgucaaagguuucaguuacaaguaugggaauggcguuuggaucggaaggacaaaauccaaccggcugcgcaagggcuuugagaugaucugggaccccaauggguggaccaacacugauagcgacuucucugugaagcaggauguaguggccauuacagacuggucaggauacagugguagcuuuguccagcauccugagcucaccggcuuagauugcauacgaccauguuucuggguggaacugguuagagggcuucccagggagaauacgaccaucuggacauccggaucuucgauuagcuucugcggcgugaacuccgacacugcaaacuggucauggccugauggugcugaauugccauuuaccaucgacaaauga

SEQ ID NO: 138566 - RNA, 1413 nt, Artificial Sequence
  derived and/or modified sequence opt3 from neuraminidase__InfluenzaA__ACI32783
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaaagcagaucuugagaacacaggagucggagugcguguguguaaauggcucuugcuuuacuauuaugaccgauggucccuccaacggggccgcgucauacaaaaucuucaagauugaaaagggaaaaguuacaaagaguauagagcucaaugcaccuaacuuucacuaugaagaguguagcugcuacccagacaccggcacggugaugugugucugcagggauaauuggcacggcuccaaccggcccuggcugucuuucaaucagaaccuggacuaccaaaucggguauauuugcagcggagugaucggugauaauccucgcccaaaagacggcaaggggucauguaacccggugacugucgauggagccgacggcguuaaagguuuuaguuacaaguaugggaauggcguguggaucggaagaacaaaauccaacaggcuccggaagggcuucgagaugauuugggaccccaauggguggaccgauacugacagcgauuuuucuguaaagcaggacguggucgcuauaacagauuggucaggauacagugguagcuucgugcagcauccugaauuaaccggccuggacugcauccgcccauguuuuuggguugagcuugugcgaggguugcccagagaaaacacgaccauuuggacauccggaucuucgaucagcuucugcggcgucgauggugacacugccaauugguccuggccugauggggcagagcugccauucaccauugacaaauga

SEQ ID NO: 138567 - RNA, 1413 nt, Artificial Sequence
  derived and/or modified sequence opt3 from neuraminidase__InfluenzaA__ACI32784
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacuggcaccaucaagagcuggaaaaagcagaucuugagaacacaggaaucggagugcguguguaugaaugguucuugcuuuacuauuaugaccgaugggcccuccaacggagccgcgucauacaaaaucuucaagauugagaagggcaaagcaacaaagaguauagaacucaaugccccuaacuuucacuaugaggaauguagcugcuacccagacaccggcacgguaauguguguuugcagggauaauuggcacggguccaaccggcccugggugucuuucaaucagaaccuggacuaccaaaucggauauauuugcagcggugucuuuggcgauaauccucgcccaaaagacagagaggggucauguaacccggugacuguggauggagcugacggcgucaaggguuucaguuacaaauaugggaauggcguuuggaucggaaggacaaaguccaaccggcugcgcaaaggcuuugagaugaucugggaccccaauggguggaccaacacugauagcgacuucucugugaagcaggauguaguggccauuacagacuggucaggauacagugguagcuuuguccagcauccugaacucaccggcuuagauugcauacgaccauguuucuggguggagcugguuagagggcuucccagggaaaauacgaccaucuggacauccggaucuucgauuagcuucugcggcgugaacuccgacacugcaaacuggucauggccugauggugcugaguugccauuuaccaucgacaaguga

SEQ ID NO: 138568 - RNA, 1413 nt, Artificial Sequence
  derived and/or modified sequence opt3 from neuraminidase__InfluenzaA__ACI32785
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaugugcaaccagagaaucauaacguacgaaaauucuaccugggugaaccacacauaugucaauauuaacaauacuaacguuguggcagagaaagacaagaccucgguaacacuugccggaaauucaagccuguguaguaucuccggaugggcgauuuacaccaaagauaacucuaucaggaucggcagcaagggugacguguucgucauucgggagccuuuuauauccugcucacauuuggaaugucgcacuuucuuuuuaacacaaggggcucugcuaaaugauaaacacaguaacggaaccgugaaggaccgaagcccauaucgugcccucaugucuugcccgcugggcgaggcacccuccccuuacaauucaaaguucgaaagcguugccuggagugcuucugcaugucaugauggcaugggguggcuuacgaucggaauuuccgguccagacaacggcgccguggcuguccugaaauauaacgggaucauaacugagaccauuaagagcuggaaaaagagaaucuugaggacacaggagucggaaugcguguguguaaauggaucuugcuuuacuaucaugaccgauggccccuccaacggugccgcgucauacaaaauuuucaagaucgagaaggggaaaguuacaaagaguauugaacucaaugcaccuaacuuucacuaugaggaguguagcugcuacccagacaccggaacggugaugugugucugccgggauaauuggcacggcuccaaccgccccugggugucuuucaaucagaaccuggacuaccagauaggcuauaucugcagcgggguguuuggagauaauccuagaccaaaagacgguaagggcucauguaacccggucacuguugauggggccgacggagugaaaggcuucaguuacaaguaugguaaugggguauggauuggcaggacaaaauccaaccggcugcgcaagggauuugaaaugaucugggaccccaauggcugggcugauaccgacagcgauuucucugugaagcaagacgucguggccaucacugauuggucaggguacagugggagcuuuguucagcauccugagcucacagguuuaaacugcauucgaccauguuucuggguggaacuggucagaggccuucccagggagaauaccacgauauggaccuccgggucuucgaucagcuucugcggaguggacuccgauacagcaaacuggucauggccugacggcgcugaauugccauuuacuauugauaaauga

SEQ ID NO: 138569 - RNA, 1413 nt, Artificial Sequence
  derived and/or modified sequence opt3 from neuraminidase__InfluenzaA__ACI32787
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaacaauacauaugucaacauuaauaacacuaauguuguggcagagaaagacaagaccucgguaacacuugccgggaacucaagccuguguaguaucuccggaugggcgaucuacaccaaagauaauucuauuaggauaggcagcaagggugacguguucgucauccgggagccuuuuauuuccugcucacacuuggaaugucgcacuuucuuuuuaacacaaggggcucugcuaaacgauaaacauaguaauggaaccgugaaggaccgaagcccauaucgugcccucaugucuugcccgcugggcgaggcacccuccccuuacaacucaagauucgaaagcguugccuggagugcuucugcaugucacgauggcaugggguggcuuacgaucggaauauccgguccagacaacggcgccguggcuguccugaaguauaaugggauuaucacugagaccaucaaaagcuggaagaaaaggauuuugcggacacaggagucggaaugcguguguaugaacggaucuugcuuuacuaucaugaccgauggccccuccaauggugccgcgucauacaagauuuucaaaauagagaaggggaagguaacaaaaaccaucgaacucaacgcaccuaauuuucauuaugaggaguguaguugcuacccagacacgggaacuguuaugugugugugccgcgauaacuggcacggcagcaauagacccugggucuccuucaaccagaaucuggacuaccagauuggcuauaucugcucugggguguuuggagauaacccuaggccaaaggacggugaaggcagcuguaauccggugacagucgauggggccgacggaguuaaaggcuucucauacaaguaugguaacgggguguggaucggccggaccaaaaguaaucgccugcgaaagggauuugagaugauuugggaccccaacggcuggacuaauacagauuccgacuucagcguaaaacaagauguggucgcuauaaccgacuggucuggguacucaggaaguuuugugcagcacccugaacucacggguuuagauugcaucagaccauguuucuggguugagcuggugaggggccuuccccgggaaaacaccacaauuuggacuagcggguccucuaucucguucugcggagucaacggcgguaccgccgacuggagcuggccugauggggcagaguugccauuuacaauugacaaguga

SEQ ID NO: 138570 - RNA, 1413 nt, Artificial Sequence
  derived and/or modified sequence opt3 from neuraminidase__InfluenzaA__ACI32788
augaaccccaaucagaagaucauuaccauaggcagcaucuccauugccaucgggauuaucucucugaugcuccaaauaggaaacaucauuucaaucugggcuagucacagcauucagacagguucccagaaucauacuggcacgugcaaccagagaaucauaaccuacgagaauaacacaugggugaaucacacuugugucaacauuaauaacaccaauguuguggcagggaaagacaagacaucuguaacccuugugggaaacucgucacugugcagcaucaguggcugggccauuuauacuaaagauaauuccaucaggaucgguucuaagggggacgucuucgugauucgggaaccuuuuauaagcuguucccauuuggagugccgcacauucuuuuuaacccaaggagcgcugcuaaacgauaaacacucaaauggcacgguuaaggaccgaaguccauaccgugcucucaugagcuguccgcugggcgaagcccccucuccuuauaacuccaaguucgagucaguggcauggagcgccagugcuugccaugaugggaaaggauggcuuacuaucgguauuucuggcccagacaacggggcagucgccgugcugaaguacaauggaaucauaaccgaaacaauuaaauccuggaagaaaagaaucuugaggacucaggagagcgaguguguaugcguuaacggcucguguuuuaccaucaugacagauggucccucuaauggggcugccuccuauaagauuuucaagaucgaaaaaggaaaggugaccaaaucaauugagcucaacgcgccuaauuuucacuacgaagagugcaguuguuauccagacacgggcacugucaugugcgugugccgggauaacuggcacggcagcaaucgccccuggguguccuucaaccagaaucuggacuaccagauaggguacaucuguucuggagucuuuggugauaacccuagaccaaaggacggcaaagggagcugcaauccgaugacaguugauggagcagacggcgugaaggguuucucauauaaauacgggaacggcguauggauuggaaggaccaagaguaaucggcugcgcaagggcuuugagaugaucugggaccccaacggguggacugauacagacuccgauuucagcgugaaacaagacgucguggccaucaccgauuggucuggauauucagguaguuuuguucagcauccugaacucacgggcuuagacuguauucgaccaugcuucuggguggagcuggucagagggcuucccagggaaaauaccacaauauggacuagcggauccucuaucucguucuguggcguggauagcgacaccgcuaacugguccuggccugauggugccgaguugccauuuacaauugacaaguga

SEQ ID NO: 138571 - RNA, 1410 nt, Artificial Sequence
  derived and/or modified sequence opt3 from neuraminidase__InfluenzaA__ACI32790
augaaccccaaucagaagaucauuaccauaggcagcgugucccugacaaucgccacuauuugcuuccucacgcaaaucgcuauucuugucaccacaguuacucugcacuuuaaacaguacgaguguaacucuccuccaaauaaccaggugauguugugcgaaccgaccaucauagagagaaauaucacagaaauuguauauuuaaccaacacuacaaucgagaaggaaauuugucccaaacuggcagaguacaggaauuggucaaagccucagugcaacaucaccggguucgccccauuuaguaaagacaauagcauacggcuauccgcgggaggugauauuugggugacgcgcgagcccuaugucucuugugacccugauaagugcuaccaauucgcucucggccaggggacuacccugaacaauggacauucgaacgacacagugcacgaucgaacuccauaucguacccuucugaugaaugaauugggcguucccuuucaucucgguacaaaacagguguguaucgccuggucaagcaguuccugccacgacgggaaagcauggcugcaugucugugugaccggagaugacaagaacgccacggcuucuuucauuuacaauggcagacugguagauagcaucggcuccuggucaaagaagauccucaggacucaggagagugaaugcguuuguauuaacgggacaugcaccguggucaugacugacggaagcgcaucugguaaagccgauacaaagauauuauuuaucgaggagggcaagauugugcacaccucccugcuuucagggagcgcucaacacguggaagagugcaguuguuauccucgguacccaggaguccgcugcguuuguagagacaacuggaaaggcucuaauaggccgaucguggauauaaacguaaaggacuacuccauugugagcucguaugucugcucugguuuggugggggacacgccccggaaaaaugauuccucaaguagcucccauugucuggacccuaacaaugaagagggaggccacggcguuaaggggugggccuucgaugacggaaacgauguguggaugggucgcaccaucucugaaaaacuacgaagcggcuacgagacauuuaaggucaucgagggguggucaaaaccaaauaguaagcuccagauuaacagacaggugaucguagacaggggaaaucgguccggcuauagcgguauuuucucuguugaagggaagucaugcauaaaccguuguuuuuacguggagcugauccgcggcagaaaucaggaaacugagguccuuuggaccaguaacagcauuguggucuucugcggaacauccggcacuuaugggaccggaucuuggcccgauggugcggacaucaaucugaugccuaucuga

SEQ ID NO: 138572 - RNA, 1410 nt, Artificial Sequence; identical to SEQ ID NO: 136398
  derived and/or modified sequence opt3 from neuraminidase__InfluenzaA__ACI32791

SEQ ID NO: 138573 - RNA, 1410 nt, Artificial Sequence; identical to SEQ ID NO: 136398
  derived and/or modified sequence opt3 from neuraminidase__InfluenzaA__ACI32793

SEQ ID NO: 138574 - RNA, 1410 nt, Artificial Sequence; identical to SEQ ID NO: 136398
  derived and/or modified sequence opt3 from neuraminidase__InfluenzaA__ACI32794

SEQ ID NO: 138575 - RNA, 1410 nt, Artificial Sequence; identical to SEQ ID NO: 136728
  derived and/or modified sequence opt3 from neuraminidase__InfluenzaA__ACI32795

SEQ ID NO: 138576 - RNA, 1410 nt, Artificial Sequence
  derived and/or modified sequence opt3 from neuraminidase__InfluenzaA__ACI32796
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguagcauaacaggguucgcaccauuuuccaaagacaacucuauucggcugucggccggaggugauaucuggguaacccgcgagcccuaugugucaugcgacccugauaaguguuaccaauucgcgcuaggccaggggacgacucucaauaacguccauagcaaugacaccgugcacgaucgaacaccauaucguacucugcuuaugaacgaacugggaguucccuuucauuugggcaccaaacaggugugcauugcuuggaguuccucuagcugucacgacgguaaggccuggcuccaugucugcgugacaggggaugacaagaaugcaaccgccuccuucaucuacaacggaagacugguagauucaaucguuaguuggagcaaagagauucugaggacgcaggaaucugagugugugugcauaaauggcacuuguacagucgugaugaccgacggcuccgcuucagggaaggcagauacuaaaauccucuuuauugaggaaggaaagaucgugcacacaagcaccuuaagugguucugcccaacacgucgaggaaugcuccugcuauccucgguacccaggcguucgcugugugugcagagacaacuggaaggggagcaacaggccgauaguagauauuaauaucaaagacuacucgaucgugucuuccuaugucuguucaggacuggugggcgacacgccccggaagaacgauaguagcuccucuagccauugccuugacccuaauaacgaggaaggugggcacggaguuaaaggcugggcuuucgaugacggcaaugauguguggauggggcgcaccauuucagagaagagucgauccggauacgagacauuuaaagucaucgaagguuggagcaacccaaauucuaaguugcagauuaacagacaggugauaguagacaggggcaaucggucaggguauaguggaaucuucagcguugagggcaaauccuguauuaaccguugcuuuuacguggaacugauccgcgguagaaaggaggaaacugagguccuauggaccucuaauucgaucguggucuucugugggacaagcggcacuuauggaaccggcuccuggcccgauggggccgacauuaaccucaugccuauauga

SEQ ID NO: 138577 - RNA, 1410 nt, Artificial Sequence
  derived and/or modified sequence opt3 from neuraminidase__InfluenzaA__ACI32797
augaaccccaaucagaugaucauuaccauaggcagcgugucccugacaaucucuacuauuugcuucuuuaugcaaaucgccauucucaucacgaccgucacacuucacuucaagcaguacgaguuuaacucaccuccaaauaaccagguuaugcugugugaaccgacuauaaucgagagaaauauuaccgaaaucguguauuugacaaacaccacuauugagaaagaaaucugccccaaguuagcugaguacaggaauuggaguaaaccucaguguagcauaacaggguucgcaccauuuuccaaggacaacucuauucggcugucggccggaggugauaucuggguaacccgcgagcccuaugugucaugcgacccugauaaauguuaccaauucgcgcuaggccaggggacgacucucaauaacguccauagcaaugacaccgugcacgaucgaacaccauaucguacucugcuuaugaacgaacugggaguucccuuucauuugggcaccaaacaggugugcauugcuuggaguuccucuagcugucacgacgguaaggccuggcuccaugucugcgugacaggggaugacaagaaugcaaccgccuccuucaucuacaacggaagacugguagauucaaucguuaguuggagcaaggagauucugaggacgcaggaaucugagugugugugcauaaauggcacuuguacagucgugaugaccgacggcuccgcuucagggaaagcagauacuaagauccucuuuauugaggaaggaaaaaucgugcacacaagcaccuuaagugguucugcccaacacgucgaggaaugcuccugcuauccucgguacccaggcguucgcugugugugcagagacaacuggaaggggagcaacaggccgauaguagauauuaauaucaaggacuacucgaucgugucuuccuaugucuguucaggacuggugggcgacacgccccggaaaaacgauaguagcuccucuagccauugccuugacccuaauaacgaggaaggugggcacggaguuaagggcugggcuuucgaugacggcaaugauguguggauggggcgcaccauuucagagaaaagucgauccggauacgagacauuuaaggucaucgaagguuggagcaacccaaauucuaaauugcagauuaacagacaggugauaguagacaggggcaaucggucaggguauaguggaaucuucagcguugagggcaaguccuguauuaaccguugcuuuuacguggaacugauccgcgguagaaaagaggaaacugagguccuauggaccucuaauucgaucguggucuucugugggacaagcggcacuuauggaaccggcuccuggcccgauggggccgacauuaaccucaugccuauauga

SEQ ID NO: 138578 - RNA, 1410 nt, Artificial Sequence
  derived and/or modified sequence opt3 from neuraminidase__InfluenzaA__ACI32798
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaacgagauucugaggacgcaggaaagcgagugugugugcauaaacggcacuuguacagucgugaugaccgacggcucugcuuccgggaaagcagauacuaagauccucuuuauugaggaaggaaaaaucgugcacacaucaaccuuaagcgguagugcccaacacgucgaggaaugcucuugcuauccucgguacccaggcguucgcugugugugcagagacaauuggaagggguccaacaggccgauaguagauauuaauaucaaggacuacagcaucgugucgucuuaugucuguuccggacuggugggcgacacgccccggaaaaacgauucaaguagcuccucucauugccuugacccuaauaacgaggaaggugggcacggaguuaagggcugggcuuucgaugacggcaaugauguguggauggggcgcaccauuagcgagaaauugcgaucaggauacgagacauuuaaggucaucgaagguuggaguaacccaaauuccaaacugcagauuaacagacaggugauaguagacaggggcaaucggagcggguauucuggaaucuucucaguugagggcaagaguuguauuaaccguugcuuuuacguggaacuaauccgcgguagaaaagaggaaacugagguccucuggaccagcaauuccaucguggucuucugugggacaucuggcacuuauggaaccggcucguggcccgauggggccgacauuaaccugaugccuauauga

SEQ ID NO: 138579 - RNA, 1410 nt, Artificial Sequence
  derived and/or modified sequence opt3 from neuraminidase__InfluenzaA__ACI32799
augaaccccaaucagagaaucauuaccauaggcagcgugucccugacaaucucuacuauuugcuucuuuaugcaaaucgccauucucaucacgaccgucacacuucacuucaagcaguacgaguuuaacucaccuccaaauaaccagguuaugcugugugaaccgacuauaaucgagaggaauauuaccgaaaucguguauuugacaaacaccacuauugagaaagaaaucugccccaaguuagcugaguaccggaauuggaguaaaccucagugugacauaacaggguucgcaccauuuagcaaggauaacuccauucgccugucugccggaggugacaucuggguaacccgagagcccuaugugucgugcgauccugacaaauguuaccaauucgcgcuaggccaggggacgacucucaauaacguccauucaaaugauaccgugcacgaccguacaccauauagaacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaaggcugguagacuccguugugucauggaguaaggauauccugcggacgcaggagagcgaaugugucugcauuaauggcacuuguacaguggugaugaccgacggcucugcuuccgggaaagcaaacacuaagauacucuuuaucgaggagggaaaaauuguccacacaucaaccuuaagcgguagugcccaacacguugaagagugcucuugcuauccucgcuacccaggcgugagauguguaugcagggauaacuggaagggguccaaucggccgaucguggacauaaacauuaagaauuacagcaucgucucgucuuauguguguuccggacugguuggcgacacgccccgcaaaaccgauucaaguagcuccucucauugccuugacccuaacaaugaagagggugggcacggagugaagggcugggcuuucgaugacggcaacgaugucuggauggggcgaacaaucagcgaaaaauugagacugggauacgagacuuuuaaggugauugaggguuggucaaauccaaacaguaaacuacagaucaauaggcagguaauuguugaccggggcaaccguuccggguauagcggaauauucucuguggaaggcaagucauguaucaaucgcugcuuuuacgucgagcucauuagagguaggaaagaagagaccgaagugcuguggacaaguaacagcaucgucguguucugugggacuuccggcaccuauggaacaggcucuuggcccgauggggccgacaucaaucuuaugccuauuuga

SEQ ID NO: 138580 - RNA, 1410 nt, Artificial Sequence
  derived and/or modified sequence opt3 from neuraminidase__InfluenzaA__ACI32800
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagacuaauagacaggugauuguagacaggggcaaccggagcggguauucuggaauauucucaguugagggcaaaaguuguaucaaucguugcuuuuacguggaacuaauucgcgguagaaaggaggaaaccgagguccucuggacaagcaacuccaucguggucuucugugggacuucuggcaccuauggaacaggcucguggcccgauggggccgacaucaaucugaugccuauuuga

SEQ ID NO: 138581 - RNA, 1410 nt, Artificial Sequence; identical to SEQ ID NO: 138580
  derived and/or modified sequence opt3 from neuraminidase__InfluenzaA__ACI32802

SEQ ID NO: 138582 - RNA, 1410 nt, Artificial Sequence; identical to SEQ ID NO: 138580
  derived and/or modified sequence opt3 from neuraminidase__InfluenzaA__ACI32803

SEQ ID NO: 138583 - RNA, 1410 nt, Artificial Sequence; identical to SEQ ID NO: 137723
  derived and/or modified sequence opt3 from neuraminidase__InfluenzaA__ACI32804

SEQ ID NO: 138584 - RNA, 1410 nt, Artificial Sequence
  derived and/or modified sequence opt3 from neuraminidase__InfluenzaA__ACI32805
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagugacuaaaauccucuuuauugaggaaggaaagaucguccacacaucaaccuuaagcgguagugcccaacacguugaggaaugcucuugcuauccucgguacccaggcgugcgcuguguaugcagagauaacuggaagggguccaauaggccgauaguggacauuaacaucaaagauuacagcaucgucucgucuuauguguguuccggacugguuggcgacacgccccggaagaaugaccgcucaaguagcucccauugccuugauccuaacaaugaggaaggugggcacggagugaaaggcugggcuuucgacgauggcaacgacgucuggauggggcgaaccauuucugaaaagagcagaucaggauacgagacauuuaaagugaucgaggguuggaguaauccaaacuccaaguugcagacuaauaggcagguaauuguugaucggggcaaccguagcggguauucuggaauauucucaguggagggcaaaaguuguaucaaucgcugcuuuuacgucgaacugauuagagguaggaaggaggaaaccgaggugcuauggacaagcaacuccaucgucguguucugugggacuucuggcaccuauggaacaggcucguggcccgacggggccgauaucaaucucaugccuauuuga

SEQ ID NO: 138585 - RNA, 1410 nt, Artificial Sequence; identical to SEQ ID NO: 136728
  derived and/or modified sequence opt3 from neuraminidase__InfluenzaA__ACI32806

SEQ ID NO: 138586 - RNA, 1410 nt, Artificial Sequence
  derived and/or modified sequence opt3 from neuraminidase__InfluenzaA__ACI32807
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaguaugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaaugauaccguucgagaccguacaccauauagaacucugcuuaugaacgaacugggagugcccuuucacuugggcaccaagcaggucugcaucgcuuggagcaguuccucuugucaugaugguaaagccuggcuccacgugugcauuacaggggacgauaagaaugcaaccgccagcuucaucuacaacggaaggcugguagacuccaucguuucauggaguaaagagauucugcggacgcaggaaagcgagugugugugcauaaauggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaacuggaagggguccaaccggccgauaguagacauuaauaucaaagaccacagcaucgugucgucuuacgucuguuccggacuggugggcgauacgccccgcaagaacgacucaaguagcuccucucauugccuugauccuaauaacgaggaaggugggcacggaguuaaaggcugggcuuucgacgauggcaaugacguguggauggggcgaaccauuagcgagaagucaagauugggauaugagacauuuaaagucaucgaagguuggaguaacccaaauuccaagcugcagauuaacaggcaagugauaguagaucggggcaaucguagcggguacucuggaaucuucucaguugagggcaaaaguuguauuaaccgcugcuuuuauguggaacuaaucagagguaggaaggaggaaacugagguccucuggaccagcaauuccaucguggucuucugugggacaucuggcacuuacggaaccggcucguggcccgacggggccgauauuaaccugaugccuauauga

SEQ ID NO: 138587 - RNA, 1410 nt, Artificial Sequence
  derived and/or modified sequence opt3 from neuraminidase__InfluenzaA__ACI32808
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccguugugucauggaguaaagauauccugaggacgcaggagagcgaaugugucugcauuaauggcacuuguacaguggugaugaccgacggcucugcuuccgggaaggcagauacuaaaauacucuuuaucgaggagggaaagauuguccacacaucaaccuuaagcgguagugcccaacacguugaagagugcucuugcuauccucgguacccaggcgugcgcuguguaugcagagacaacuggaagggguccaacaggccgaucguggacauaaauauuaaaaacuacagcaucgucucgucuuauguguguuccggacugguuggcgauacgccccggaagaccgacucaaguagcuccucucauugccuugauccuaauaacgaagagggugggcacggagugaaaggcugggcuuucgacgauggcaaugacgucuggauggggcgcacaaucagcgaaaaguugcgacugggauacgagacuuuuaaagugauugaggguuggucaaacccaaauaguaagcuacagaucaacagacagguaauuguugauaggggcaaucgguccggguauagcggaauauucucuguggaaggcaaaucauguaucaaccguugcuuuuacgucgagcucauucgcgguagaaaggaaaagaccgaggugcuguggacaaguaauagcaucgucguguucugugggacuuccggcaccuauggaacaggcucuuggcccgacggggccgauaucaaccuuaugccuauuuga

SEQ ID NO: 138588 - RNA, 1410 nt, Artificial Sequence; identical to SEQ ID NO: 137723
  derived and/or modified sequence opt3 from neuraminidase__InfluenzaA__ACI32809

SEQ ID NO: 138589 - RNA, 1410 nt, Artificial Sequence
  derived and/or modified sequence opt3 from neuraminidase__InfluenzaA__ACI32810
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccacaucguacucugcuuaugaacgaacugggaguucccuuucacuugggcaccaaacaggugugcauugcuuggagcaguuccucuugucaugaugguaaggccuggcuccacgucugcgugacaggggacgauaagaaugcaaccgccagcuucaucuauaacggaagacugguagacuccguugugucauggaguaaagauauccugaggacgcaggagagcgaaugugucugcauuaauggcacuuguacaguggugaugaccgacggcucugcuuccgggaaggcagauacuaaaauacucuuuaucgaggagggaaagauuguccacacaucaaccuuaagcgguagugcccaacauguugaagagugcucuugcuacccucgguauccaggcgugcgcuguguaugcagagacaacuggaagggguccaacaggccgaucguggacauaaauauuaaaaacuacagcaucgucucgucuuacguguguuccggacugguuggcgauacgccccggaagaccgacucaaguagcuccucucacugccuugauccuaauaacgaagagggugggcauggagugaaaggcugggcuuucgacgauggcaaugacgucuggauggggcgcacaaucagcgaaaaguugcgacugggauaugagacuuuuaaagugauugaggguuggucaaacccaaauaguaagcuacagaucaacagacagguaauuguugauaggggcaaucgguccggguacagcggaauauucucuguggaaggcaaaucauguaucaaccguugcuuuuaugucgagcucauucgcgguagaaaggaagagaccgaagugcuguggacaaguaauagcaucgucguguucugugggacuuccggcaccuacggaacaggcucuuggcccgacggggccgauaucaaccuuaugccuauuuga

SEQ ID NO: 138590 - RNA, 1410 nt, Artificial Sequence
  derived and/or modified sequence opt3 from neuraminidase__InfluenzaA__ACI32811
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaaguccaaacugcagauuaacagacaggugauaguagacaggggcaaucggagcggguauucuggaaucuucucaguugagggcaagaguuguauuaaccguugcuuuuacguggaacuaauccgcgguagaaaggaggaaacugagguccucuggaccagcaauuccaucguggucuucugugggacaucuggcacuuauggaaccggcucguggcccgauggggccgacauuaaccugaugccuauauga

SEQ ID NO: 138591 - RNA, 1410 nt, Artificial Sequence
  derived and/or modified sequence opt3 from neuraminidase__InfluenzaA__ACI32812
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccguugugucauggaguaaagauauccugaggacgcaggagagcgaaugugucugcauuaauggcacuuguacaguggugaugaccgacggcucugcuuccgggaaggcaaacacuaaaauacucuuuaucgaggagggaaagauuguccacacaucaaccuuaagcgguagugcccaacacguugaagagugcucuugcuauccucgguacccaggcgugcgcuguguaugcagagauaacuggaagggguccaauaggccgaucguggacauaaacauuaaaaauuacagcaucgucucgucuuauguguguuccggacugguuggcgacacgccccggaagaccgauucaaguagcuccucucauugccuugacccuaacaaugaagagggugggcacggagugaaaggcugggcuuucgaugacggcaacgaugucuggauggggcgcacaaucagcgaaaaguugcgacugggauacgagacuuuuaaagugauugaggguuggucaaauccaaacaguaagcuacagaucaauagacagguaauuguugacaggggcaaccgguccggguauagcggaauauucucuguggaaggcaaaucauguaucaaucguugcuuuuacgucgagcucauucgcgguagaaaggaagagaccgaagugcuguggacaaguaacagcaucgucguguucugugggacuuccggcaccuauggaacaggcucuuggcccgauggggccgacaucaaucuuaugccuauuuga

SEQ ID NO: 138592 - RNA, 1410 nt, Artificial Sequence; identical to SEQ ID NO: 136815
  derived and/or modified sequence opt3 from neuraminidase__InfluenzaA__ACI32814

SEQ ID NO: 138593 - RNA, 1350 nt, Artificial Sequence
  derived and/or modified sequence opt3 from neuraminidase__InfluenzaA__ACJ53848
augaaccccaaucagaagaucauuaccauaggcagcaucugcauggugauugggaucgucucccugaugcuccaaauuggaaacaugaucucuauauggguuucacacaguauccagacagguaaucagugucaggccgagccuauuagcaacacuaaauuccuuacggaaaaggcuguggcauccguaacccuggccggcaauucuucguugugcccaaucucagggugggcgguguacagcaaagacaacaguauuagaaucggauccaggggcgaugucuuugugauacgggagccguucauuucuuguagccauuuagaaugccgcacauuuuuccugacucaaggugcucuacucaaugacaagcacuccaacgggaccguuaaagaucgaucaccccaucguacacugaugaguuguccugugggagaggccccaagccccuauaauucuagauuugaauccgucgcauggucagccagcgcuugccacgacggcaccaguuggcuuacuaucggcauuucugggccugauaacggagcaguggccguacugaaguacaaugguaucaucacagacaccauuaaguccuggaggaacaauauauugcggacgcaggagagcgagugugcuugcguuaacggcucguguuucacugugaugaccgaugggccaucuuccggacaggccucauauaaaaucuuuaagauggaaaaaggcaaggucgugaaaaguguggagcucgacgcgcccaauuaccauuaugaagagugcagcuguuacccugaugccggugagauuacaugcgucugccgcgacaacuggcacggguccaacagaccauggguuucuuucaaucagaaccuggaauaucaaaucggauacauauguagcggcguguuuggcgauaauccgaggcccaacgacgggacuggaucaugcgguccuguaaguccaaauggcgcauacggggugaagggauucuccuuuaaguauggcaacggugucuggauugggcggaccaaaagcacaaauucucgcucaggcuucgagaugaucugggaucccaacggauggaccggcacggacaguagcuuuuccgugaagcaggacaucguugcuauuacugauuggucuggguacucgggauccuucgugcagcacccugaacugacaggucucgacuguauccgaccaugcuucugggucgaguuaauuagaggcaggcccaaagaauccaccauauggacuucagggaguucuaucagcuuuuguggagugaauagcgauacaguaucauggagcuggccggacggcgccgagcugccuuucaccauugauaaguga

SEQ ID NO: 138594 - RNA, 1350 nt, Artificial Sequence
  derived and/or modified sequence opt3 from neuraminidase__InfluenzaA__ACJ53849
augaaccccaaucagaagaucauuaccauaggcagcaucugcauggugauugggaucgucucccugaugcuccaaauuggaaacaugaucucuauauggguuucacacaguauccagacagguaaucagugucaggccgagccuauuagcaacacuaaauuccuuacggaaaaggcuguggcauccguaacccuggccggcaauucuucguugugcccaaucucagggugggcgguguacagcaaagacaacaguauuagaaucggauccaggggcgaugucuuugugauacgggagccguucauuucuuguagccauuuagaaugccgcacauuuuuccugacucaaggugcucuacucaaugacaagcacuccaacgggaccguuaaagaucgaucaccccaucguacacugaugaguuguccugugggagaggccccaagccccuauaauucuagauuugaauccgucgcauggucagccagcgcuugccacgacggcaccaguuggcuuacuaucggcauuucugggccugauaacggagcaguggccguacugaaguacaaugguaucaucacagacaccauuaaguccuggaggaacaauauauugcggacgcaggagagcgagugugcuugcguuaacggcucguguuucacugugaugaccgaugggccaucuuccggacaggccucauauaaaaucuuuaagauggaaaaaggcaaggucgugaaaaguguggagcucgacgcgcccaauuaccauuaugaagagugcagcuguuacccugaugccggugagauuacaugcgucugccgcgacaacuggcacggguccaacagaccauggguuucuuucaaucagaaccuggaauaucaaaucggauacauauguagcggcguguuuggcgauaauccgaggcccaacgacgggacuggaucaugcaguccuguauccccaaauggugcauacggcgugaagggguucagcuuuaaguauggaaacggcgucuggauuggucggaccaaaucuacaaauucacgcaguggguucgagaugaucugggaucccaacggcuggaccggaacggacagcuccuuuucugugaagcaggacaucguugcuauuacugauuggucgggcuacagcggguccuucgugcagcacccugaacugacaggacucgacuguauccgaccaugcuucugggucgaguuaauuagagguaggcccaaagaaucaaccauauggacuucaggcucuagcaucuccuuuuguggggugaauagugauacaguaagcuggucuuggccggacggagccgagcugccuuucaccauugauaaguga

SEQ ID NO: 138595 - RNA, 1350 nt, Artificial Sequence
  derived and/or modified sequence opt3 from neuraminidase__InfluenzaA__ACJ53853
augaaccccaaucagaagaucauuaccauaggcagcaucugcauggugauugggaucgucucccugaugcuccaaauuggaaacaugaucucuauauggguuucacacaguauccagacagguaaucagugucaggacgagccuauuagcaacacuaaauuccuuacggaaaaggccguggcuuccguaacccuggcaggcaauucuucguugugcccaaucucagggugggccguguacagcaaagauaacaguauuagaaucggauccaggggcgacgucuuugugauacgggagccguucauuucuuguagccauuuagaaugccgcacauuuuuccugacucaaggugcgcuacucaaugauaagcacuccaacgggaccguuaaagaccgaucaccccaucguacacugaugaguuguccugugggagaggcuccaagccccuauaauucuagauuugaauccgucgccuggucagcaagcgccugccacgauggcaccaguuggcuuacuaucggcauuucugggccugacaacggagcuguggcaguacugaaguacaaugguaucaucacagauaccauuaaguccuggaggaacaauauauugcggacgcaggagagcgagugugccugcguuaacggcucguguuucacugugaugaccgacgggccaucuuccggacaggcuucauauaaaaucuuuaagauggaaaaaggcaaggucgugaaaaguguggagcucgaugcccccaauuaccauuaugaagagugcagcuguuacccugacgcgggugagauuacaugcgucugccgcgauaacuggcacggguccaacagaccauggguuucuuucaaucagaaccuggaauaucaaaucggauacauauguagcggcguguuuggcgacaauccgaggcccaacgaugggacuggaucaugcgguccuguauucccaaauggcgcauacggggugaagggauuuaguuucaaguauggcaacggugucuggauugggcggaccaaauccacaaauagccgcucuggcuuugagaugaucugggaccccaacggauggaccggcacggacucaaguuucagcgugaagcaggauaucguugccauuacugacugguccggguacucuggaucguucgugcagcacccugaacugacaggucucgauuguauccgaccaugcuuuugggucgaguuaauuagaggcaggcccaaagaaagcaccauauggacuuccgggucaaguaucucuuucuguggagugaauagcgacacaguauccuggucauggccggauggcgcugagcugccuuuuaccauugacaaguga

SEQ ID NO: 138596 - RNA, 1350 nt, Artificial Sequence; identical to SEQ ID NO: 138595
  derived and/or modified sequence opt3 from neuraminidase__InfluenzaA__ACJ53866

SEQ ID NO: 138597 - RNA, 1350 nt, Artificial Sequence
  derived and/or modified sequence opt3 from neuraminidase__InfluenzaA__ACJ53867
augaaccccaaucagaagaucauuaccauaggcagcaucugcauggccauugggaucgugucccugaugcuccaaauuggaaacaugaucucucuuugggucucacacaguauacagacagguaaucagugucaggcugagccuaucagcaacacuaaauuccugacggaaaaggcaguugccuccgugaccuuggcgggcaauucuucguuaugcccaauuucagggugggcuguauacagcaaagacaacaguaucagaauuggauccaggggcgauguguuugucauccgggagccguucauaucuuguagccaucuggaaugccgcacauuuuuccuaacucaaggugcccuccugaaugacaagcacuccaacgggaccgugaaagaucgaucaccccaucguacacuuaugaguuguccuguuggagaggcaccaagccccuauaauucuagauuugaauccguggccuggucagcuagcgcaugccacgacggcaccaguuggcugacuauuggcaucucugggccugauaacggagccgucgcuguguugaaguacaaugguauuaucacagacaccaucaaguccuggaggaacaauauucuccggacgcaggagagcgagugugccugcguaaacggcucguguuucacuguuaugaccgaugggccaucuuccggacaggcgucauauaaaauauuuaagauggaaaaaggcaagguggucaaaaguguggagcuggacgcacccaauuaccauuaugaagagugcagcuguuacccugaugccggugagaucacaugcgugugccgcgacaacuggcacggguccaacagaccaugggucucuuucaaucagaaccuggaauaucaaauuggauacaucuguagcggcguuuuuggcgauaauccgaggcccaacgacgggacuggaucaugcgguccugugaguccaaauggcgcuuacgggguaaagggauucuccuuuaaguauggcaacgguguguggauagggcggaccaaaagcacaaauucucgcucaggcuucgagaugauuugggaucccaacggauggaccggcacggacaguagcuuuuccgucaagcaggacaucguggccaucacugauuggucuggguacucggguagcuucguucagcacccugaacucacaggauuagacuguauucgaccaugcuucuggguggagcugaucagaggcaggcccaaagaauccaccauuuggacuucagggaguucuaucagcuuuuguggagucaauuccgauacagugucauggagcuggccggacggcgcagagcuuccuuucaccauagauaaguga

SEQ ID NO: 138598 - RNA, 1350 nt, Artificial Sequence
  derived and/or modified sequence opt3 from neuraminidase__InfluenzaA__ACJ53875
augaaccccaaucagaagaucauuaccauaggcagcaucugcauggugauugggaucgucucccugaugcuccaaauuggaaacaugaucucuauauggguuucacacaguauccagacagguaaucagugucaggccgagccuauuagcaacacuaaauuccuuacggaaaaggcuguggcauccguaacccuggccggcaauucuucguugugcccaaucucagggugggcgguguacagcaaagacaacaguauuagaaucggauccaggggcgaugucuuugugauacgggagccguucauuucuuguagccauuuagaaugccgcacauuuuuccugacucaaggugcucuacucaaugacaagcacuccaacgggaccguuaaagaucgaucaccccaucguacacugaugaguuguccugugggagaggccccaagccccuauaauucuagauuugaauccgucgcauggucagccagcgcuugccacgacggcaucaguuggcuuaccauuggcaucucugggccugauaacggagcaguggccguacugaaguacaaugguaucauuacugacacaauaaaguccuggaggaacaauaucuugcggacccaggagagcgagugugcuugcguuaacggcucguguuucacggugaugacugaugggccaucuuccggacaggccucauauaaaauuuuuaagauggaaaaaggcaaggucgugaaaaguguggagcucgaagcgcccaauuaccauuaugaggagugcagcuguuacccugacgccggugaaauaaccugcgucugccgcgauaacuggcacggguccaacagaccauggguuucuuucaaucagaaccuggaguaucaaaucggauacauuuguagcggcguguuuggcgacaauccgaggcccaacgaugggacaggaucaugcgguccuguaaguccaaauggcgcauacggggugaagggauucuccuuuaaguauggcaacggugucuggaucgggcggacuaaaagcaccaauucucgcucaggcuucgaaaugaucugggaccccaacggauggacaggcaccgauaguagcuuuuccgugaagcaggacauuguugcuaucacggacuggucuggguacucgggauccuucgugcagcacccugagcugacuggucucgauuguauucgaccaugcuucugggucgaauuaauaagaggcaggcccaaagaguccacaaucuggaccucagggaguucuauuagcuuuuguggagugaauagcgacacuguaucauggagcuggccggauggcgccgagcugccuuucacaaucgacaaguga

SEQ ID NO: 138599 - RNA, 1350 nt, Artificial Sequence
  derived and/or modified sequence opt3 from neuraminidase__InfluenzaA__ACJ53876
augaaccccaaucagaagaucauuaccauaggcagcaucugcauggugauugggaucgucucccugaugcuccaaauuggaaacaucauaucuaucuggguuucacacaguauucagacagguaaucagugucaggccgagccuaucagcaacacuaaauuccuuacggaaaaggcuguggcauccguaacccuggccggcaauucuucguugugcccaauuucagggugggcgguguacagcaaagacaacaguaucagaauaggauccaggggcgaugucuuugugauucgggagccguucaucucuuguagccauuuagaaugccgcacauuuuuccugacucaaggugcucuacucaaugacaagcacuccaacgggaccguuaaagaucgaucaccccaucguacacugaugaguuguccugugggagaggccccaagccccuauaauucuagauuugaauccgucgcauggucagccagcgcuugccacgacggcaccaguuggcuuacuauuggcaucucugggccugauaacggagcaguggccguacugaaguacaaugguaucauuacagacaccauaaaguccuggaggaacaauaucuugcggacgcaggagagcgagugugcuugcguuaacggcucguguuucacugugaugaccgaugggccaucuuccggacaggccucauauaaaauuuuuaagauggaaaaaggcaaggucgugaaaaguguggagcucgacgcgcccaauuaccauuaugaagagugcagcuguuacccugaugccggugagaucacaugcgucugccgcgacaacuggcacggguccaacagaccauggguuucuuucaaucagaaccuggaauaucaaauaggauacauuuguagcggcguguuuggcgauaauccgaggcccaacgacgggacuggaucaugcgguccuguaaguccaaauggcgcauacggggugaagggauucuccuuuaaguauggcaacggugucuggaucgggcggaccaaaagcacaaauucucgcucaggcuucgagaugaucugggaucccaacggauggaccggcacggacaguagcuuuuccgugaagcaggacauuguugcuaucacugauuggucuggguacucgggauccuucgugcagcacccugaacugacaggucucgacuguauucgaccaugcuucugggucgaguuaauaagaggcaggcccaaagaauccaccaucuggacuucagggaguucuauuagcuuuuguggagugaauagcgauacaguaggcuggucauggccggacggugccgagcugccuuucaccaucgauaaguga

SEQ ID NO: 138600 - RNA, 1404 nt, Artificial Sequence
  derived and/or modified sequence opt3 from neuraminidase__InfluenzaA__ACJ67535
augaaccccaaucagaagaucauugcccugggcagcguguccauaaccaucgcuacaauuugccucaucaugcaaauugcaguccuugccacuacgaugacccugcacuucaacgaguguacaaauccuucuaacaaucaggcgaugccaugcgaaccgaucauaaucgagagaaacaugacugaaauuguucauuugaauaacaccacaaucgagaaagaaucaugucccaagguggcugaguacaaaaauuggaguaagccucagugccagauuaccggguuugccccauucagcaaagacaacuccaucagguuaucugcaggaggugauauauggguaacucgggagcccuaugugucguguggccuggggaauugcuaccaauuugcccuaggacagggcacaacccucaacaauaagcacucaaacgacacgauucaugaucgcagcccucaccgaacucugcuuaugaaugaacugggugucccauuccauuuggggaccaaacagguguguaucgcuuggaguuccucuagcugccacgacggaaaggcauggcuccacguuugugugacaggcgaugaccguaacgccacugcuuccauuaucuaugauggcaugcugaccgacucaaucgggaguuggagcaagaacauucugagaacacaggagucugaaugcgucuguauaaauggaaccugcacggugguaaugacugaugguuccgccucaggcagggcggacacaaaaauccucuuuauucgggaggggaagaucguucauauaagccccuuaaguggaucugcacaacacguggaggaaugcuccuguuacccucgcuauccagaggucagaugcguguguagggauaacuggaaaggcagcaaucggccggugcuguacauuaacgucgccgacuauucgguugauucuuccuacgugugcucaggucuuguaggggacacuccccgcaaugacgauaguagcuccucuagcaacugucgagacccuaauaacgaaagaggaggcccaggcgugaaggggugggcuuucgauaauggaaacgacgucuggauggguaggaccaucaagaaagauucacggaguggcuacgagacauuucgugugguugggggauggaccacggccaauuccaagagccagaucaaccgccaggugauugucgacucugauaauuggucaggcuauagugguaucuucagcguggaagggaaaaccugcauuaacagauguuuuuacguagaguugauaaggggccggccccaggagacacgaguuugguggacuuccaauucuaucauuguguucugcggaaccucgggcacauaugggacuggaagcuggccugacggugcaaacaucaacuuuauguccaucuga

SEQ ID NO: 138601 - RNA, 1410 nt, Artificial Sequence
  derived and/or modified sequence opt3 from neuraminidase__InfluenzaA__ACK99424
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugaucccgugccagcccacuauaaucgaaagaaacauuaccgagaucguauauuugacaaauaccacuauugaaaaggagaucuguccuaaauuaguggaauacaggaacuggaguaagccacaaugcaaaauaacaggguucgcacccuuuagcaaggacaauuccauucggcugucugccggaggugauaucugggucacccgcgagccuuaugugucgugugacccaucaaagugcuaccaguucgcgcuaggccaggggacgacucucaacaaucgacauagcaacgauaccguucacgaccguacacccuauagaacucugcuuaugaaugagcugggagugccuuuucauuugggcaccaaacaggucuguauugcuuggaguuccucuagcugccacgaugguaaggccuggcuccauguguguguaacagggcacgacgaaaacgcaaccgccuccuucaucuacgauggaaggcugguugacucaaucggcaguuggagcaaaaauauucugcggacgcaagagucugaaugcguguguauaaacggcacuugcacagucgugaugaccgauggguccgcuucagagcgcgcagacacuaagauccucuuuauugaggaaggaaaagugguccacaucagcccauuaagugguucugcccagcauguugaggaaugcuccuguuauccgagauaccccggcgugaggugcguaugucgggauaauuggaaggggagcaaccgcccuauaguggacauuaacgucaaggauuacucgaucgugucuuccuauguuugcucaggacuggugggcgacacaccacgaaagaaugacaguagcuccucuagcuacuguagaaaccccaauaacgagaaagguucacacggggucaaaggaugggcuuucgaugacggcaaugauguguggaugggcaggaccaucagugaggaacuucgguccggguaugagacguuuaagguaauuggagguuggagcaccccuaacucuaaauugcagaucaaucgucagguuauuguggacucaggcaaccgcaguggguacagcggaauauucuccgucgaaggcaagucuugcaucaauagauguuuuuauguggagcugauuaggggucggaaacaagaaacaaaggucugguggacuucgaacagcaucgugguuuucugcgggaccuccggcacauacggaacuggcucauggccagauggggccgacaucaaucuaaugcccauuuga

SEQ ID NO: 138602 - RNA, 1410 nt, Artificial Sequence; identical to SEQ ID NO: 138421
  derived and/or modified sequence opt3 from neuraminidase__InfluenzaA__ACK99435

SEQ ID NO: 138603 - RNA, 1413 nt, Artificial Sequence
  derived and/or modified sequence opt3 from neuraminidase__InfluenzaA__ACK99446
augaaccccaaucagaagaucauuaccauaggcagcaucuccauggccauugggaucauuucucugacacuccaaaucggaaacauaaucucaauuugggugagucacagcauccagacugguucccagaaucauacgggcauuugcaaccagagaaucauaaccuacgaaaauucuacaugggucaaccaaacuuauguuaauauuaacaauaccaacgugguagcugggaaagacaagacaucggugacccuugcaggaaauucaagccuguguccuaucaggggcugggccauuuacacuaaagauaacaguauccggaucgguuccaagggggacgucuucgugauucgcgagccauuuauaucuugcagccacuuggagugucgaacauucuuuuuaacccagggagcgcugcuaaaugauaaacauuccaacggcacgguuaaggaccguucaccgcacagagcucucaugaguugcccccugggcgaagccccuagcccauauaauucuagguucgaguccguggcauggucagccagcgcuugucaugaugggaugggauggcuuacuaucgguauuaguggccccgacgauggggcagucgccgugcugaaguacaacggaaucauaaccgaaacaauuaaaucuuggaagaaacggaucuugcgcacucaggaguccgagugcguauguguuaacggcagcugcuuuaccaucaugacagacgguccuucgaauggggcugccucuuauagaauuuucaagaucgaaaaaggaaaggugaccaaguccauugagcucgaugcgccaaacucacacuacgaagaguguaguugcuaucccgacacgggcacugucaugugugugugcagggauaauuggcacggcagcaaccggccuuggguguccuuuaaucagaaccuggacuaccaaauaggguacaucugcucuggagucuucggugauaauccacgcccgaaagacggcaaggggagcuguaaccccguuacaguggacggagcagauggcguaaaagguuuuucauaucgauacgggaauggcguguggauuggaagaaccaagaguaacagguuccggaaaggcuuugagaugaucugggacccuaauggguggacugauacagacuccgauuucagcgucaagcaggacgugguugccaugaccgauuggucuggauauucagguaguuuugugcagcauccagaacugacgggccucgacugcaugcgucccuguuucugggucgaguuagugcgcgggagaccuagggaaaacaccacaaucuggacuagcggauccucuauuucguucugcggcguaaauagcgauaccgcuaacugguccuggccagacggugccgagcugcccuuuacaauagauaaauga

SEQ ID NO: 138604 - RNA, 1410 nt, Artificial Sequence
  derived and/or modified sequence opt3 from neuraminidase__InfluenzaA__ACK99457
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugaugccgugcgaacccacuaucauagagagaaauaucaccgaaauuguauacuugacaaacaccacuaucgagaaggaaauuuguccuaaauuaguggaguauaggaauuggucaaagccacagugcaaaaucacaggguucgcacccuuuaguaaggacaacagcauacggcuguccgccggaggugauauuugggucacccgcgagccuuacgugucuugugacccaggcaagugcuaucaauucgcgcuagggcagggaacgacucucaauaaccgacacucgaaugauaccguucaugaccguacacccuacagaacucugcuuaugaacgaacugggcgugccuuuucacuuggguaccaaacaggucuguaucgcuuggucaagcaguuccugccaugaugggaaggccuggcuccacguguguguaacaggacacgacgagaaugcaaccgccucuuucauuuaugauggcaggcugguugacagcaucguguccuggaguaaaaacauccugcggacgcaggaaucagagugcgucuguauuaauggcacuugcacaguggugaugaccgaugggagcgcuucugagcgcgcagacacuaagauacucuuuaucgaagagggaaaaauuguccauaucuccccauuaucagguagcgcccaacacguugaagagugcaguuguuacccgagauaucccggcgugaggugcguaugucgggauaacuggaaggggucuaaccgcccuauaguggacauuaaugucaaggauuacuccaucgugagcucguacguuugcucuggacuggugggcgacacaccacgaaagaacgacuccucaaguagcuccuauuguagaaaucccaacaaugaaaaagguucucauggggucaaaggaugggcuuucgaugacggcaacgauguguggaugggcaggaccaucggggaggagcuucggagcggauacgaaacguuuaagguaauugguggcuggucaaccccuaauaguaaauugcagacaaaccgucagguuaucguggaccgcgggaauagauccggauauagcggcauuuucucugucgaggguaagucaugcauaaacagguguuuuuacguggaacugauccgggggcgaaaacaggagacuaaggucugguggaccaguaauagcauugugguuuucugcggcacauccggaacuuauggcaccgggucuuggccagauggagccgacaucaaccuaaugcccaucuga

SEQ ID NO: 138605 - RNA, 1413 nt, Artificial Sequence
  derived and/or modified sequence opt3 from neuraminidase__InfluenzaA__ACK99468
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaaccaaacauaugucaauauuaacaauacuaacguuguggcagggaaagacaagaccucgaugacacuugccggaaauucaagccuguguccuaucaggggcugggcgaucuacaccaaagauaacaguauucggauagguuccaagggggacguauucgugauccgcgagccauuuauuucuugcagccacuuggagugucgaacuuucuuuuuaacacagggagcucugcuaaaugauaaacauuccaacggcaccgucaaggaccguucaccguauagagcccucaugaguugcccccugggcgaagcaccuagcccauacaauucuagguucgaguccguggccuggucagcuagcgcaugucacgaugggcuuggauggcugacgaucgguauaaguggccccgacaacggggccguugcuguguugaaguauaacggaauuaucacugaaaccaucaaaucuuggaagaaacggauucuccgcacacaggaguccgagugcgucuguaugaauagcucgugcuuuacuaucaugaccgauggcccuucuaacggugccgcguccuacagaauuuucaagauagaaaaagggagggugacaaagucaaucgagcuggacgcaccaaauuaucauuacgaagaguguaguugcuaccccgauaccggaacgguaauguguguuugccgggacaacuggcacggcagcaaucgcccuuggguguccuuuaaccagaaucuggauuaucaaauuggcuacaucugcucuggggucuucggagacaacccacgaccgaaggauggugagggcagcuguaaucccgugacuguggacggggccgacggagucaaaggcuuuucauauagauacgguaacgggguuuggaucggcaggacaaagaguaaucggcuccguaaaggauucgaaaugauuugggauccuaacggcuggaccgacacugauuccgacuuuagcaugaagcaggauauaguggcuaugacagacuggucuggguauucaggaaguuucguacagcacccagaguuaaccggucuggauugcaugcgccccuguuuuuggguggaacuugucagaggcuugccuagggagaauacgaccaucuggacaagcggguccucuauuucguucugcggagugaacagcgacacugccaauugguccuggccagauggcgcagaacugcccuucaccaucgacaaauga

SEQ ID NO: 138606 - RNA, 1410 nt, Artificial Sequence
  derived and/or modified sequence opt3 from neuraminidase__InfluenzaA__ACK99479
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaaaaucacaggguucgccccauuuaguaaggacaacagcauacggcuauccgcgggaggugauauuugggugacccgcgagcccuaugucucuugugacccugauaagugcuaccaauucgcucucggccaggggacgacucugaauaaccgacauucgaaugacaccgugcacgaucguacaccauauagaacucuucugaugaacgaauugggaguucccuuucaucucggcaccaaacagguguguaucgccuggucaagcaguuccugccacgacgguaaggcauggcugcaugucugugugacagggcacgaugagaaugccaccgcuucuuucauuuacgacggaaggcugguagauagcaucggcuccuggaguaaaaagauccuccggacgcaggaaucagagugcguuuguauuaacggcacuugcacaguggucaugaccgacgggagcgcaucuggacgcgccgauacuaaaauauuauuuaucgaggaagguaagauugugcacaucuccccucugcuuggcucagcucaacauguggaggaaugcagcuguuauccaagauacccgggggucaggugcguuugucgggacaauuggaagggaaguaaccgccccauaguggauauuaacguaaaagacuacucuaucguguccagcuaugucugcucgggcuuggugggugacacaccucgaaagaaugauucuuccucaaguagccacugucugaacccaaauaacgaggaagggggacauggcguuaaaggcugggccuucgacgaugggaaugacguguggaugggaagaaccaucuccgagaagcuaaggucugguuacgagacguuuaaagucauugaaggcuggagcaagcccaacucaaaacuccagaucaaucgucaggugauuguagaucgggggaaccgcaguggauauuccggcauauucagcguugaggguaagucuugcaucaauagauguuuuuacguggaacugauuagggggcggaagcaggagaccgaagucugguggacaucaaacaguaucguggucuucugcggcacuagcggaaccuauggcacaggguccuggccugacggagcgaauaucaaccuuaugccaauuuga

SEQ ID NO: 138607 - RNA, 1413 nt, Artificial Sequence; identical to SEQ ID NO: 138300
  derived and/or modified sequence opt3 from neuraminidase__InfluenzaA__ACL12066

SEQ ID NO: 138608 - RNA, 1410 nt, Artificial Sequence; identical to SEQ ID NO: 137201
  derived and/or modified sequence opt3 from neuraminidase__InfluenzaA__ACL12132

SEQ ID NO: 138609 - RNA, 1413 nt, Artificial Sequence; identical to SEQ ID NO: 138534
  derived and/or modified sequence opt3 from neuraminidase__InfluenzaA__ACL12154

SEQ ID NO: 138610 - RNA, 1410 nt, Artificial Sequence; identical to SEQ ID NO: 138528
  derived and/or modified sequence opt3 from neuraminidase__InfluenzaA__ACL12165

SEQ ID NO: 138611 - RNA, 1410 nt, Artificial Sequence; identical to SEQ ID NO: 138528
  derived and/or modified sequence opt3 from neuraminidase__InfluenzaA__ACL12176

SEQ ID NO: 138612 - RNA, 1410 nt, Artificial Sequence
  derived and/or modified sequence opt3 from neuraminidase__InfluenzaA__ACL12198
augaaccccaaucagaagaucauuaccauaggcagcgugucccugacaaucucuacuauuugcuucuuuaugcagaucgccauucucaucacgaccgucacacuucacuucaaacaguacgaguuuaacucaacuccuaauaaccagguuaugcugugugaaccaaccauaaucgagagaaauauuacagaaaucguguauuugaccaacacuacaauugagaaggaaaucugcccgaaauuagcugaguacaggaauuggaguaagccccagugugacauaaccggguucgcaccuuuuagcaaagauaacuccauucggcugucugccggaggugacaucuggguaacgcgcgagccauaugugucgugcgaucccgacaaguguuaccaauucgcgcuaggccaggggacuacccucaauaacguccauucaaaugauacagugcgagaccguacuccuuauagaacccugcuuaugaacgaacugggaguuccauuucacuugggcacaaaacaggugugcauugcuuggagcaguuccucuugucaugaugguaaggccuggcuccacgucugcaucaccggggacgauaagaaugcaacggccagcuucaucuacaacggaaggcugguggacuccguaguuucauggaguaaagagauucugcggacucaggaaagcgagugugugugcauaaauggcacauguaccgucgugaugacugauggcucugcuuccgggaaggcagacacaaaaauccucuuuauugaggaaggaaagaucgugcauaccucaacguuaagcgguagugcccaacacgucgaggaaugcucuugcuauccccgcuacccuggcguuagaugugugugcagggauaacuggaagggguccaaccggccaauaguagacauuaauaucaaagaccacagcaucgugucgucuuacgucuguuccggacuggugggcgauaccccgcgcaagaacgacucaaguagcuccucucauugccuugaucccaauaacgaggaaggugggcacggaguuaaaggcugggcuuucgacgauggcaaugacguguggauggggcgaacaauuagcgagaagucaagauugggauaugagacuuuuaaagucaucgaagguuggaguaacccuaaguccaaacugcagauuaauaggcaagugauaguagaucggggcaaccguagcggguacucuggaaucuucucaguugagggcaagaguuguauuaaucgcugcuuuuauguggaacuaaucagagguaggaaggaggaaaccgagguccucuggacaagcaacuccaucguggucuucugugggacuucuggcaccuacggaacaggcucguggccagacggggccgauauuaaucugaugcccauauga

SEQ ID NO: 138613 - RNA, 1410 nt, Artificial Sequence; identical to SEQ ID NO: 138106
  derived and/or modified sequence opt3 from neuraminidase__InfluenzaA__ACL12209

SEQ ID NO: 138614 - RNA, 1410 nt, Artificial Sequence; identical to SEQ ID NO: 138528
  derived and/or modified sequence opt3 from neuraminidase__InfluenzaA__ACL12220

SEQ ID NO: 138615 - RNA, 1410 nt, Artificial Sequence
  derived and/or modified sequence opt3 from neuraminidase__InfluenzaA__ACL12242
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaauccaaaguccaaacugcagauuaacaggcaagugauaguagaccggggcaaucguagcggguacucuggaaucuucucaguugagggcaagaguuguauuaaccgcugcuuuuauguggaacuaaucagagguaggaaggaggaaacugagguccucuggaccagcaauuccaucguggucuucugugggacaucuggcacuuacggaaccggcucguggcccgauggggccgacauuaaccugaugccuauauga

SEQ ID NO: 138616 - RNA, 1413 nt, Artificial Sequence
  derived and/or modified sequence opt3 from neuraminidase__InfluenzaA__ACL12264
augaaccccaaucagaagaucauuaccauaggcagcaucuccauggccauugggaucauuucucugauccuccaaauagugaacaucauuucaaucugggucagucacagcauucagacaggaucccagaaucauacugguaucugcaaccagagaauaauuacguacgaaaauucuaccuggguuaaccaaacauaugugaauaucaacaauacuaacguaguggcuggcaaagacaagaccucggucacacuugcaggaaauucaagccuguguccuauuagggggugggccaucuacaccaaagauaacaguauccggauuggcuccaagggugacguguucguuauacgcgagccauuuaucucuugcagccacuuggagugucgaacuuucuuuuuaacacagggggcgcugcuaaaugauaaacauuccaacggaaccgugaaggaccguucaccguauagagcucucaugaguugcccccugggcgaagccccuagcccauacaauucuagguucgaguccgucgcauggucagccagcgcuugucacgauggcaugggguggcuuacgauuggaaucaguggucccgacgauggcgcaguggccguacugaaguauaacgggauaauuacugaaaccaucaaaucuuggaagaaacggaucuugcgcacacaggaguccgagugcguuugugugaacggaagcugcuuuacuauuaugaccgacggcccuucgaauggugcugccucuuacagaaucuucaagauugaaaaagggaaggucacaaaguccauagagcucgaugcgccaaacucacauuaugaagaguguaguugcuaccccgacaccggaacggugaugugugugugcagggauaauuggcacggcagcaaccggccuugggucuccuuuaaucagaaccuggacuaccaaaucggcuauauuugcucugggguuuucggagauaauccacgcccgaaagacgguaagggcagcugugaccccgugacuguagauggggcagacggagugaaaggcuuuucauaccgauaugguaacggggucuggaucggcagaacaaagaguaauagguuccggaaaggauuugagaugaucugggauccuaacggcuggaccgacacugauuccgacuucagcgugaagcaggauguuguggccaugacagacuggucuggguacucaggaaguuuuguccagcacccagaacugaccggucucgauugcaugcgucccuguuucuggguggaguuaguacgcggcagaccuagggaaaauacgaccauuuggacaagcggguccucuauaucguucugcggaguuaacagcgacacugcuaauugguccuggccagauggcgccgagcugcccuuuaccaucgacaaauga

SEQ ID NO: 138617 - RNA, 1410 nt, Artificial Sequence; identical to SEQ ID NO: 138421
  derived and/or modified sequence opt3 from neuraminidase__InfluenzaA__ACN32275

SEQ ID NO: 138618 - RNA, 1410 nt, Artificial Sequence
  derived and/or modified sequence opt3 from neuraminidase__InfluenzaA__ACN32286
augaaccccaauaagaaaaucauuaccauaggcagcgugucccugacaaucucuacuauuugcuucuuuaugcagaucgccauucucaucacgaccgucacacuucacuucaagcaauacgaguuuaacucaccuccaaauaaccagguuaugcugugugaaccgacuauaaucgagagaaauauuaccgaaaucguguauuugacaaacaccacuauugagaaagaaaucugccccaaguuagcugaguacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaguucgcgcuaggccaagggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaaaaaugcaaccgccagcuucaucuacaacggaaggcugguggacuccauuguaucauggaguaaggagauacugcggacgcaggaaagcgaguguguuugcaucaauggcacuuguacaguggucaugaccgauggcucugcuuccgggaaagcagacacuaagauucucuuuaucgaggaaggaaagauagugcauacaucaaccuuacuggguagcgcccagcacguggaggaaugcaguugcuauccucgcuacccaggcgucagauguguuugcagggauaacuggaaagggucuaaccggccgauuguggacaucaauaucaaggaccacuccauuguaagcucguacguguguucuggacuugucggcgauacgccccgcaaaaacgacuccucaaguagcggucauugcuuggauccuaauaacgaggaagggggacacggcgugaagggcugggcuuucgacgaugggaaugacguuuggaugggacgaaccaucuccgagaaaucuagacuggguuaugagacauuuaaggugauugaaggcuggagcaacccaaaaucaaagcuacaaauaaauaggcaggucaucguggaucgggggaaccguaguggauacuccggcauuuucagcguagaggguaagucuuguaucaaucgcugcuuuuauguugaacucaucagagggaggaaagaggaaacugaggugcuguggaccucaaacaguauugucguguucuguggcacaagcggaacuuacggcaccggguccuggcccgacggagccgauauaaaucuuaugccuaucuga

SEQ ID NO: 138619 - RNA, 1410 nt, Artificial Sequence
  derived and/or modified sequence opt3 from neuraminidase__InfluenzaA__ACN32493
augaaccccaaucagaagaucauuaccauaggcagcgugucccugacaaucucuacuauuugcuucuuuaugcaaaucgccauucucaucacgaccgucacacuucacuucaaacaguacgaguuuaacucaaguccuaauaaccagguuaugcugugugaaccaacuauaaucgagagaaauauuaccgaaaucguguauuugacaaacaccacuauugagaaggaaaucugcccgaaauuagcugaguacaggaauuggagcaagccccagugugacauaacaggguucgcaccuuuuuccaaagauaacucuauucggcugucggccggaggugacaucuggguaacccgcgagccauaugugucaugcgaucccgacaaguguuaccaauucgcgcuaggccaggggacgacucucaauaacguccauagcaauaacaccgugcgagaucguacaccuuauagaacucugcuuaugaaugaacugggaguuccauuucacuugggcaccaaacaggugugcauugcuuggaguuccucuagcugucaugacgguaaggccuggcuccacgucugcaucacaggggaugacaagaacgcaaccgccuccuucaucuacaauggaaggcugguggauucaauuguaaguuggagcaaagagauacugcggacgcaggaaucugaguguguuugcaucaacggcacuuguacaguggucaugaccgacggcuccgcuucagggaaggcagauacuaaaauucucuuuaucgaggaaggaaagauagugcauacaagcaccuuaagugguucugcccaacacguggaggaaugcuccugcuauccccgcuacccuggcgucagauguguuugcagggacaacuggaaggggagcaaucggccaauuguggauaucaacaucaaagaccacucgauuguaucuuccuacguguguucaggacuggucggcgacacgccgcgcaagaaugauaguagcuccucuagccauugccuugaccccaacaaugaggaaggugggcacggagugaaaggcugggcuuucgaugacggcaacgauguuuggauggggcgaaccaucucagagaagaguagauugggauaugagacauuuaaagugauugaagguugguccaauccuaagagcaaacugcagauaaacaggcaggucaucguggaccggggcaaucguucuggguacucaggaauuuucaguguagagggcaagagcuguaucaaccgcugcuuuuauguugaacuaaucagagguaggaaggaggaaacugaggugcucuggaccuccaauucuauugucguguucugugggacaucgggcacuuacggaaccggcagcuggccagauggggccgacauaaaccugaugcccaucuga

SEQ ID NO: 138620 - RNA, 1410 nt, Artificial Sequence; identical to SEQ ID NO: 136170
  derived and/or modified sequence opt3 from neuraminidase__InfluenzaA__ACN32526

SEQ ID NO: 138621 - RNA, 1410 nt, Artificial Sequence
  derived and/or modified sequence opt3 from neuraminidase__InfluenzaA__ACN32537
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccagacagguguguaucgccuggucaagcaguuccugccacgacgggaaggcauggcugcaugucugugugacaggagaugacgagaacgccaccgcuucuuucauuuacaauggcaggcugguagauagcaucggcuccuggaguaaaaagauccuccggacgcaggaaucagagugcguuuguauuaacgggacuugcacaguggucaugaccgacggaagcgcaucugguaaagccgauacuaagauauuauuuaucgaggaaggcaaaauugugcacaucuccacacugucagggagcgcucaacacguggaggaaugcaguuguuauccucgcuacccagacgucagaugcguuuguagggauaacuggaagggaucuaaucggccgauaguggacauuaacguaaaggacuacuccaucgugagcucguaugucugcucuggccuugugggugauacccccaggaaaaaugacuccuucucaaguagccauuguuuggauccuaacaaugaggaagggggacacggcguuaagggcugggccuuugacgaugggaacgacguguggaugggacgaacgaucuccgagaaacugagaucugguuacgagaccuucaaggucauugauggcuggagcaaaccaaauucaaagcuacagaucaaccgccaggugauuguagaacgggggaaucguaguggauauuccggcauauuuagcguugaggguaaaucuugcaucaaccgcuguuucuacguggaacucauuagagggaggaaggaggaaacagaggucugguggacuucaaauaguaucguggucuuuugcggcaccagcggaacauauggcacuggguccuggcccgacggagcggauaucaaccugaugccuauuuga

SEQ ID NO: 138622 - RNA, 1413 nt, Artificial Sequence; identical to SEQ ID NO: 138098
  derived and/or modified sequence opt3 from neuraminidase__InfluenzaA__ACN32807

SEQ ID NO: 138623 - RNA, 1413 nt, Artificial Sequence; identical to SEQ ID NO: 138046
  derived and/or modified sequence opt3 from neuraminidase__InfluenzaA__ACN32818

SEQ ID NO: 138624 - RNA, 1413 nt, Artificial Sequence; identical to SEQ ID NO: 138046
  derived and/or modified sequence opt3 from neuraminidase__InfluenzaA__ACN32829

SEQ ID NO: 138625 - RNA, 1413 nt, Artificial Sequence
  derived and/or modified sequence opt3 from neuraminidase__InfluenzaA__ACN32840
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguuguggcagggaaagacaagaccucaguaacacuugccggaaacagcagucuguguuccauuucuggcugggcgaucuacaccaaagauaauagcaucaggauugguuccaagggggacguguucgucauacgggagccuuuuaucucaugcagucauuuggagugucgcacuuucuuuuuaacacaaggagcucugcuaaacgauaaacacagcaauggcaccgugaaggaccgaucuccauaucgugcccucauguccugcccgcugggcgaagcacccucaccuuacaacagcaaguucgagaguguugccuggucugcuuccgcaugucaugaugggaugggauggcuuacgauugguaucagcggcccagacaauggggccguggcuguccugaaauauaacggaauaauuacugaaaccaucaagucguggaaaaagagaaucuugaggacacaggagucugagugcguguguguaaacggcuccugcuuuacuauuaugaccgauggucccucaaauggggccgcgaguuacaaaaucuucaagauugaaaagggaaaaguuacaaagagcauagagcucaacgcaccuaauuuucacuaugaagaguguuccugcuacccagacaccggcacggugaugugugucugccgggauaacuggcacggcucuaaucgccccugggugagcuucaaccagaaucuggacuaccagaucggguauauuugcucaggaguguuuggugauaacccuagaccaaaagacggcaaggggaguuguaauccggucacuguugauggagccgacggcgugaaagguuucuccuacaaguaugggaacggcguauggaucggaaggacaaaaagcaaucggcugcgcaagggcuuugagaugaucugggaccccaacggguggaccgauacugacucugauuucucagugaagcaagacgucguggcuauuacagauuggaguggauacagcgguuccuuuguucagcauccugaacucaccggcuuagacugcauacgaccauguuucuggguggagcuggucagagggcuucccagggaaaauacgaccaucuggacaucuggaucgagcauuuccuucugcggcguggauucagacacuguaaacuggaguuggccugauggugccgaguugccauuuaccaucgacaaauga

SEQ ID NO: 138626 - RNA, 1410 nt, Artificial Sequence; identical to SEQ ID NO: 138528
  derived and/or modified sequence opt3 from neuraminidase__InfluenzaA__ACN32851

SEQ ID NO: 138627 - RNA, 1410 nt, Artificial Sequence; identical to SEQ ID NO: 138615
  derived and/or modified sequence opt3 from neuraminidase__InfluenzaA__ACN32862

SEQ ID NO: 138628 - RNA, 1410 nt, Artificial Sequence; identical to SEQ ID NO: 138619
  derived and/or modified sequence opt3 from neuraminidase__InfluenzaA__ACN32873

SEQ ID NO: 138629 - RNA, 1410 nt, Artificial Sequence; identical to SEQ ID NO: 138615
  derived and/or modified sequence opt3 from neuraminidase__InfluenzaA__ACN32884

SEQ ID NO: 138630 - RNA, 1410 nt, Artificial Sequence; identical to SEQ ID NO: 138619
  derived and/or modified sequence opt3 from neuraminidase__InfluenzaA__ACN32895

SEQ ID NO: 138631 - RNA, 1410 nt, Artificial Sequence; identical to SEQ ID NO: 138528
  derived and/or modified sequence opt3 from neuraminidase__InfluenzaA__ACN32906

SEQ ID NO: 138632 - RNA, 1410 nt, Artificial Sequence
  derived and/or modified sequence opt3 from neuraminidase__InfluenzaA__ACN32917
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcuguguaagccgacuauaaucgaaagaaauauuaccgagaucguguauuugacaaacaccacuauugaaaaagagaucugccccaaguuagcugaauacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugagcugggaguucccuuucacuugggcaccaaacaggugugcauugcuuggagcaguuccucuugucaugacgguaaggccuggcuccacgucugcaucacaggggaugacaaaaacgcaaccgccagcuucaucuacaauggaaggcugguggauuccguaguuucauggaguaaggaaauucugcggacgcaggagagcgaaugugugugcauaaacggcacuuguacagucgugaugaccgacggcucugcuuccgggaaagcagauacuaagauccucuuuauugaggagggaaagaucgugcauacaucaaccuuaagcgguagugcccaacacgucgaagagugcucuugcuauccucgcuacccaggcguuagaugugugugcagggacaacuggaaaggguccaaucggccgauaguagauauuaacaucacggaccacagcaucgugucgucuuacgucuguuccggacuggugggcgacacccccaggaagaaugauucaaguagcuccucucauugccuugacccuaacaaugaagagggugggcacggaguuaaaggcugggcuuucgaugacggcaacgauguguggauggggcgaacaauuagcgaaaagucaagauugggauaugagacuuuuaaagucaucgaggguuggaguaauccaaaguccaaacugcagauuaaccgccaggugauaguagaccggggcaaucguagcggguacucuggaaucuucucaguugaaggcaagaguuguauuaaccgcugcuuuuauguggagcuaaucagagguaggaaggaagagaccgaaguccucuggacaagcaauuccaucguggucuucugugggacuucuggcaccuacggaacaggcucguggcccgauggggccgacauuaaccugaugccuauauga

SEQ ID NO: 138633 - RNA, 1410 nt, Artificial Sequence
  derived and/or modified sequence opt3 from neuraminidase__InfluenzaA__ACN32928
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucacggaccacagcaucgugucgucuuacgucuguuccggacuggugggcgacacccccaggaaaaaugauucaaguagcuccucucauugccuugacccuaacaaugaggaaggugggcacggaguuaagggcugggcuuucgaugacggcaacgauguguggauggggcgaacaauuagcgagaaaucaagauugggauaugagacuuuuaaggucaucgaagguuggaguaauccaaaauccaagcugcagauuaaccgccaggugauaguagaccggggcaaucguagcggguacucuggaaucuucucaguugagggcaaaaguuguauuaaccgcugcuuuuauguggaacuaaucagagguaggaaggaggaaaccgagguccucuggacaagcaauuccaucguggucuucugugggacuucuggcaccuacggaacaggcucguggcccgauggggccgacauuaaccugaugccuauauga

SEQ ID NO: 138634 - RNA, 1410 nt, Artificial Sequence; identical to SEQ ID NO: 138619
  derived and/or modified sequence opt3 from neuraminidase__InfluenzaA__ACN32939

SEQ ID NO: 138635 - RNA, 1410 nt, Artificial Sequence; identical to SEQ ID NO: 138528
  derived and/or modified sequence opt3 from neuraminidase__InfluenzaA__ACN32950

SEQ ID NO: 138636 - RNA, 1410 nt, Artificial Sequence
  derived and/or modified sequence opt3 from neuraminidase__InfluenzaA__ACN32961
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucacggaccacagcaucgugucgucuuacgucuguuccggacuggugggcgacacccccaggaaaaaugauucaaguagcuccucucauugccuugacccuaacaaugaggaaggugggcacggaguuaagggcugggcuuucgaugacggcaacgauguguggauggggcgaacaauuagcgagaaaucaagauugggauaugagacuuuuaaggucaucgaagguuggaguaauccaaaauccaagcugcagauuaaccgccaggugauaguagaccggggcaaucguagcggguacucuggaaucuucucaguugagggcaaaaguuguauuaaccgcugcuuuuauguggaacuaaucagagguaggaaggaggaaaccgagguccucuggacaagcaauuccaucguggucuucugugggacuucuggcaccuacggaacaggcucguggcccgauggggccgacauuaacauaaugccuaucuga

SEQ ID NO: 138637 - RNA, 1410 nt, Artificial Sequence; identical to SEQ ID NO: 138615
  derived and/or modified sequence opt3 from neuraminidase__InfluenzaA__ACN32972

SEQ ID NO: 138638 - RNA, 1410 nt, Artificial Sequence; identical to SEQ ID NO: 138615
  derived and/or modified sequence opt3 from neuraminidase__InfluenzaA__ACN32994

SEQ ID NO: 138639 - RNA, 1410 nt, Artificial Sequence
  derived and/or modified sequence opt3 from neuraminidase__InfluenzaA__ACN33005
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaauggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaacuggaagggguccaaccggccgauaguagacauuaauaucaaagaccacagcaucgugucgucuuacgucuguuccggacuggugggcgauacgccccgcaagaacgacucaaguagcuccucucauugccuugauccuaauaacgaggaaggugggcacggaguuaaaggcugggcuuucgacgauggcaaugacguguggauggggcgaaccauuagcgagaagucaagauugggauaugagacauuuaaagucaucgaagguuggaguaacccaaaguccaaacugcagauuaauaggcaagugauaguagaucggggcaaccguagcggguacucuggaaucuucucaguugagggcgaaaguuguauuaaucgcugcuuuuauguggagcuaaucagagguaggaaggaagagacugagguccucuggaccagcaacuccaucguggucuucugugggacaucuggcacuuacggaaccggcucguggcccgacggggccgauauuaaucugaugccuauauga

SEQ ID NO: 138640 - RNA, 1410 nt, Artificial Sequence; identical to SEQ ID NO: 138615
  derived and/or modified sequence opt3 from neuraminidase__InfluenzaA__ACN33016

SEQ ID NO: 138641 - RNA, 1410 nt, Artificial Sequence; identical to SEQ ID NO: 138615
  derived and/or modified sequence opt3 from neuraminidase__InfluenzaA__ACN33049

SEQ ID NO: 138642 - RNA, 1410 nt, Artificial Sequence; identical to SEQ ID NO: 138615
  derived and/or modified sequence opt3 from neuraminidase__InfluenzaA__ACN33060

SEQ ID NO: 138643 - RNA, 1410 nt, Artificial Sequence; identical to SEQ ID NO: 138619
  derived and/or modified sequence opt3 from neuraminidase__InfluenzaA__ACN33082

SEQ ID NO: 138644 - RNA, 1413 nt, Artificial Sequence; identical to SEQ ID NO: 138085
  derived and/or modified sequence opt3 from neuraminidase__InfluenzaA__ACN33093

SEQ ID NO: 138645 - RNA, 1413 nt, Artificial Sequence; identical to SEQ ID NO: 138046
  derived and/or modified sequence opt3 from neuraminidase__InfluenzaA__ACN33104

SEQ ID NO: 138646 - RNA, 1410 nt, Artificial Sequence; identical to SEQ ID NO: 138619
  derived and/or modified sequence opt3 from neuraminidase__InfluenzaA__ACN33115

SEQ ID NO: 138647 - RNA, 1413 nt, Artificial Sequence
  derived and/or modified sequence opt3 from neuraminidase__InfluenzaA__ACN33126
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaucaagcagucuguguuccauuucuggcugggcgaucuacaccaaggauaacagcaucaggauugguuccaaaggggacguguucgucauacgggagccuuuuaucucaugcagucacuuggaaugucgcacuuucuuuuuaacacaaggagcucugcuaaaugauaagcauagcaacggcaccgugaaagaccgaucuccauaucgugcccucauguccugcccgcugggcgaggcacccucaccuuacaauagcaaguucgaaaguguugccuggucugcuuccgcaugucacgaugggaugggauggcuuacgauugguaucagcggcccagacaacggggccguggcuguccugaaguauaacggaauaauuacuggcaccaucaaaucguggaagaaacagaucuugagaacacaggagucugagugcguguguaugaaugguuccugcuuuacuauuaugaccgaugggcccucaaacaaggccgcgaguuacaaaaucuucaagauugaaaagggaaaaguaacaaagagcauagagcucaaugcaccuaacuuucauuaugaagaguguuccugcuacccagacaccggcaucguuaugugugugugcagggauaauuggcacggcucuaaccggcccugggucagcuucaaucagaaccuggacuaccaaauuggguauaucugcucaggaguguuuggugauaauccucgcccagaggacggcgaagggaguuguaacccggugacggucgauggagccaauggcguuaaagguuucuccuacaaguaugacaacgggguguggaucggcagaacuaaaagcaauaggcugcggaagggauuugagaugauuugggaccccaacggcuggacaaauaccgauucugacuucucaguaaaacaggauguggucgcuauaacugacuggaguggguacagcggauccuuugugcagcacccugaacucacagguuuagauugcauccgcccauguuucuggguugagcuggugcgaggccuucccagagaaaacaccacgauuuggaccucugggucgagcaucuccuucugcggagucaacucagacacagccaauuggaguuggccugauggcgcagaguugccauuuacuauugacaaguga

SEQ ID NO: 138648 - RNA, 1413 nt, Artificial Sequence
  derived and/or modified sequence opt3 from neuraminidase__InfluenzaA__ACN33148
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuucauuaugaagaguguagcugcuacccagacaccggcaucguuaugugugugugcagggauaacuggcacggcuccaaucggcccugggucucuuucaaccagaaucuggacuaccaaauuggguauaucugcagcggaguguuuggugauaacccucgcccagaggacggcgaagggucauguaauccggugacggucgauggagccaacggcguuaaagguuucaguuacaaguaugacaaugggguguggaucggcagaacuaaauccaacaggcugcggaagggauuugagaugauuugggaccccaauggcuggacaaacaccgauagcgacuucucuguaaaacaggauguggucgcuauaacugacuggucaggguacagugguagcuuugugcagcacccugaacucacaggauuagauugcauccgcccauguuucuggguugagcuggugcgaggccuucccagagaaaacaccacgauuuggaccuccgggucuucgaucagcuucugcggagucaauuccgacacagccaacuggucauggccugauggcgcagaguugccauuuacuauugacaaguga

SEQ ID NO: 138649 - RNA, 1410 nt, Artificial Sequence
  derived and/or modified sequence opt3 from neuraminidase__InfluenzaA__ACN33159
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaaaugccccaaguuagcugaguacaggaauuggaguaaaccucagugugacaucacaggguucgcaccauuuagcaaggauaacuccauacggcugucugccggaggugacauuuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcaucgcuuggagcaguuccucuugucaugacgguaaggccuggcuccacgucugcauuacaggggaugacaaaaacgcaaccgccagcuucaucuacaauggaaggcugguggauuccguaguuucauggaguaaggagauccugcggacgcaggaaagcgagugugugugcauuaacggcacuuguacagucgugaugaccgacggcucugcuuccgggaaagcagauacuaagauacucuuuaucgaggaaggaaagauugugcauacaucaaccuuaagcgguagugcccaacacgucgaggaaugcucuugcuauccucgcuacccaggcguuagaugugugugcagggacaacuggaaaggguccaaucggccgaucguagauauaaacauuaaggaccacagcaucgugucgucuuacgucuguuccggacuggugggcgacacgccccgcaaaaaugauucaaguagcuccucucauugccuugacccuaacaaugaggaaggugggcacggaguuaagggcugggcuuucgaugacggcaacgauguguggauggggcgaaccaucagcgagaaaucaagauugggauaugagacauuuaaggucauugaagguuggaguaauccaaaauccaagcugcagaucaacaggcaagugauuguagaccggggcaaucguagcggguacucuggaauauucucaguugagggcaagaguuguaucaaccgcugcuuuuauguggaacuaauuagagguaggaaagaggaaacugagguccucuggaccagcaauuccaucguggucuucugugggacaucuggcacuuacggaaccggcucguggcccgauggggccgacaucaaccugaugccuauuuga

SEQ ID NO: 138650 - RNA, 1410 nt, Artificial Sequence; identical to SEQ ID NO: 138528
  derived and/or modified sequence opt3 from neuraminidase__InfluenzaA__ACN33170

SEQ ID NO: 138651 - RNA, 1410 nt, Artificial Sequence; identical to SEQ ID NO: 138619
  derived and/or modified sequence opt3 from neuraminidase__InfluenzaA__ACN33181

SEQ ID NO: 138652 - RNA, 1410 nt, Artificial Sequence; identical to SEQ ID NO: 138619
  derived and/or modified sequence opt3 from neuraminidase__InfluenzaA__ACN33203

SEQ ID NO: 138653 - RNA, 1410 nt, Artificial Sequence
  derived and/or modified sequence opt3 from neuraminidase__InfluenzaA__ACN33214
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaacaguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaauaacacagugcgagaucguacuccauauagaacccugcuuaugaaugaacugggaguucccuuucacuugggcacaaaacaggugugcaucgcuuggagcaguuccucuugucaugacgguaaggccuggcuccacgucugcauuaccggggaugacaagaacgcaacggccagcuucaucuacaauggaaggcugguggauuccguaguuucauggaguaaagagauccugcggacucaggaaagcgagugugugugcauuaacggcacauguaccgucgugaugacugacggcucugcuuccgggaaggcagauacaaaaauacucuuuaucgaggaaggaaagauugugcauaccucaacguuaagcgguagugcccaacacgucgaggaaugcucuugcuauccucgcuacccaggcguuagaugugugugcagggacaacuggaagggguccaaucggccgaucguagauauaaacauuaaagaccacagcaucgugucgucuuacgucuguuccggacuggugggcgacacccccaggaagaaugauucaaguagcuccucucauugccuugacccuaacaaugaggaaggugggcacggaguuaaaggcugggcuuucgaugacggcaacgauguguggauggggcgaacaaucagcgagaagucaagauugggauaugagacuuuuaaagucauugaagguuggaguaauccaaaguccaaacugcagaucaaccgccaggugauuguagaccggggcaaucguagcggguacucuggaauauucucaguugagggcaagaguuguaucaaccgcugcuuuuauguggaacuaauuagagguaggaaggaggaaaccgagguccucuggacaagcaauuccaucguggucuucugugggacuucuggcaccuacggaacaggcucguggcccgauggggccgacaucaaccugaugccuauuuga

SEQ ID NO: 138654 - RNA, 1413 nt, Artificial Sequence; identical to SEQ ID NO: 138087
  derived and/or modified sequence opt3 from neuraminidase__InfluenzaA__ACN42984

SEQ ID NO: 138655 - RNA, 1413 nt, Artificial Sequence; identical to SEQ ID NO: 138087
  derived and/or modified sequence opt3 from neuraminidase__InfluenzaA__ACN42995

SEQ ID NO: 138656 - RNA, 1410 nt, Artificial Sequence
  derived and/or modified sequence opt3 from neuraminidase__InfluenzaA__ACN43006
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaacagaguuaugcugugugaaccgacuauaaucgagaggaauauuaccgaaaucguguauuugacaaacaccacuauugagaaggaaaucugccccaaauuagcugaguaccggaauuggaguaagccucagugugacauaacaggguucgcaccauuuagcaaagauaacuccauucgccugucugccggaggugacaucuggguaacccgagagcccuaugugucgugcgauccugacaaguguuaccaguucgcgcuaggccaagggacgacucucaauaacguccauucaaauaacaccgugcgugauagaacaccauauaggacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggacggcugguggauuccguaguuucauggaguaaagagauucugcgcacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccagcacgucgaggaaugcucuugcuauccuagauacccaggcguuaggugugugugccgggacaacuggaagggguccaaucgcccgauaguagauauuaacaucaaagaccacagcaucgugucgucuuacgucuguuccggacuggugggcgacacgccccgaaagaaugauucaaguagcuccucucauugccuugacccuaacaaugaggaaggugggcacggaguuaaaggcugggcuuucgaugacggcaacgauguguggauggggagaaccauuagcgagaagucaagguugggauaugagacauuuaaagucaucgaagguuggaguaauccaaaguccaaacugcaaauuaaccgucaggugauaguagaccggggcaaucgcagcggguacucuggaaucuucucaguugagggcaagaguuguauuaacagaugcuuuuauguggaacuaaucaggggucggaaggaggaaacugagguccucuggaccagcaauuccaucguggucuucugugggacaucuggcacuuacggaaccggcucguggcccgauggggccgacauuaaccugaugccuauauga

SEQ ID NO: 138657 - RNA, 1410 nt, Artificial Sequence; identical to SEQ ID NO: 138619
  derived and/or modified sequence opt3 from neuraminidase__InfluenzaA__ACN43017

SEQ ID NO: 138658 - RNA, 1410 nt, Artificial Sequence; identical to SEQ ID NO: 138615
  derived and/or modified sequence opt3 from neuraminidase__InfluenzaA__ACN43028

SEQ ID NO: 138659 - RNA, 1410 nt, Artificial Sequence
  derived and/or modified sequence opt3 from neuraminidase__InfluenzaA__ACN43039
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuuggagaccaaacaggugugcauugcuuggagcaguuccucuugucaugauggcaaggccuggcuccacgucugcaucacaggugacgauaagaaugcaaccgccagcuucaucuacaacgggaggcugguggacuccguaguuucauggaguaaagaaauucugcggacgcaggagagcgagugugugugcauaaauggaacuuguacagucgugaugaccgauggcucugcuuccggcaaggcagacacuaaaauccucuuuauugaagaggggaagaucgugcauacaucaaccuuaagcggaagugcccaacacgucgaagagugcucuugcuauccucgcuacccagguguuagaugugugugcagggauaacuggaagggcuccaaccggccgauaguagacauuaauaucaaagaccacagcaucgugucgucuuacgucuguuccgggcuggugggagauacgccccgcaagaacgacucaaguagcuccucucauugccuugauccuaauaacgaagagggcggucacgggguuaaaggaugggcuuucgacgauggcaaugacguguggaugggccgaaccauuagcgagaagucaagauugggguaugaaacauuuaaagucaucgagggauggaguaacccaaaguccaaacugcagauuaauaggcaagugauaguagaucgggguaaccguagcggcuacucugggaucuucucaguugaaggaaagaguuguauuaaucgcugcuuuuauguggagcuaaucagaggcaggaaggaagagacugagguccucuggaccagcaacuccaucguggucuucugugguacaucugggacuuacggcaccggaucguggcccgacggcgccgauauuaaucugaugccuauauga

SEQ ID NO: 138660 - RNA, 1410 nt, Artificial Sequence; identical to SEQ ID NO: 138528
  derived and/or modified sequence opt3 from neuraminidase__InfluenzaA__ACN43050

SEQ ID NO: 138661 - RNA, 1410 nt, Artificial Sequence; identical to SEQ ID NO: 138615
  derived and/or modified sequence opt3 from neuraminidase__InfluenzaA__ACN43061

SEQ ID NO: 138662 - RNA, 1410 nt, Artificial Sequence
  derived and/or modified sequence opt3 from neuraminidase__InfluenzaA__ACN43072
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaauccaaaguccaaacugcagauuaacaggcaagugauaguagaccggggcaaucguagcggguacucuggaaucuucucaguugagggcaagaguuguauuaaccgcugcuuuuauguggaacuaaucagagguaggaaggaggaaacugagguccucuggaccagcaauuccguggucguguucugugggacaucuggcacuuacggaaccggcucguggcccgauggggccgacaucaaccugaugccuauuuga

SEQ ID NO: 138663 - RNA, 1410 nt, Artificial Sequence
  derived and/or modified sequence opt3 from neuraminidase__InfluenzaA__ACN43083
augaaccccaaucagaagaucauuaccauaggcagcgugucccugacaaucucuacuauuugcuucuuuaugcaaaucgccauucucaucacgaccgucacacuucacuucaaacaguacgaguuuaacucaaguccuaauaaccagguuaugcugugugaaccaacuauaaucgagagaaauauuaccgaaaucguguauuugacaaacaccacuauugagaaggaaaucugcccgaaauuagcugaguacaggaauuggagcaagccccagugugacauaacaggguucgcaccuuuuuccaaagauaacucuauucggcugucggccggaggugacaucuggguaacccgcgagccauaugugucaugcgaucccgacaaguguuaccaauucgcgcuaggccaggggacgacucucaauaacguccauagcaauaacaccgugcgagaucguacaccuuauagaacucugcuuaugaaugaacugggaguuccauuucacuugggcaccaaacaggugugcauugcuuggaguuccucuagcugucaugacgguaaggccuggcuccacgucugcaucacaggggaugacaagaacgcaaccgccuccuucaucuacaauggaaggcugguggauucaauuguaaguuggagcaacgagauacugcggacgcaggaaucugaguguguuugcaucaacggcacuuguacaguggucaugaccgacggcuccgcuucagggaaagcagauacuaagauucucuuuaucgaggaaggaaaaauagugcauacaagcaccuuaagugguucugcccaacacguggaggaaugcuccugcuauccccgcuacccuggcgucagauguguuugcagggacaauuggaaggggagcaaccggccaauuguggauaucaauaucaaggaccacucgauuguaucuuccuacguguguucaggacuggucggcgacacgccgcgcaaaaacgauaguagcuccucuagccauugccuugaccccaauaacgaggaaggugggcacggagugaagggcugggcuuucgaugacggcaaugauguuuggauggggcgaaccaucucagagaaaaguagauugggauaugagacauuuaaggugauugaagguugguccaacccuaaaagcaagcugcagauaaauaggcaggucaucguggaccggggcaaccguucuggguacucaggaauuuucaguguagagggcaaaagcuguaucaaucgcugcuuuuauguugaacuaaucagagguaggaaggaggaaacugaggugcucuggaccuccaacucuauugucguguucugugggacaucgggcacuuacggaaccggcagcuggccagauggggccgacauaaaucugaugcccaucuga

SEQ ID NO: 138664 - RNA, 1410 nt, Artificial Sequence; identical to SEQ ID NO: 136343
  derived and/or modified sequence opt3 from neuraminidase__InfluenzaA__ACN50231

SEQ ID NO: 138665 - RNA, 1410 nt, Artificial Sequence
  derived and/or modified sequence opt3 from neuraminidase__InfluenzaA__ACN50233
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugcucaccgauggcucugcuuccgggaaggcagacacuaaaaucuuauuuauugaggaaggaaagaucgugcacacaucaaagcugagcgguagugcccaacacgucgaggaaugcucuugcuauccucgguacccaggcguucgcugugugugcagagauaacuggaaaggguccaacaggccgauaguagacauuaauaucaaggacuacagcaucgugucgucuuaugucuguuccggacuugugggcgauacuccccggaaaaacgacucaaguagcuccggucauugcuuggauccuaauaacgaggaagggggacacggcguuaagggcugggcuuucgacgaugggaaugacguguggaugggacgcacgauuucugagaaacugcgaagcgguuacgagaccuuuaaggucaucgaaggcuggucaaacccaaauaguaaacuacagauuaacagacaggugauaguagauagggggaaucgguccggauauagcggcaucuucucuguugaggguaagucauguauuaaccguugcuuuuacguggaacucauccgcgggagaaaggaggaaacagagguccuguggaccaguaauagcaucguggucuucuguggcaccuccggaacauauggcacugggucuuggcccgacggagccgauauuaaccuuaugccuauauga

SEQ ID NO: 138666 - RNA, 1410 nt, Artificial Sequence
  derived and/or modified sequence opt3 from neuraminidase__InfluenzaA__ACN50245
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguugugcugugugaaccgacuauaaucgagagaaauauuaccgaaaucguauauuugacaaacaccacuauugagaaggaaaucugccccaaauuagcugaguacaggaauuggaguaagccucagugugacauaacaggguucgcaccauuuagcaaagauaacuccauucggcugucugccggaggugacaucugggugacccgcgagcccuaugucucgugcgauccugacaaguguuaccaauucgcgcuaggccaggggacgacucucaauaacgugcauucaaaugauaccguucgagaccguacaccauauagaacucugcuuaugaacgaacugggagugcccuuucacuugggcaccaagcaggucugcauugcuuggagcaguuccucuugucaugaugguaaagccuggcuccacgugugcaucacaggggacgauaagaaugcaaccgccagcuucaucuacaacggaaggcugguagacuccauuguuucauggaguaaagagauacugcggacgcaggaaagcgagugugugugcaucaauggcacuuguacagucgugaugaccgauggcucugcuuccgggaaggcagacacuaaaauucucuuuaucgaggaaggaaagauagugcauacaucaaccuuaagcgguagugcccaacacgucgaggaaugcucuugcuauccucgcuacccaggcguuagaugugugugcagggauaacuggaagggguccaaccggccgauuguagacaucaauaucaaagaccacagcauugugucgucuuacgucuguuccggacuggugggcgauacgccccgcaagaacgacucaaguagcuccucucauugccuugauccuaauaacgaggaaggugggcacggaguuaaaggcugggcuuucgacgauggcaaugacguguggauggggcgaaccaucagcgagaagucaagauugggauaugagacauuuaaagucauugaagguuggaguaacccaaaguccaaacugcagauaaauaggcaagugaucguagaucggggcgaccguagcggguacucuggaauuuucucaguugagggcaagaguuguaucaaccgcugcuuuuauguggaacuaaucagagguaggaaggaggaaacugagguccucuggaccagcaauuccauuguggucuucugugggacaucuggcacuuacggaaccggcucguggcccgauggggccgacauaaaccugaugccuaucuga

SEQ ID NO: 138667 - RNA, 1413 nt, Artificial Sequence
  derived and/or modified sequence opt3 from neuraminidase__InfluenzaA__ACN72609
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuucauuaugaagaguguagcugcuacccagacaccggcaucguuaugugugugugcagggauaacuggcacggcuccaaucggcccugggucucuuucaaccagaaucuggacuacaaaauuggguauaucugcagcggaguguuuggugauaacccucgcccagaggacggcgaagggucauguaauccggugacggucgauggagccaacggcguuaaggguuucaguuacaaauaugacaaugggguguggaucggcagaacuaaguccaacaggcugcggaaaggauuugagaugauuugggaccccaauggcuggacaaacaccgauagcgacuucucuguaaagcaagauguggucgcuauaacugacuggucaggguacagugguagcuuugugcagcacccugaacucacaggauuagauugcauccgcccauguuucuggguugagcuggugcgaggccuucccagagaaaacaccacgauuuggaccuccgggucuucgaucagcuucugcggagucaauuccgacacagccaacuggucauggccugauggcgcagaguugccauuuacuauugacaaguga

SEQ ID NO: 138668 - RNA, 1410 nt, Artificial Sequence
  derived and/or modified sequence opt3 from neuraminidase__InfluenzaA__ACN72621
augaaccccaaucagaagaucauuauaaucagcuccauuugcaugaccaacggcaucgccucucugauucuccaaaucgggaauauaaucucaauuuggaucagucacagcauucagacaggaaaccagaaucagacugagacguguaaccaauccgugaucauauacgaaaauaacaccugggucaaucagacauauguuaacauuucuaauaacaauuucguggcugagcagacuguagugccugucaaacuuguggguucgucaccacugugcccgguuagcggcugggcaaucuacaguaaggacaacuccgugagaauugggucuaaaggagaugucuuugugaucagggaacccuucaucagcuguucccauuuggagugccggaccuuuuucuuaacacagggcgcccugcuaaaugacaagcacucaaacgguaccguaaaagaucgcaguccuuaucgaacucucaugagcuguccaauuggggaaguucccucuccuuacaacucccguuuugagucaguggcguggagcgcuagugccugccaugacggaucuuccuggcugacaauaggcaucagcggcccagauaauggggcagucgccgugcuuaaguauaacgacauuaucaccgauacgauaaagucguggaaaaauaacauucugagaacucaagagucugaaugugcuugcuugaauggauccuguuucaccgugaugacagacggucccucaaacggccaggcaaguuacaagaucuuuaaaaucgagaaggggaaagucguuaagagcguggaacucaaugccccuaacuaucacuacgaggagugcuccuguuacccagauucuggagaaauuaucugcguaugcagggacaauuggcauggcagcaaccggccgugggugucauucaaucagaaccuggaguaucagauugguuacauauguagugggguccugggagauaauccccgcccuaacgacagaacuggcaauugcggcccaguguccagccacggggcuaacggaguuaaggguuuuucuuucaaauauggcgaugggaucuggauuggaaggaccaagucaacaaguagccgguccggcuuugaaaugaucugggaccccaacgguuggaccgggacggacaauaacuucucugugaaacaagauaucgucggcauuacugacuggacaggauacucgggcagcuuugugcagcacccugagcucaccggguuagauuguauacgcccaugcuucuggguagaacugauccgaggaagacccaaggagaauacuauuuggacauccgguucaaguaucucuuucuguggcguuaacagcgacaccguggggugguccuggccggauggagccgagcuuccuuuuacgauugacaaauga

SEQ ID NO: 138669 - RNA, 1410 nt, Artificial Sequence; identical to SEQ ID NO: 138528
  derived and/or modified sequence opt3 from neuraminidase__InfluenzaA__ACN76503

SEQ ID NO: 138670 - RNA, 1410 nt, Artificial Sequence
  derived and/or modified sequence opt3 from neuraminidase__InfluenzaA__ACO36345
augaaccccaaucagaagaucauuaccauaggcagcgugucccugacaaucucuacuauuugcuucuuuaugcaaaucgccauucucaucacgaccgucacacuucacuucaaacaguacgaguuuaacucaaguccuaauaaccagguuaugcagugugaaccaacuauaaucgagagaaauauuaccgaaaucguguaucugacaaacaccacuauugagaaggaaaucugcccgaaauuggcugaguacaggaauuggagcaagccccaaugugacauaacaggguucgcaccuuuuuccaaagauaacucuauucgguuaucggccggaggugacaucuggguaacccgcgagccauaugugucaugcgaucccgacaaguguuaccaguucgcgcugggccaggggacgacucuaaauaacguccauagcaauaacaccgugcgagaucguacaccuuauagaacucuccugaugaaugaacuuggaguuccauuucaccugggcaccaaacaggugugcauugcuuggaguuccucuagcugucaugacgguaaggccugguugcacgucugcaucacaggggaugacaagaacgcaaccgccuccuucaucuacaauggaaggcucguggauucaauuguaaguuggagcaaagagauacugcggacgcaagaaucugaguguguuugcaucaacggcacuuguacaguggucaugaccgacggcuccgcuucagggaaggcagauacuaaaauucuguuuaucgaggaaggaaagauagugcauacaagcacccucagugguucugcccagcacguggaggaaugcuccugcuauccccgcuacccuggcgucagauguguuugcagggacaacuggaaggggagcaaucggccaauuguggauaucaacaucaaagaccacucgauuguaucuuccuacguguguucaggauuagucggcgacacgccgcgcaagaaugauaguagcuccucuagccauugccuggaccccaacaaugaggaaggugggcacggagugaaaggcugggcuuucgaugacggcaacgauguuuggauggggcgaaccaucucagagaagaguagacuuggauaugagacauuuaaagugauugaagguugguccaauccuaagagcaaauugcagauaaacaggcaggucaucguggaccggggcaaucguucuggguacucaggaauuuucaguguagagggcaagagcuguaucaaccgcugcuuuuauguugaacugaucagagguaggaaggaggaaacugaggugcuauggaccuccaauucuauugucguguucugugggacaucgggcacuuacggaaccggcagcuggccagauggggccgacauaaaccucaugcccaucuga

SEQ ID NO: 138671 - RNA, 1410 nt, Artificial Sequence; identical to SEQ ID NO: 136996
  derived and/or modified sequence opt3 from neuraminidase__InfluenzaA__ACO36356

SEQ ID NO: 138672 - RNA, 1410 nt, Artificial Sequence
  derived and/or modified sequence opt3 from neuraminidase__InfluenzaA__ACO36367
augaaccccaaucagaagaucauuaccauaggcagcgugucccugaucauuucuacaaucugcuucuuuaugcaaacugccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgaaaccguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccauuguaucauggaguaaagagauacugcggacgcaggaaagcgaguguguuugcaucaacggcacuuguacaguggucaugaccgacggcucugcuuccgggaaggcagauacuaaaauucucuuuaucgaggaaggaaagauagugcauacaucaaccuuaagcgguagugcccaacacguggaggaaugcucuugcuauccucgcuacccaggcgucagauguguuugcagggacaacuggaagggguccaaucggccgauuguggauaucaacaucaaagaccacagcauuguaucgucuuacguguguuccggacuggucggcgacacgccccgcaagaaugauucaaguagcuccucucauugccuugacccuaacaaugaggaaggugggcacggagugaaaggcugggcuuucgaugacggcaacgauguuuggauggggcgaaccaucagcgagaagucaagauugggauaugagacauuuaaagugauugaagguuggaguaauccaaaguccaaacugcagauaaacaggcaggucaucguggaccggggcaaucguagcggguacucuggaauuuucucaguagagggcaagaguuguaucaaccgcugcuuuuauguugaacuaaucagagguaggaaggaggaaacugaggugcucuggaccagcaauuccauugucguguucugugggacaucuggcacuuucggaaccggcucguggcccgauggggccgacauaaaccugaugccuaucuga

SEQ ID NO: 138673 - RNA, 1413 nt, Artificial Sequence; identical to SEQ ID NO: 138648
  derived and/or modified sequence opt3 from neuraminidase__InfluenzaA__ACO36400

SEQ ID NO: 138674 - RNA, 1410 nt, Artificial Sequence
  derived and/or modified sequence opt3 from neuraminidase__InfluenzaA__ACO36411
augaaccccaaucagaagaucauuaccauaggcagcgugucccugacaaucucuacuauuggguucuuuaugcaaacggccauccucauuaccacagucacucuucacuucaaacaguacgaguuuaacucaccuccaaauaaccagguuaugcugugcgaaccgaccaucauagagagaaauaucacagaaauuguguauuugaccaacacuacaaucgagaaggaaauuugucccaaauuagcugaguacaggaauuggaguaagccucagugcgacaucaccggauucgcaccauuuagcaaagauaacuccauacggcugucugccgguggcgacauuuggguaacgcgcgagcccuaugugucgugugauccugacaagugcuaccaauucgcgcuagggcagggaacuacccucaauaacguccauucaaaugauacagugcgaggccguacuccauauagaacccugcuuaugaacgaacuggguguucccuuucacuuggggacaaaacagguguguaucgcuuggagcaguuccucuugccaugacggaaaggccuggcuccacgucuguauuaccggcgaugacaagaaugcaacggccagcuucaucuacaacggcaggcugguggauuccaucguaucauggaguaaagagauucugcggacucaggaaagcgagugcguuuguauaaaugggacaugcaccguggucaugacugacggaucugcuuccgguaaggcagauacaaaaauccucuuuauugaggaaggcaagaucgugcauaccucaacguuaagcgggagugcccaacacguggaggaauguucuugcuauccucgcuacccaggagucagaugcguuuguagggacaacuggaagggcuccaaccggccgauaguggauauuaauaucaaagaccacagcaucguaucgucuuacgugugcuccggucuggucggggacacaccccgcaagaacgauucaaguagcuccucucauugucuugacccuaauaacgaggaaggaggccacggcgugaaagggugggcuuucgaugacggaaaugauguuuggaugggucgaaccauuagcgagaagucaagauugggcuaugagacuuuuaaagugaucgaaggguggaguaacccaaaguccaaacugcagauuaauaggcaggucauaguggaccggggaaaccguagcggcuacucugguaucuucucaguagaggggaagaguugcauuaaucgcuguuuuuauguugaacuaaucagaggcaggaaggaggaaaccgaggugcucuggacaagcaacuccaucgucguguucugcggaacuucuggcaccuacgggacaggaucguggcccgauggugccgacauuaaucugaugccuauauga

SEQ ID NO: 138675 - RNA, 1410 nt, Artificial Sequence
  derived and/or modified sequence opt3 from neuraminidase__InfluenzaA__ACO36422
augaaccccaaucagaagaucauuaccauaggcagcgugucccugaucauuucuacaaucugcuucuuuaugcaaacugccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgaggacguacaccauauagaacucugcuuaugaacgaacugggcguucccuuucacuuggguaccaaacaggugugcauugcuuggagcaguuccucuugucaugacgggaaggccuggcuccacgucugcaucacaggagaugacaagaaugcaaccgccagcuucaucuacaacggcaggcugguggauuccauuguaucauggaguaaagagauacugcggacgcaggaaagcgaguguguuugcaucaauggcacuuguacaguggucaugaccgacgggucugcuuccggaaaggcagauacuaaaauucucuuuaucgaggaagguaagauagugcauacaucaaccuuaagcggcagugcccaacacguggaggaaugcucuugcuauccucgcuacccaggggucagauguguuugcagggacaacuggaagggauccaaccggccgauuguggauaucaauaucaaagaccacagcauuguaucgucuuacguguguuccggccuggucggugacacgccccgcaagaacgauucaaguagcuccucucauugccuugacccuaauaacgaggaagggggacacggcgugaaaggcugggcuuucgaugacgggaaugauguuuggaugggacgaaccaucagcgagaagucaagauuggguuaugagacauuuaaagugauugaaggcuggaguaacccaaaguccaaacugcagauaaauaggcaggucaucguggaccgggggaaccguagcggauacucuggcauuuucucaguagaggguaagaguuguaucaaucgcugcuuuuauguugaacuaaucagagggaggaaggaggaaacugaggugcucuggaccagcaacuccauugucguguucuguggcacaucuggaacuuacggcaccgggucguggcccgauggagccgacauaaaucugaugccuaucuga

SEQ ID NO: 138676 - RNA, 1410 nt, Artificial Sequence; identical to SEQ ID NO: 138432
  derived and/or modified sequence opt3 from neuraminidase__InfluenzaA__ACO36433

SEQ ID NO: 138677 - RNA, 1410 nt, Artificial Sequence
  derived and/or modified sequence opt3 from neuraminidase__InfluenzaA__ACO36444
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaaaaugucccaagcuggcagaguauaggaauuggucaaaaccucagugcaacauuacaggguucgccccauuuaguaaggacaauagcauccggcuauccgcgggaggugauauaugggugacccgcgagcccuacgucucuugugacccugauaagugcuaucaauucgcucucggccaggggacgacucugaacaauggacacucgaacaauaccgugcaugaccgaacaccauaccguacucuucugaugaacgaauugggcguucccuuucaccucgguaccagacagguguguauugccuggucaagcaguuccugccaugaugggaaagcauggcugcacgucugugugacaggagacgauaagaaugccaccgcuucuuucaucuauaacggcaggcugguagacagcauuggcuccuggaguaaaaagauccuccggacgcaggagucagaaugcguuuguaucaacgggacuugcacaguggucaugaccgauggaagcgcaucugagaaagccgacacuaagauuuuauuuauagaggaagguaagaucgugcacauuuccacacugucaggcagcgcucaacauguggaggaaugcaguuguuacccucgcuauccaggggucagaugcguuuguagggauaauuggaaaggaucuaaccggccgaucguggacauaaauguaaaggauuacuccauugugagcucguacgucugcucuggccuugugggugacacccccaggaaaaacgacuccuucucaaguagccacuguuuggauccuaauaacgaggaagggggacauggcguuaagggcugggccuuugacgaugggaaugacguguggaugggacgaacgaucuccgagaaacugagaucugguuaugagaccuucaaggucaucgaaggcuggagcaaaccaaacucaaagcuacagauuaaucgccaggugaucguagagcgggggaaccguaguggauacuccggcauuuuuagcguugaagguaagucuugcauaaaucgcuguuucuauguggagcucaucagagggaggaaagaagagacagaggucugguggacuucaaacaguauuguggucuuuugcggcaccagcggaacauacggcacuggguccuggcccgauggagcggacaucaaucugaugccuaucuga

SEQ ID NO: 138678 - RNA, 1410 nt, Artificial Sequence
  derived and/or modified sequence opt3 from neuraminidase__InfluenzaA__ACO36466
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucgcuuauuugacaaacaccacuauugagaaggaaaucugccccaaauuagcagaguacaggaauuggaguaagccucaguguaacauaacaggguucgccccauuuagcaaagacaauuccauucggcugucugcgggaggugauaucugggugacccgcgagcccuauguaucgugcgacccugauaaguguuaccaauucgcucuaggccaggggacgacucucaacaaugugcauucaaacgacaccguccacgaucgaacaccauaucguacucugcuuaugaaugaacugggagugcccuuucauuugggcaccaagcagguuugcauugccuggagcaguuccucuugucacgacgguaaagcauggcuccaugugugcgucacaggggaugacgagaacgccaccgcuagcuucaucuacaauggaagacugguggauuccguaguuucauggaguaagaaaauccugaggacgcaggaaagcgagugugugugcauuaacggcacuuguacagucgugaugaccgacggcucugcauccgggaaggccgauacuaaaauacucuuuaucgaggaaggaaagauugugcacacaucaaccuuaagcgguagugcucaacacgucgaggaaugcucuugcuauccucgguacccaggcguucgcugugugugcagagacaacuggaagggguccaauaggccgaucguagauauaaacauuaaagacuacagcaucgugucgucuuaugucuguuccggacuggugggcgacacgccccggaagaaugauucaaguagcuccucucauugccuugacccuaacaaugaggaaggugggcacggaguuaaaggcugggccuucgaugacggcaacgauguguggauggggcgcaccaucagcgagaaguugcgaucaggauacgagacauuuaaagucauugaagguuggaguaauccaaacuccaagcugcagaucaauagacaggugauuguagacaggggcaaccggagcggguauucuggaauauucucaguugagggcaaaaguuguaucaaucguugcuuuuacguggaacuaauucgcgguagaaaccaggagacugaaguccucuggaccagcaauuccaucguggucuucugugggacaucuggcacuuauggaaccggcucguggcccgauggggcggacaucaaccugaugccuauuuga

SEQ ID NO: 138679 - RNA, 1410 nt, Artificial Sequence
  derived and/or modified sequence opt3 from neuraminidase__InfluenzaA__ACO36477
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaauuugucccaaacuggcagaguauaggaauuggucaaagccucagugcaacaucacaggguucgccccauuuaguaaagacaauagcauacggcuauccgcgggaggugauauuugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguaucgccuggucaagcaguuccugccaugacgggaaggcauggcugcacgucugugugacaggagaugacaaaaacgccaccgcuucuuucauuuauaauggcaggcugguagauagcaucggcuccuggucaaagaacauccuccggacgcaggagagugaaugcguuuguauuaacgggacuugcacaguggucaugaccgacggaagcgcaucugguaaagccgauacuaagauauuauuuaucgaggagggcaaaauugugcacaucuccacacugucagggagcgcucaacauguggaagagugcaguuguuacccucgcuauccaggagucagaugcguuuguagggacaauuggaagggcucuaaccggccgauaguggauauuaauguaaaggacuacuccaucgugagcucguacgucugcucuggucuugugggggacacccccaggaaaaacgauuccuucucaaguagccacuguuuggacccuaauaacgaagagggaggccauggcguuaaggggugggccuuugaugacggaaaugauguguggaugggucgaacgaucuccgaaaaacugagaucuggcuaugagaccuucaaggucauugagggguggagcaaaccaaacucaaagcuacagaucaaucgccaggugauuguagaacggggaaaccguaguggcuacuccgguauauuuagcguugaggggaaaucuugcaucaaucgcuguuucuauguggaacucauuagaggcaggaaggaggaaacagaggucugguggacuucaaacaguaucguggucuuuugcggaaccagcggcacauacgggacuggauccuggcccgacggugcggauaucaaucugaugccuauuuga

SEQ ID NO: 138680 - RNA, 1410 nt, Artificial Sequence
  derived and/or modified sequence opt3 from neuraminidase__InfluenzaA__ACO36499
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccguugugucauggaguaaaaagauccugaggacgcaggagagcgaaugugucugcauuaacggcacuuguacaguggugaugaccgacggcucugcuuccgggaaagcagauacuaagauacucuuuaucgaggagggaaagauuguccacacaucaaccuuaagcgguagugcccaacacguugaagagugcucuugcuauccucgguacccaggcgugcgcuguguaugcagagacaacuggaaaggguccaauaggccgaucguggauauaaacauuaaggacuacagcaucgucucgucuuauguguguuccggacugguuggcgacacgccccggaaaaaugauucaaguagcuccucucauugccuugacccuaacaaugaagagggugggcacggagugaagggcugggcuuucgaugacggcaacgaugucuggauggggcgcaccaucagcgaaaaauugcgaucaggauacgagacauuuaaggugauugaggguuggaguaauccaaacuccaaacugcagaucaauagacagguaauuguugacaggggcaaccggagcggguauucuggaauauucucaguggaaggcaagaguuguaucaaucguugcuuuuacgucgagcuaauucgcgguagaaaccaggaaacugaggugcucuggaccagcaauuccaucgucguguucugugggacaucuggcacuuauggaaccggcucguggcccgauggggccgacaucaaccugaugccuauuuga

SEQ ID NO: 138681 - RNA, 1410 nt, Artificial Sequence; identical to SEQ ID NO: 136343
  derived and/or modified sequence opt3 from neuraminidase__InfluenzaA__ACO36510

SEQ ID NO: 138682 - RNA, 1410 nt, Artificial Sequence; identical to SEQ ID NO: 136343
  derived and/or modified sequence opt3 from neuraminidase__InfluenzaA__ACO36543

SEQ ID NO: 138683 - RNA, 1410 nt, Artificial Sequence; identical to SEQ ID NO: 136343
  derived and/or modified sequence opt3 from neuraminidase__InfluenzaA__ACO36554

SEQ ID NO: 138684 - RNA, 1410 nt, Artificial Sequence; identical to SEQ ID NO: 136343
  derived and/or modified sequence opt3 from neuraminidase__InfluenzaA__ACO36565

SEQ ID NO: 138685 - RNA, 1410 nt, Artificial Sequence
  derived and/or modified sequence opt3 from neuraminidase__InfluenzaA__ACO36576
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaagacugguagacuccaucguuucauggaguaaagagauucugaggacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaacuggaagggguccaacaggccgauaguagacauuaauaucaaagacuacagcaucgugucgucuuaugucuguuccggacuggugggcgauacgccccggaagaacgacucaaguagcuccucucauugccuugauccuaauaacgaggaaggugggcacggaguuaaaggcugggcuuucgacgauggcaaugacguguggauggggcgcaccauuagcgagaaguugcgaucaggauacgagacauuuaaagucaucgaagguuggaguaacccaaauuccaagcugcagauuaacagacaggugauaguaggcagggggaaucggagcggauauucuggcaucuucucaguugaggguaaaaguuguauuaaccguugcuuuuacguggaacuaauccgcgggagaaaggaggaaacugagguccucuggaccagcaauuccaucguggucuucuguggcacaucuggaacuuauggcaccgggucguggcccgauggagccgacauuaaccugaugccuauauga

SEQ ID NO: 138686 - RNA, 1410 nt, Artificial Sequence; identical to SEQ ID NO: 136343
  derived and/or modified sequence opt3 from neuraminidase__InfluenzaA__ACO36587

SEQ ID NO: 138687 - RNA, 1410 nt, Artificial Sequence; identical to SEQ ID NO: 136728
  derived and/or modified sequence opt3 from neuraminidase__InfluenzaA__ACO36609

SEQ ID NO: 138688 - RNA, 1410 nt, Artificial Sequence
  derived and/or modified sequence opt3 from neuraminidase__InfluenzaA__ACO36620
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcuacaggugaauagacagguaauuguugacaggggcaaccggagcggguauucuggaauauucucaguggagggcaaaaguuguaucaaucguugcuuuuacgucgaacugauucgcgguagaaaggaggaaacugaggugcucuggaccagcaacuccaucgucguguucugugggacaucuggcacuuauggaaccggcucguggcccgauggggccgacaucaaucugaugccuauuuga

SEQ ID NO: 138689 - RNA, 1410 nt, Artificial Sequence; identical to SEQ ID NO: 136728
  derived and/or modified sequence opt3 from neuraminidase__InfluenzaA__ACO36631

SEQ ID NO: 138690 - RNA, 1410 nt, Artificial Sequence; identical to SEQ ID NO: 136728
  derived and/or modified sequence opt3 from neuraminidase__InfluenzaA__ACO36653

SEQ ID NO: 138691 - RNA, 1410 nt, Artificial Sequence
  derived and/or modified sequence opt3 from neuraminidase__InfluenzaA__ACO36675
augaaccccaaucagaagaucauuaccauaggcagcgugucccugacaaucucuacuauuugccucuucaugcaaaucgccauucuuaucacgaccgucacacugcacuuuaaacaguacgaguucaacucaccuccaaauaaccagguuauguugugugaaccgacuauaaucgagagaaauauuaccgaaaucguguauuuaacaaacaccacuauugagaaggaaaucugccccaaacuggcugaguacaggaauuggaguaagccucaguguaacauaacaggguuugcaccauucagcaaagacaauuccauucggcuaucugccggaggugauaucuggguaacccgcgagcccuaugugucgugcgacccugauaaguguuaccaauuugcgcucggccaggggacgacucugaacaauguccauucaaacgacaccgugcacgaucgaacaccauaucguacucuucugaugaaugaauugggaguucccuuccaucucggcaccaaacaggugugcauugcuuggagcaguuccucuugucacgacgguaaggccuggcugcaugucugcgugacaggggaugacaagaacgcaaccgccagcuuuaucuacaauggaagacugguagauuccaucguuucauggaguaaagagauucucaggacgcaggaaagcgagugugugugcauaaacggcacuuguacagucgugaugaccgacggcucugcuuccgggaaggcagauacuaaaaucuuauucauugaggaaggaaagaucgugcacacaucaacccugagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuugugggcgacacgccccggaagaaugauucaaguagcuccucucauugcuuggacccuaacaaugaggaaggugggcacggaguuaaaggcugggcuuuugaugacggcaacgauguguggauggggcgcaccauuagcgagaagcugcgaucaggauacgagacauucaaagucaucgaagguuggaguaauccaaacuccaagcuacagauuaauagacaggugauaguagacaggggcaaccggagcggguauucuggaaucuuuucaguugagggcaaaaguuguauuaaucguugcuucuacguggaacucauccgcgguagaaaggaggaaacugagguccuguggaccagcaacuccaucguggucuuuugugggacaucuggcacuuauggaaccggcucguggcccgauggggccgacauuaaucuuaugccuauauga

SEQ ID NO: 138692 - RNA, 1410 nt, Artificial Sequence
  derived and/or modified sequence opt3 from neuraminidase__InfluenzaA__ACO36686
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgaccaugauaaguguuaccaauucgcgcuaggccaggggacgacucucaacaauguccacucaaacgacaccgugcaugaucgaacaccuuaucguacucugcuuaugaaugaacugggaguuccauuucacuugggcaccaaacaggugugcauugcuuggagcaguuccucuugucaugacgguaaggccuggcuccacgucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacaugucgaggaaugcucuugcuauccccgguacccuggcguucgcugugugugcagagacaacuggaagggguccaauaggccaauaguagauauuaacaucaaagacuacagcaucgugucgucuuaugucuguuccggacuggugggcgacacgccgcggaagaaugauucaaguagcuccucucacugccuugaccccaacaaugaggaaggugggcauggaguuaaaggcugggcuuucgaugacggcaacgauguguggauggggcgcaccauuagcgagaaguugcgaucaggauacgagacauuuaaagucaucgaagguuggaguaauccuaacuccaagcugcagauuaauagacaggugauaguagacaggggcaaccggagcggguauucuggaaucuucucaguugagggcaaaaguuguauuaaucguugcuuuuacguggaacuaauccgcgguagaaaggaggaaacugagguccucuggaccagcaacuccaucguggucuucugugggacaucuggcacuuauggaaccggcucguggccagauggggccgacauuaaucugaugcccauauga

SEQ ID NO: 138693 - RNA, 1410 nt, Artificial Sequence
  derived and/or modified sequence opt3 from neuraminidase__InfluenzaA__ACO37125
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcauugcuuggagcaguuccucuugucacgaugguaaggccuggcuccaugucugcgugacaggggacgauaagaaugcaaccgccagcuucaucuacaacggaaugcugguagacuccaucguuucauggaguaaagagauucugagaacgcaggaaagcgagugugugugcauaaauggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccuagguacccaggcguucggugugugugccgcgauaacuggaagggguccaacagaccgauaguagacauuaauaucaaagacuacagcaucgugucgucuuaugucuguuccggacuggugggcgauacgcccaggaagaacgacucaaguagcuccucucauugccuugauccuaauaacgaggaaggugggcacggaguuaaaggcugggcuuucgacgauggcaaugacguguggauggggcggaccauuagcgagaaguugcgcucaggauacgagacauuuaaagucaucgaagguuggaguaacccaaauuccaagcugcagauuaaccgacaggugauaguagauagaggcaauaggagcggguauucuggaaucuucucaguugagggcaaaaguuguauuaaccggugcuuuuacguggaacuaauccguggucgcaaggaggaaacugagguccucuggaccagcaauuccaucguggucuucugugggacaucuggcacuuauggaaccggcucguggcccgacggggccgauauuaaccugaugccuauauga

SEQ ID NO: 138694 - RNA, 1410 nt, Artificial Sequence
  derived and/or modified sequence opt3 from neuraminidase__InfluenzaA__ACO94511
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaauggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaacuggaagggguccaaccggccgauaguagacauuaauaucaaagaccacagcaucgugucgucuuacgucuguuccggacuggugggcgauacgccccgcaagaacgacucaaguagcuccucuaauugccuugauccuaacaaugaggaaggugggcauggaguuaaaggcugggcuuucgacgauggcaacgacguguggauggggcgaaccauuagcgagaagucaagauugggauaugagacauuuaaagucaucgaagguuggaguaauccaaaguccaaacugcagauuaacaggcaagugauaguagaucggggcaaucguagcggguacucuggaaucuucucaguugagggcaagaguuguauuaaccgcugcuuuuauguggaacuaaucagagguaggaaggaggaaacugagguccucuggaccagcaauuccaucguggucuucugugggacaucuggcacuuacggaaccggcucguggcccgacggggccgauauuaaccugaugccuauauga

SEQ ID NO: 138695 - RNA, 1410 nt, Artificial Sequence; identical to SEQ ID NO: 138528
  derived and/or modified sequence opt3 from neuraminidase__InfluenzaA__ACO94512

SEQ ID NO: 138696 - RNA, 1410 nt, Artificial Sequence; identical to SEQ ID NO: 138615
  derived and/or modified sequence opt3 from neuraminidase__InfluenzaA__ACO94513

SEQ ID NO: 138697 - RNA, 1410 nt, Artificial Sequence
  derived and/or modified sequence opt3 from neuraminidase__InfluenzaA__ACO94675
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaauggcacuuguacagucgugaugaccgauggcucugcuuccgggaaggcagacacuaaaauccucuuuauugaggaaggaaagaucgugcauacaucaaccuuaagcgguagugcccaacacgucgaggaaugcucuugcuauccucgcuacccaggcguuagaugugugugcagggauaacuggaagggguccaaccggccgauaguagacauuaauaucaaaaaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaauccaaaguccaaacugcagauuaacaggcaagugauaguagaccggggcaaucguagcggguacucuggaaucuucucaguugagggcaagaguuguauuaaccgcugcuuuuauguggaacuaaucagagguaggaaggaggaaacugagguccucuggaccagcaauuccaucguggucuucugugggacaucuggcacuuacggaaccggcucguggcccgauggggccgacauuaaccugaugccuauauga

SEQ ID NO: 138698 - RNA, 1410 nt, Artificial Sequence
  derived and/or modified sequence opt3 from neuraminidase__InfluenzaA__ACO94686
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuaccauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaaugauacagugcgagaccguacuccauauagaacccugcuuaugaacgaacugggaguucccuuucacuugggcacaaaacaggugugcaucgcuuggagcaguuccucuugucaugaugguaaggccuggcuccacgucugcauuaccggggacgauaagaaugcaacggccagcuucaucuacaacggaaggcugguggacuccaucguaucauggaguaaagauauucugcggacucaggagagcgaauguguuugcauaaauggcacauguaccguggucaugacugacggcucugcuuccgggaaggcagauacaaaaauccucuuuauugaggagggaaagaucgugcauaccucaacguuaagcgguagugcccaacacguggaagagugcucuugcuauccucgcuacccaggcgucagauguguuugcagggacaacuggaagggguccaaccggccgauaguggacauuaauaucaaagaucacagcaucguaucgucuuacguguguuccggacuggucggcgacacaccccgcaagaacgauucaaguagcuccggucauugccuugacccuaauaacgaagagggagggcacggcgugaaaggcugggcuuucgaugacgggaaugauguuuggaugggacgaaccauuucugaaaagagcagauuggguuaugagacuuuuaaagugaucgagggcuggucaaacccaaagaguaaacugcagauuaauaggcaggucauaguggaccgggggaaccguuccggauacagcggcaucuucucuguagaagguaagucauguauuaaucgcugcuuuuauguugagcuaaucagagggaggaaggaagagaccgaagugcucuggacaaguaacagcaucgucguguucuguggcacuuccggaaccuacggcacagggucuuggcccgauggagccgagauuaaucugaugccuauauga

SEQ ID NO: 138699 - RNA, 1410 nt, Artificial Sequence; identical to SEQ ID NO: 138615
  derived and/or modified sequence opt3 from neuraminidase__InfluenzaA__ACO94697

SEQ ID NO: 138700 - RNA, 1413 nt, Artificial Sequence; identical to SEQ ID NO: 138648
  derived and/or modified sequence opt3 from neuraminidase__InfluenzaA__ACO94708

SEQ ID NO: 138701 - RNA, 1410 nt, Artificial Sequence
  derived and/or modified sequence opt3 from neuraminidase__InfluenzaA__ACO94719
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagauauacugcggacgcaggagagcgaauguguuugcaucaauggcacuuguacaguggucaugaccgacggcucugcuuccgggaaggcagauacuaaaauucucuuuaucgaggagggaaagauagugcauacaucaaccuuaagcgguagugcccaacacguggaagagugcucuugcuauccucgcuacccaggcgucagauguguuugcagggacaacuggaagggguccaaccggccgauuguggacaucaauaucaaagaucacagcauuguaucgucuuacguguguuccggacuggucggcgacacgccccgcaagaacgauucaaguagcuccggucauugccuugacccuaauaacgaagagggagggcacggcgugaaaggcugggcuuucgaugacgggaaugauguuuggaugggacgaaccaucucugaaaagagcagauuggguuaugagacauuuaaagugauugagggcuggucaaacccaaagaguaaacugcagauaaauaggcaggucaucguggaccgggggaaccguuccggauacagcggcauuuucucuguagaagguaagucauguaucaaucgcugcuuuuauguugagcuaaucagagggaggaaggaagagacugaagugcucuggaccaguaacagcauugucguguucuguggcacauccggaacuuacggcaccgggucuuggcccgauggagccgagauaaaucugaugccuaucuga

SEQ ID NO: 138702 - RNA, 1410 nt, Artificial Sequence
  derived and/or modified sequence opt3 from neuraminidase__InfluenzaA__ACO94741
augaaccccaaucagaagaucauuaccauaggcagcgugucccugacaaucucuacuauuugcuucuuuaugcaaaucgccauucucaucacgaccgucacacuucacuucaaacaguacgaguuuaacucaaguccuaauaaccagguuaugcugugugaaccaacuauaaucgagagaaauauuaccgaaaucguguauuugacaaacaccacuauugagaaggaaaucugcccgaaauuagcugaguacaggaauuggagcaagccccagugugacauaacaggguucgcaccuuuuuccaaagauaacucuauucggcugucggccggaggugacaucuggguaacccgcgagccauaugugucaugcgaucccgacaaguguuaccaauucgcgcuaggccaggggacgacucucaauaacguccauagcaauaacaccgugcgagaucguacaccuuauagaacucugcuuaugaaugaacugggaguuccauuucacuugggcaccaaacaggugugcauugcuuggaguuccucuagcugucaugacgguaaggccuggcuccacgucugcaucacaggggaugacaagaacgcaaccgccuccuucaucuacaauggaaggcugguggauucaauuguaaguuggagcaaagagauacugcggacgcaggaaucugaguguguuugcaucaacggcacuuguacaguggucaugaccgacggcuccgcuucagggaaggcagauacuaaaauucucuuuaucgaggaaggaaagauagugcauacaagcaccuuaagugguucugcccaacacguggaggaaugcuccugcuauccccgcuacccuggcgucagauguguuugcagggacaacuggaaggggagcaaucggccaauuguggauaucaacaucaaagaccacucgauuguaucuuccuacguguguucaggacuggucggcgacacgccgcgcaagaaugauaguagcuccucuagccauugccuugaccccaacaaugaggaaggugggcacggagugaaaggcugggcuuucgaugacggcaacgauguuuggauggggcgaaccaucucagagaagaguagauugggauaugagacauuuaaagugauugaagguugguccaauccuaagagcaaacugcagauaaacaggcaggucaucguggaccggggcaaucguucuggguacucaggaauuuucaguguagagagcaaguccuguaucaaccgcugcuuuuauguugaacuaaucagaggcaggaaggaggaaacugaggugcucuggaccucuaauucgauugucguguucugugguacaagcgggacuuacggcaccggauccuggccagauggcgccgacauaaaccugaugcccaucuga

SEQ ID NO: 138703 - RNA, 1410 nt, Artificial Sequence; identical to SEQ ID NO: 138619
  derived and/or modified sequence opt3 from neuraminidase__InfluenzaA__ACO94763

SEQ ID NO: 138704 - RNA, 1410 nt, Artificial Sequence
  derived and/or modified sequence opt3 from neuraminidase__InfluenzaA__ACO94774
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauggcuuggagcaguuccucuugucaugacgguagggccuggcuccacgucugcauuacaggggaugacaagaacgcaaccgccagcuucaucuacaauggacggcugguggauuccguaguuucauggaguaaggagauccugcgcacgcaggaaagcgagugugugugcauuaacggcacuuguacagucgugaugaccgacggcucugcuuccgggaaagcagauacuaagauacucuuuaucgaggaaggaaaaauugugcauacaucaaccuuaagcgguagugcccaacacgucgaggaaugcucuugcuauccuagauacccaggcguuaggugugugugccgggacaacuggaagggguccaaucgcccgaucguagauauaaacauuaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggagaaccaucagcgagaaaucaagguugggauaugagacauuuaaggucauugaagguuggaguaauccaaaauccaagcugcagaucaaccgacaggugauuguagaccguggcaaucgcagcggguacucuggaauauucucaguugagggcaaaaguuguaucaacagaugcuuuuauguggaacuaauuaggggucggaaggaggaaacugagguccucuggaccagcaauuccaucguggucuucugugggacaucuggcacuuacggaaccggcucguggcccgauggggccgacaucaaccugaugccuauuuga

SEQ ID NO: 138705 - RNA, 1410 nt, Artificial Sequence
  derived and/or modified sequence opt3 from neuraminidase__InfluenzaA__ACO94785
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcuguguaagccgacuauaaucgaaagaaauauuaccgagaucguguauuugacaaacaccacuauugaaaaagagaucugccccaaguuagcugaauacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugagcugggaguucccuuucacuugggcaccaaacaggugugcauugcuuggagcaguuccucuugucaugacgguaaggccuggcuccacgucugcaucacaggggaugacaaaaacgcaaccgccagcuucaucuacaauggaaggcugguggauuccguaguuucauggaguaaggaaauucugcggacgcaggagagcgaaugugugugcauaaacggcacuuguacagucgugaugaccgacggcucugcuuccgggaaagcagauacuaagauccucuuuauugaggagggaaagaucgugcauacaucaaccuuaagcgguagugcccaacacgucgaagagugcucuugcuauccucgcuacccaggcguuagaugugugugcagggacaacuggaaaggguccaaucggccgauaguagauauuaacaucaaggaccacagcaucgugucgucuuacgucuguuccggacuggugggcgacacgccccgcaaaaaugauucaaguagcuccucucauugccuugacccuaacaaugaagagggugggcacggaguuaagggcugggcuuucgaugacggcaacgauguguggauggggcgaaccauuagcgaaaaaucaagauugggauaugagacauuuaaggucaucgaggguuggaguaauccaaaauccaagcugcagauuaacaggcaagugauaguagaccggggcaaucguagcggguacucuggaaucuucucaguugaaggcaagaguuguauuaaccgcugcuuuuauguggagcuaaucagagguaggaaagaagagacugaaguccucuggaccagcaauuccaucguggucuucugugggacaucuggcacuuacggaaccggcucguggcccgauggggccgacauuaaccugaugccuauauga

SEQ ID NO: 138706 - RNA, 1410 nt, Artificial Sequence; identical to SEQ ID NO: 138615
  derived and/or modified sequence opt3 from neuraminidase__InfluenzaA__ACO94796

SEQ ID NO: 138707 - RNA, 1413 nt, Artificial Sequence
  derived and/or modified sequence opt3 from neuraminidase__InfluenzaA__ACO94807
augaaccccaaucagaagaucauuaccauaggcagcaucuccauugccaucgggauuaucucucugauacuccaaaucggaaacauuaucucaauuugggcuagucacagcauccagacagguucccagaaucauacuggcauaugcaaccagagaauuaucacguacgaaaauucuaccugggugaacaauacauaugucaacauuaauaacacuaauguuguggcagagaaagacaagaccucgguaacacuugccgggaacucaagccuguguaguaucuccggaugggcgaucuacaccaaagauaauucuauuaggauaggcagcaagggugacguguucgucauccgggagccuuuuauuuccugcucacacuuggaaugucgcacuuucuuuuuaacacaaggggcucugcuaaacgauaaacauaguaauggaaccgugaaggaccgaagcccauaucgugcccucaugucuugcccgcugggcgaggcacccuccccuuacaacucaagauucgaaagcguugccuggagugcuucugcaugucacgauggcaugggguggcuuacgaucggaauauccgguccagacaacggcgccguggcuguccugaaguauaaugggauuaucacugagaccaucaaaagcuggaagaaaaggauuuugcggacacaggagucggaaugcguguguaugaacggaucuugcuuuacuaucaugaccgauggccccuccaaugguacagccucauacaagauuuucaaaauagagaaggggaagguaaccaaaacgaucgaacucaacgcgccuaauuuucauuaugaggaguguaguugcuacccagacacuggaacaguuaugugugugugccgcgauaacuggcacggcagcaauagacccugggucuccuucaaccagaaucuggacuaccagauuggcuauaucugcucugggguguuuggagauaacccuaggccaaaggacggugaaggcagcuguaauccggugaccgucgauggggcagacggaguuaaaggcuucucauacaaguaugguaacgggguguggaucggccggacuaaaaguaaucgccugcgaaagggauuugagaugauuugggaccccaacggcuggacaaauaccgauuccgacuucagcguaaaacaagauguggucgccauaacggacuggucuggguacucaggaaguuuugugcagcacccugaacucaccgguuuagauugcaucagaccauguuucuggguugagcuggugaggggccuuccccgggaaaacacaacuauuuggaccagcggguccucuaucucguucugcggagucaacagcggcacagcuaauugguccuggccugacggugccgaguugccauuuacuauugauaaguga

SEQ ID NO: 138708 - RNA, 1410 nt, Artificial Sequence; identical to SEQ ID NO: 138430
  derived and/or modified sequence opt3 from neuraminidase__InfluenzaA__ACO94818

SEQ ID NO: 138709 - RNA, 1365 nt, Artificial Sequence; identical to SEQ ID NO: 137735
  derived and/or modified sequence opt3 from neuraminidase__InfluenzaA__ACO94829

SEQ ID NO: 138710 - RNA, 1365 nt, Artificial Sequence; identical to SEQ ID NO: 137735
  derived and/or modified sequence opt3 from neuraminidase__InfluenzaA__ACO94840

SEQ ID NO: 138711 - RNA, 1410 nt, Artificial Sequence
  derived and/or modified sequence opt3 from neuraminidase__InfluenzaA__ACO94851
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaaugauaucgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaagggguccaaccggccgauuguggacaucaauaucaaagaccacagcauuguaucgucuuacguguguuccggacuggucggcgauacgccccgcaagaacgacucaaguagcuccucucauugccuugauccuaauaacgaggaaggugggcacggagugaaaggcugggcuuucgacgauggcaaugacguuuggauggggcgaaccaucagcgagaagucaagauugggauaugagacauuuaaagugauugaagguuggaguaacccaaaguccaaacugcagauaaauaggcaggucaucguggaucggggcaaccguagcggguacucuggaauuuucucaguagagggcaagaguuguaucaaucgcugcuuuuauguugaacuaaucagagguaggaaggaggaaacugaggugcucuggaccagcaacuccauugucguguucugugggacaucuggcacuuacggaaccggcucguggcccgacggggccgauauaaaucugaugccuaucuga

SEQ ID NO: 138712 - RNA, 1413 nt, Artificial Sequence; identical to SEQ ID NO: 138648
  derived and/or modified sequence opt3 from neuraminidase__InfluenzaA__ACO94873

SEQ ID NO: 138713 - RNA, 1410 nt, Artificial Sequence
  derived and/or modified sequence opt3 from neuraminidase__InfluenzaA__ACO94884
augaaccccaaucagaagaucauuaccauaggcagcgugucccugacaaucgccacuauuugcuuccucaugcaaaucgcuauucuugucacgaccguuacacugcacuuuaaacagcaugaguguaacucuccuccaaauaaccaggugauguugugcgaaccgacuaucauagagagaaauaucaccgaaauuguauacuuaacaaacaccacuaucgagaaggaaaugugucccaaacuggcagaguauaggaauuggucaaagccucagugcaacauuacaggguucgccccauuuaguaaagacaauagcauccggcuauccgcgggaggugauauaugggugacccgcgagcccuacgucucuugugacccugauaagugcuaucaauucgcucucggccaggggacgacucugaacaauggacacucgaacgacaccgugcaugaucgaacaccauaccguacucuucugaugaaugaauugggcguucccuuucaccucgguaccagacagguguguauugccuggucaagcaguuccugccaugacgggaaggcauggcugcacgucugugugacaggagaugacaaaaacgccaccgcuucuuucaucuauaauggcaggcugguagauagcauuggcuccuggucaaagaaaauccuccggacgcaggagagugaaugcguuuguaucaacgggacuugcacaguggucaugaccgacggaagcgcaucugguaaggccgauacuaaaauuuuauuuauagaggagggcaagaucgugcacauuuccacacugucagggagcgcucaacauguggaagagugcaguuguuacccucgcuauccaggagucagaugcguuuguagggacaacuggaagggcucuaaucggccgaucguggauauaaacguaaaagacuacuccauugugagcucguacgucugcucuggucuugugggggacacccccaggaagaaugauuccuucucaaguagccacuguuuggacccuaacaaugaagagggaggccauggcguuaaagggugggccuuugaugacggaaacgauguguggaugggucgaacgaucuccgaaaagcugagaucuggcuaugagaccuucaaagucaucgagggguggagcaagccaaauucaaaacuacagauuaaccgccaggugaucguagaacggggaaaucguaguggcuacuccgguauuuuuagcguugaggggaagucuugcauaaaccgcuguuucuauguggaacucaucagaggcaggaaggaggaaacagaggucugguggacuucaaauaguauuguggucuuuugcggaaccagcggcacauacgggacuggauccuggcccgacggugcggauaucaaccugaugccuaucuga

SEQ ID NO: 138714 - RNA, 1410 nt, Artificial Sequence; identical to SEQ ID NO: 136730
  derived and/or modified sequence opt3 from neuraminidase__InfluenzaA__ACO94906

SEQ ID NO: 138715 - RNA, 1410 nt, Artificial Sequence; identical to SEQ ID NO: 136161
  derived and/or modified sequence opt3 from neuraminidase__InfluenzaA__ACO94917

SEQ ID NO: 138716 - RNA, 1410 nt, Artificial Sequence; identical to SEQ ID NO: 136730
  derived and/or modified sequence opt3 from neuraminidase__InfluenzaA__ACO94928

SEQ ID NO: 138717 - RNA, 1410 nt, Artificial Sequence; identical to SEQ ID NO: 136161
  derived and/or modified sequence opt3 from neuraminidase__InfluenzaA__ACO94939

SEQ ID NO: 138718 - RNA, 1410 nt, Artificial Sequence
  derived and/or modified sequence opt3 from neuraminidase__InfluenzaA__ACO94950
augaaccccaaucagaagaucauuaccauaggcagcgugucccugacaaucucuacuauuugcuuccucaugcaaaucgccauucuuaucacgaccgucacacugcacuuuaaacaguacgaguucaacucaccuccaaauaaccagguuauguugugugaaccgacuauaaucgagagaaauauuaccgaaaucguguauuuaacaaacaccacuauugagaaggaaaucugccccaaacuggcugaguacaggaauuggaguaagccucagugugacauaacaggguuugcaccauucagcaaagauaacuccauucggcuaucugccggaggugacaucuggguaacccgcgagcccuaugugucgugcgauccugacaaguguuaccaauuugcgcucggccaggggacgacucugaauaacguccauucaaaugauaccgugcacgaccgaacaccauaucguacucuucugaugaacgaauugggaguucccuuccaucucggcaccaaacaggugugcauugcuuggagcaguuccucuugucacgaugguaaggccuggcugcaugucugcgugacaggggacgauaagaaugcaaccgccagcuuuaucuacaacggaagacugguagacuccaucguuucauggaguaaaaagauucucaggacgcaggagagcgaaugugugugcauaaauggcacuuguacagucgugaugaccgauggcucugcuuccgggaaagcagacacuaagaucuuauucauugaggagggaaagaucgugcacacaucaacccugagcgguagugcccaacacgucgaagagugcucuugcuauccucgguacccaggcguucgcugugugugcagagauaacuggaaaggguccaacaggccgauaguagacauuaauaucaaggacuacagcaucgugucgucuuaugucuguuccggacuugugggcgauacgccccggaaaaacgacucaaguagcuccucucauugcuuggauccuaauaacgaagagggugggcacggaguuaagggcugggcuuuugacgauggcaaugacguguggauggggcgcaccauuagcgaaaaacugcgaucaggauacgagacauucaaggucaucgaggguuggaguaacccaaauuccaaacuacagauuaacagacaggugauaguagauaggggcaaucggagcggguauucuggaaucuuuucaguugaaggcaagaguuguauuaaccguugcuucuacguggagcucauccgcgguagaaaggaagagacugaaguccuguggaccagcaauuccaucguggucuuuugugggacaucuggcacuuauggaaccggcucguggcccgacggggccgauauuaaccuuaugccuauauga

SEQ ID NO: 138719 - RNA, 1410 nt, Artificial Sequence
  derived and/or modified sequence opt3 from neuraminidase__InfluenzaA__ACO94961
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaauuaugccccaaacuggcugaguacaggaauuggaguaagccucagugugacaucacaggguucgcaccauuuagcaaagauaacuccauacggcuaucugccggaggugacauuuggguaacccgcgagcccuaugugucgugcgauccugacaaguguuaccaauucgcgcucggccaggggacgacucugaauaacguccauucaaaugauaccgugcacgaccgaacaccauaucguacucuucugaugaacgaauugggaguucccuuucaucucggcaccaaacaggugugcaucgcuuggagcaguuccucuugucacgaugguaaggccuggcugcaugucugcgugacaggggacgauaagaaugcaaccgccagcuucauuuacaacggaagacugguagacuccaucguuucauggaguaaaaagauccucaggacgcaggagagcgaaugugugugcauuaauggcacuuguacagucgugaugaccgauggcucugcuuccgggaaagcagacacuaagauauuauuuaucgaggagggaaagauugugcacacaucaacccugagcgguagugcccaacacgucgaagagugcucuugcuauccucgguacccaggcguucgcugugugugcagagauaacuggaaaggguccaacaggccgaucguagacauaaauauuaaggacuacagcaucgugucgucuuaugucuguuccggacuugugggcgauacgccccggaaaaacgacucaaguagcuccucucauugcuuggauccuaauaacgaagagggugggcacggaguuaagggcugggcuuucgacgauggcaaugacguguggauggggcgcaccaucagcgaaaaacugcgaucaggauacgagacauuuaaggucauugaggguuggaguaacccaaauuccaaacuacagaucaacagacaggugauuguagauaggggcaaucggagcggguauucuggaauauucucaguugaaggcaagaguuguaucaaccguugcuuuuacguggagcucauucgcgguagaaaggaagagacugaaguccuguggaccagcaauuccaucguggucuucugugggacaucuggcacuuauggaaccggcucguggcccgacggggccgauaucaaccuuaugccuauuuga

SEQ ID NO: 138720 - RNA, 1410 nt, Artificial Sequence
  derived and/or modified sequence opt3 from neuraminidase__InfluenzaA__ACO94972
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacgagaacgcaaccgccagcuucaucuacaauggaagacugguagauuccguugugucauggaguaagaaaauccugaggacgcaggaaagcgagugugucugcauuaacggcacuuguacaguggugaugaccgacggcucugcuuccgggaaggcagauacuaaaauacucuuuaucgaggaaggaaagauuguccacacaucaaccuuaagcgguagugcccaacacguugaggaaugcucuugcuauccucgguacccaggcgugcgcuguguaugcagagacaacuggaagggguccaauaggccgaucguggauauaaacauuaaagacuacagcaucgucucgucuuauguguguuccggacugguuggcgacacgccccggaagaaugauucaaguagcuccucucauugccuugacccuaacaaugaggaaggugggcacggagugaaaggcugggcuuucgaugacggcaacgaugucuggauggggcgcaccaucagcgagaaguugcgaucaggauacgagacauuuaaagugauugaagguuggaguaauccaaacuccaagcugcagaucaauagacagguaauuguugacaggggcaaccggagcggguauucuggaauauucucaguggagggcaaaaguuguaucaaucguugcuuuuacgucgaacuaauucgcgguagaaaccaggagacugaagugcucuggaccagcaauuccaucgucguguucugugggacaucuggcacuuauggaaccggcucguggcccgauggggccgacaucaaccugaugccuauuuga

SEQ ID NO: 138721 - RNA, 1410 nt, Artificial Sequence
  derived and/or modified sequence opt3 from neuraminidase__InfluenzaA__ACO95156
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaacaugccccaaauuagcugaguacaggaauuggaguaagccucaguguaacaucaccggguucgcaccauuuagcaaagacaauuccauacggcugucugccggaggugauauuuggguaacgcgcgagcccuaugugucgugcgacccugauaaguguuaccaauucgcgcuaggccaggggacuacccucaacaauguccauucaaacgacacagugcacgaucgaacuccauaucguacccugcuuaugaaugaacugggaguucccuuucauuugggcacaaaacaggugugcaucgcuuggagcaguuccucuugucacgacgguaaggccuggcuccaugucugcauuaccggggaugacaagaacgcaacggccagcuucaucuacaauggaagacugguggauuccguaguuucauggaguaaaaagauccugaggacucaggagagcgaaugugugugcauuaacggcacauguaccgucgugaugacugacggcucugcuuccgggaaagcagauacaaagauacucuuuaucgaggagggaaagauugugcacaccucaacguuaagcgguagugcccaacacgucgaagagugcucuugcuauccucgguacccaggcguucgcugugugugcagagacaacuggaaaggguccaauaggccgaucguagauauaaacauuaaggacuacagcaucgugucgucuuaugucuguuccggacuggugggcgacacaccccggaaaaaugauucaaguagcuccucucauugccuugacccuaacaaugaagagggugggcacggaguuaagggcugggcuuucgaugacggcaacgauguguggauggggcgcaccaucagcgaaaaauugcgaucaggauacgagacuuuuaaggucauugaggguuggaguaauccaaacuccaaacugcagaucaauagacaggugauuguagacaggggcaaccggagcggguauucuggaauauucucaguugaaggcaagaguuguaucaaucguugcuuuuacguggagcuaauucgcgguagaaaccaggaaaccgagguccucuggacaagcaauuccaucguggucuucugugggacuucuggcaccuauggaacaggcucguggcccgauggggccgacaucaaccugaugccuauuuga

SEQ ID NO: 138722 - RNA, 1410 nt, Artificial Sequence; identical to SEQ ID NO: 136343
  derived and/or modified sequence opt3 from neuraminidase__InfluenzaA__ACO95174

SEQ ID NO: 138723 - RNA, 1410 nt, Artificial Sequence; identical to SEQ ID NO: 136343
  derived and/or modified sequence opt3 from neuraminidase__InfluenzaA__ACO95185

SEQ ID NO: 138724 - RNA, 1410 nt, Artificial Sequence
  derived and/or modified sequence opt3 from neuraminidase__InfluenzaA__ACO95196
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccauucacgaucgaacaccauaucguacucugcuuaugaaugaacugggagugcccuuucauuugggcaccaagcagguuugcaucgcuuggagcaguuccucuugucacgacgguaaagccuggcuccaugugugcgucacaggggaugacaagaacgcaaccgccagcuucaucuacaauggaagacugguggauuccguaguuucauggaguaaaaagauucugaggacgcaggagagcgaaugugugugcauaaacggcacuuguacagucgugaugaccgacggcucugcuuccgggaaagcagauacuaagauccucuuuauugaggagggaaagaucgugcacacaucaaccuuaagcgguagugcccaacacgucgaagagugcucuugcuauccucgguacccaggcguucgcugugugugcagagacaacuggaaaggguccaauaggccgauaguagauauuaacaucaaggacuacagcaucgugucgucuuaugucuguuccggacuggugggcgacacgccccggaaaaaugauucaaguagcuccucucauugccuugacccuaacaaugaagagggugggcacggaguuaagggcugggcuuucgaugacggcaacgauguguggauggggcgcaccauuagcgaaaaauugcgaucaggauacgagacauuuaaggucaucgaggguuggaguaauccaaacuccaaacugcagauuaauagacaggugauaguagacaggggcaaccggagcggguauucuggaaucuucucaguugaaggcaagaguuguauuaaucguugcuuuuacguggagcuaauccgcgguagaaaccaggaaacugagguccucuggaccagcaauuccaucguggucuucugugggacaucuggcacuuauggaaccggcucguggcccgauggggccgacauuaaccugaugccuauauga

SEQ ID NO: 138725 - RNA, 1410 nt, Artificial Sequence; identical to SEQ ID NO: 136343
  derived and/or modified sequence opt3 from neuraminidase__InfluenzaA__ACO95207

SEQ ID NO: 138726 - RNA, 1410 nt, Artificial Sequence; identical to SEQ ID NO: 136343
  derived and/or modified sequence opt3 from neuraminidase__InfluenzaA__ACO95218

SEQ ID NO: 138727 - RNA, 1410 nt, Artificial Sequence; identical to SEQ ID NO: 136346
  derived and/or modified sequence opt3 from neuraminidase__InfluenzaA__ACO95229

SEQ ID NO: 138728 - RNA, 1410 nt, Artificial Sequence; identical to SEQ ID NO: 136728
  derived and/or modified sequence opt3 from neuraminidase__InfluenzaA__ACO95240

SEQ ID NO: 138729 - RNA, 1410 nt, Artificial Sequence; identical to SEQ ID NO: 136589
  derived and/or modified sequence opt3 from neuraminidase__InfluenzaA__ACO95262

SEQ ID NO: 138730 - RNA, 1410 nt, Artificial Sequence; identical to SEQ ID NO: 138527
  derived and/or modified sequence opt3 from neuraminidase__InfluenzaA__ACO95273

SEQ ID NO: 138731 - RNA, 1410 nt, Artificial Sequence; identical to SEQ ID NO: 138619
  derived and/or modified sequence opt3 from neuraminidase__InfluenzaA__ACO95306

SEQ ID NO: 138732 - RNA, 1413 nt, Artificial Sequence
  derived and/or modified sequence opt3 from neuraminidase__InfluenzaA__ACO95385
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccgacaaggccgcgucauacaaaaucuucaagauugaaaagggaaaaguaacaaagaguauagagcucaaugcaccuaacuuucauuaugaagaguguagcugcuacccagauaccggcaucguuaugugugugugcagggacaauuggcacggcuccaaccggcccugggucucuuucaaucagaaccuggauuaccaaauuggguauaucugcagcggaguguuuggugacaauccucgcccagaggauggcgaagggucauguaacccggugacggucgacggagccaauggcguuaaagguuucaguuacaaguaugacaacgggguguggaucggcagaacuaaauccaauaggcugcggaagggauuugagaugauuugggaucccaacggcuggacaaauaccgacagcgauuucucuguaaaacaggacguggucgcuauaacugauuggucaggguacagugguagcuuugugcagcacccugaacucacaggauuagacugcauccgcccauguuucuggguugagcuggugcgaggccuucccagagaaaacaccacgauuuggaccuccgggucuucgaucagcuucugcggagucaacuccgauacagccaauuggucauggccugacggcgcagaguugccauuuacuauugauaaguga

SEQ ID NO: 138733 - RNA, 1413 nt, Artificial Sequence; identical to SEQ ID NO: 138648
  derived and/or modified sequence opt3 from neuraminidase__InfluenzaA__ACO95407

SEQ ID NO: 138734 - RNA, 1413 nt, Artificial Sequence; identical to SEQ ID NO: 138648
  derived and/or modified sequence opt3 from neuraminidase__InfluenzaA__ACO95418

SEQ ID NO: 138735 - RNA, 1410 nt, Artificial Sequence; identical to SEQ ID NO: 136161
  derived and/or modified sequence opt3 from neuraminidase__InfluenzaA__ACO95429

SEQ ID NO: 138736 - RNA, 1410 nt, Artificial Sequence; identical to SEQ ID NO: 136730
  derived and/or modified sequence opt3 from neuraminidase__InfluenzaA__ACO95440

SEQ ID NO: 138737 - RNA, 1410 nt, Artificial Sequence
  derived and/or modified sequence opt3 from neuraminidase__InfluenzaA__ACO95462
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagauuaauagacaggugauaguagacaggggcaaccggagcggguauucuggaaucuucucaguugagggcaaaaguuguauuaaucguugcuuuuacguggaacuaauccgcgguagaaaggaggaaacugagguccucuggaccagcaacuccaucguggucuucugugggacaucuggcacuuauggaaccggcucguggcccgauggggccgacauuaaucugaugcuuauauga

SEQ ID NO: 138738 - RNA, 1410 nt, Artificial Sequence; identical to SEQ ID NO: 136728
  derived and/or modified sequence opt3 from neuraminidase__InfluenzaA__ACO95484

SEQ ID NO: 138739 - RNA, 1410 nt, Artificial Sequence; identical to SEQ ID NO: 136728
  derived and/or modified sequence opt3 from neuraminidase__InfluenzaA__ACO95495

SEQ ID NO: 138740 - RNA, 1410 nt, Artificial Sequence; identical to SEQ ID NO: 136728
  derived and/or modified sequence opt3 from neuraminidase__InfluenzaA__ACO95506

SEQ ID NO: 138741 - RNA, 1410 nt, Artificial Sequence
  derived and/or modified sequence opt3 from neuraminidase__InfluenzaA__ACO95517
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgacugggauacgagacauuuaaagucaucgaagguuggucaaauccaaacaguaagcuacagauuaauagacaggugauaguagacaggggcaaccgguccggguauagcggaaucuucucuguugagggcaaaucauguauuaaucguugcuuuuacguggaacucauccgcgguagaaaggaggaaacugagguccuguggaccaguaacagcaucguggucuucugugggacauccggcacuuauggaaccggcucuuggcccgauggggccgacauuaaucuuaugccuauauga

SEQ ID NO: 138742 - RNA, 1410 nt, Artificial Sequence
  derived and/or modified sequence opt3 from neuraminidase__InfluenzaA__ACO95539
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcaaacacuaaaauccucuuuauugaggaaggaaagaucgugcacacaucaaccuuaagcgguagugcccaacacgucgaggaaugcucuugcuauccucgguacccaggcguucgcugugugugcagagauaauuggaagggguccaacaggccgauaguagacauuaauaucaaagauuacagcaucgugucgucuuaugucuguuccggacuggugggcgacacgccccggaagaacgacucaaguagcuccucucauugccuugauccuaauaacgaggaaggugggcacggaguuaaaggcugggcuuucgacgauggcaaugacguguggauggggcgcaccauuagcgagaaguugcgaucaggauacgagacauuuaaagucaucgaagguuggaguaacccaaauuccaagcugcagauuaacagacaggugauaguagauaggggcaaucggagcggguauucuggaaucuucucaguugagggcaaaaguuguauuaaccguugcuuuuacguggaacuaauccgcgguagaaaggaggaaacugagguccucuggaccagcaauuccaucguggucuucugugggacaucuggcacuuauggaaccggcucguggcccgacggggccgauauuaaccugaugccuauauga

SEQ ID NO: 138743 - RNA, 1413 nt, Artificial Sequence
  derived and/or modified sequence opt3 from neuraminidase__InfluenzaA__ACP20223
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuucauuaugaagaguguagcugcuacccagacaccggcaucguuaugugugugugcagggauaacuggcacggcuccaaucggcccugggucucuuucaaccagaaucuggacuaccaaauuggguauaucugcagcggaguguuuggugauaacccucgcccagaggacggcgaagggucauguaauccggugacggucgauggagccaacggcguuaaagguuucaguuacaaguaugacaaugggguguggaucggcagaacuaaauccaacaggcugcggaagggauuugagaugauuugggaccccaauggcuggacaaacaccgauagcgacuucucuguaaaacaggauguggucgcugugacugacuggucaggguacaguggauccuuuguucagcacccugaacucacagguuuagauugcauacgcccauguuucuggguggagcugguccgaggccuucccagagaaaacaccacgaucuggaccuccgggucuucgauuagcuucugcggagugaauagcgacacagccaacuggucauggccugauggcgcagaguugccauuuacuaucgacaaguga

SEQ ID NO: 138744 - RNA, 1410 nt, Artificial Sequence
  derived and/or modified sequence opt3 from neuraminidase__InfluenzaA__ACP41952
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuucggaucgaaaaggguaaaauugugaagucagucgagaugaacgcccccaauuaucauuacgaagagugcaguuguuacccugacagcuccgagaucacuugcguuugccgcgauaacuggcacgggucuaauagaccaugggugagcuucaaccagaaucucgaauaucagauuggauacauauguucaggcaucuuuggcgacaacccgaggcccaaugauaaaaccgggaguugcggaccuguauccagcaacggugcgaacggcgugaagggguucucuuuuaaguauggaaauggcgucuggauuggucggacaaaaucaaucaguagccgcaacggguucgagaugaucugggacccaaauggcuggaccggaacggauaacaauuuuuccauuaagcaagacauagugggcaucaacgaauggucuggguacucggggagcuucguucagcaucccgagcugacuggucuggacuguauucgaccuugcuucuggguggaacucaucagaggcaggccaaaagagaauacaauuuggaccuccgggucaaguaucucuuuuuguggagucaacagcgauacugugggcugguccuggcccgacggugcagaguuaccguucacaauagauaaguga

SEQ ID NO: 138745 - RNA, 1410 nt, Artificial Sequence; identical to SEQ ID NO: 138744
  derived and/or modified sequence opt3 from neuraminidase__InfluenzaA__ACP44158

SEQ ID NO: 138746 - RNA, 1413 nt, Artificial Sequence
  derived and/or modified sequence opt3 from neuraminidase__InfluenzaA__ACP44195
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccgacaaggccgcgucauacaaaaucuucaagauugaaaagggaaaaguaacaaagaguauagagcucaaugcaccuaacuuucauuaugaagaguguagcugcuacccagauaccggcaucguuaugugugugugcagggacaauuggcacggcuccaaccggcccugggucucuuucaaucagaaccuggauuaccaaauuggguauaucugcagcggaguguuuggugacaauccucgcccagaggauggcgaagggucauguaacccggugacggucgacggagccaauggcguuaaagguuucaguuacaaguaugacaacgggguguggaucggcagaacuaaauccaauaggcugcggaagggauuugagaugauuugggaucccaacggcuggacaaauaccgacagcgauuucucuguaaaacaggacguggucgcuauaacugauuggucaggguacagugguagcuuugugcagcacccugaacucacaggauuaaacugcauccgcccauguuucuggguugagcuggugcgaggccuucccagagaaaacaccacgauuuggaccuccgggucuucgaucagcuucugcggagucaauuccgacacagccaacuggucauggccugauggcgcagaguugccauuuacuauugacaaguga

SEQ ID NO: 138747 - RNA, 1413 nt, Artificial Sequence; identical to SEQ ID NO: 138648
  derived and/or modified sequence opt3 from neuraminidase__InfluenzaA__ACP44217

SEQ ID NO: 138748 - RNA, 1413 nt, Artificial Sequence; identical to SEQ ID NO: 138648
  derived and/or modified sequence opt3 from neuraminidase__InfluenzaA__ACP44228

SEQ ID NO: 138749 - RNA, 1410 nt, Artificial Sequence; identical to SEQ ID NO: 136730
  derived and/or modified sequence opt3 from neuraminidase__InfluenzaA__ACP44239

SEQ ID NO: 138750 - RNA, 1410 nt, Artificial Sequence
  derived and/or modified sequence opt3 from neuraminidase__InfluenzaA__ACP44250
augaaccccaaucagaagaucauuaccauaggcagcgugucccugacaaucucuacuauuugcuucuuuaugcaaaucgccauucucaugacgaccgucacacuucacuucaaacaguacgaguuuaacucaccuccaaauaaccagguuaugcugugugaaccgacuaucauagagagaaauaucaccgaaauuguguauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcaucgcuuggagcaguuccucuugucacgaugguaaggccuggcuccaugucugcgugacaggggacgauaagaaugcaaccgccagcuucauuuacaacggaagacugguagacuccaucguuucauggaguaaagagauccugaggacgcaggaaagcgagugugugugcauuaauggcacuuguacagucgugaugaccgauggcucugcuuccgggaaggcagacacuaaaauacucuuuaucgaggaaggaaagauugugcacacaucaaccuuaagcgguagugcccaacacgucgaggaaugcucuugcuauccucgguacccaggcguucgcugugugugcagagauaacuggaagggguccaacaggccgaucguagacauaaauauuaaagacuacagcaucgugucgucuuaugucuguuccggacuggugggcgauacgccccggaagaacgacucaaguagcuccucucauugccuugauccuaauaacgaggaaggugggcacggaguuaaaggcugggcuuucgacgauggcaaugacguguggauggggcgcaccaucagcgagaaguugcgaucaggauacgagacauuuaaagucauugaagguuggaguaacccaaauuccaagcugcagaucaacagacaggugauuguagauaggggcaaucggagcggguauucuggaauauucucaguugagggcaaaaguuguaucaaccguugcuuuuacguggaacuaauucgcgguagaaaggaggaaacugagguccucuggaccagcaauuccaucguggucuucugugggacaucuggcacuuauggaaccggcucguggcccgacggggccgauaucaaccugaugccuauuuga

SEQ ID NO: 138751 - RNA, 1410 nt, Artificial Sequence
  derived and/or modified sequence opt3 from neuraminidase__InfluenzaA__ACP44261
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauaugcauucaaacgacaccguccacgaucgaacaccauaucguacucugcuuaugaaugaacugggagugcccuuucauuugggcaccaagcagguuugcauugcuuggagcaguuccucuugucacgacgguaaagccuggcuccaugugugcgucacaggggaugacaagaacgcaaccgccagcuucaucuacaauggaagacugguggauuccaucguaucauggaguaaagagauucugaggacgcaggaaagcgaguguguuugcauaaacggcacuuguacaguggucaugaccgacggcucugcuuccgggaaggcagauacuaaaauccucuuuauugaggaaggaaagaucgugcacacaucaaccuuaagcgguagugcccaacacguggaggaaugcucuugcuauccucgguacccaggcguccgcuguguuugcagagacaacuggaagggguccaauaggccgauaguggauauuaacaucaaagacuacagcaucguaucgucuuauguguguuccggacuggucggcgacacgccccggaagaaugauucaaguagcuccucucauugccuugacccuaacaaugaggaaggugggcacggagugaaaggcugggcuuucgaugacggcaacgauguuuggauggggcgcaccauuagcgagaaguugcgaucaggauacgagacauuuaaagugaucgaagguuggaguaauccaaacuccaagcugcagauuaauagacaggucauaguggacaggggcaaccggagcggguauucuggaaucuucucaguagagggcaaaaguuguauuaaucguugcuuuuacguugaacuaauccgcgguagaaaggaggaaacugaggugcucuggaccagcaacuccaucgucguguucugugggacaucuggcacuuauggaaccggcucguggcccgauggggccgacauuaaucugaugccuauauga

SEQ ID NO: 138752 - RNA, 1410 nt, Artificial Sequence
  derived and/or modified sequence opt3 from neuraminidase__InfluenzaA__ACP44272
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucaucaugaccgacggcucugcuuccgggaaggcagauacuaaaauucucuuuaucgaggaaggaaagauagugcacacaucaaccuuaagcgguagugcccaacacguggaggaaugcucuugcuauccucgguacccaggcguccgcuguguuugcagagacaacuggaagggguccaauaggccgauuguggauaucaacaucaaagacuacagcauuguaucgucuuauguguguuccggacuggucggcgacacgccccggaagaaugauucaaguagcuccucucauugccuugacccuaacaaugaggaaggugggcacggagugaaaggcugggcuuucgaugacggcaacgauguuuggauggggcgcaccaucagcgagaaguugcgaucaggauacgagacauuuaaagugauugaagguuggaguaauccaaacuccaagcugcagauaaauagacaggucaucguggacaggggcaaccggagcggguauucuggaauuuucucaguagagggcaaaaguuguaucaaucguugcuuuuacguugaacuaauccgcgguagaaaggaggaaacugaggugcucuggaccagcaacuccauugucguguucugugggacaucuggcacuuauggaaccggcucguggcccgauggggccgacauaaaucugaugccuaucuga

SEQ ID NO: 138753 - RNA, 1410 nt, Artificial Sequence; identical to SEQ ID NO: 138744
  derived and/or modified sequence opt3 from neuraminidase__InfluenzaA__ACQ55360

SEQ ID NO: 138754 - RNA, 1410 nt, Artificial Sequence
  derived and/or modified sequence opt3 from neuraminidase__InfluenzaA__ACQ63236
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 138755 - RNA, 1410 nt, Artificial Sequence; identical to SEQ ID NO: 138754
  derived and/or modified sequence opt3 from neuraminidase__InfluenzaA__ACQ63242

SEQ ID NO: 138756 - RNA, 1410 nt, Artificial Sequence; identical to SEQ ID NO: 138754
  derived and/or modified sequence opt3 from neuraminidase__InfluenzaA__ACQ63253

SEQ ID NO: 138757 - RNA, 1410 nt, Artificial Sequence; identical to SEQ ID NO: 138754
  derived and/or modified sequence opt3 from neuraminidase__InfluenzaA__ACQ63262

SEQ ID NO: 138758 - RNA, 1410 nt, Artificial Sequence
  derived and/or modified sequence opt3 from neuraminidase__InfluenzaA__ACQ65694
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauaacaggguucgcaccauuuagcaaggacaacuccauucggcugucugccggaggugauaucuggguaacccgcgagcccuaugugucgugcgacccugauaaguguuaccaauucgcgcuaggccaggggacgacucucaauaacguccauucaaaugacaccgugcgagaucguacaccauauagaacucugcuuaugaacgaacugggaguucccuuucacuugggcaccaaacaggugugcauugcuuggagcaguuccucuugucaugacgguaaggccuggcuccacgucugcgugacaggggaugacaaaaaugcaaccgccagcuucaucuacaacggaaggcugguagauuccaucguuucauggaguaaggacauucugcggacgcaggagagcgaaugugugugcauaaauggcacuuguacagucgugaugaccgauggcucugcuuccgggaaagcagacacuaagauccucuuuauugaggagggaaagaucgugcauacaucaaccuuaagcgguagugcccaacacgucgaagagugcucuugcuauccucgcuacccaggcguuagaugugugugcagggauaacuggcggggguccaaccgcccgauaguagacauuaauaugaaagacuacagcaucgugucgucuuaugucuguuccggacuggugggcgauacgccccgaaagaacgacucaaguagcuccggucacugccuugauccuaauaacgaagaagggggacauggcguuaaaggcugggcuuucgacgaugggaaugacguguggaugggaagaaccaucucugagaaguugaggagcgguuacgagacauuuaaagucauugagggcuggucaaacccaaauaguaagcugcagaucaaccgucaggugauuguagaucgggggaaucgcuccggauauagcggcauauucucuguugaagguaaaucauguaucaacagaugcuuuuacguggagcuaauuagggggcggaaggaagagacugaaguccucuggaccaguaauagcaucguggucuucuguggcacauccggaacuuauggcaccgggucuuggcccgacggagccgauaucaaccugaugccuauuuga

SEQ ID NO: 138759 - RNA, 1410 nt, Artificial Sequence
  derived and/or modified sequence opt3 from neuraminidase__InfluenzaA__ACQ65705
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauaacaggguucgcaccauuuagcaaggacaacuccauucggcugucugccggaggugauaucuggguaacccgcgagcccuaugugucgugcgacccugauaaguguuaccaauucgcgcuaggccaggggacgacucucaauaacguccauucaaaugacaccgugcgagaucguacaccauauagaacucugcuuaugaacgaacugggaguucccuuucacuugggcaccaaacaggugugcauugcuuggagcaguuccucuugucaugacgguaaggccuggcuccacgucugcgugacaggggaugacaaaaaugcaaccgccagcuucaucuacaacggaaggcugguagauuccaucguuucauggaguaaggagauucugcggacgcaggaaagcgagugugugugcauaaauggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuauccucgcuacccaggcguuagaugugugugcagggacaacuggcggggguccaaccgcccgauaguagauauuaauaugaaagacuacagcaucgugucgucuuaugucuguuccggacuggugggcgacacgccccgaaagaacgauucaaguagcuccggucacugccuugacccuaauaacgaggaagggggacauggcguuaaaggcugggcuuucgaugacgggaaugauguguggaugggaagaaccaucucugagaaguugaggagcgguuacgagacauuuaaagucauugaaggcuggucaaacccaaauaguaagcugcagaucaaccgucaggugauuguagaccgggggaaucgcuccggauauagcggcauauucucuguugaggguaaaucauguaucaacagaugcuuuuacguggaacuaauuagggggcggaaggaggaaacugagguccucuggaccaguaauagcaucguggucuucuguggcacauccggaacuuauggcaccgggucuuggcccgauggagccgacaucaaccugaugccuauuuga

SEQ ID NO: 138760 - RNA, 1410 nt, Artificial Sequence; identical to SEQ ID NO: 138528
  derived and/or modified sequence opt3 from neuraminidase__InfluenzaA__ACQ65716

SEQ ID NO: 138761 - RNA, 1410 nt, Artificial Sequence; identical to SEQ ID NO: 138528
  derived and/or modified sequence opt3 from neuraminidase__InfluenzaA__ACQ65727

SEQ ID NO: 138762 - RNA, 1410 nt, Artificial Sequence; identical to SEQ ID NO: 138615
  derived and/or modified sequence opt3 from neuraminidase__InfluenzaA__ACQ65739

SEQ ID NO: 138763 - RNA, 1410 nt, Artificial Sequence
  derived and/or modified sequence opt3 from neuraminidase__InfluenzaA__ACQ65750
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaaugauacagugcgaaaccguacuccauauagaacccugcuuaugaaugaacugggaguucccuuucacuugggcacaaaacaggugugcaucgcuuggagcaguuccucuugucaugacgguaaggccuggcuccacgucugcauuaccggggaugacaagaacgcaacggccagcuucaucuacaauggaaggcugguggauuccaucguaucauggaguaaagagauucugcggacucaggaaagcgaguguguuugcauaaacggcacauguaccguggucaugacugacggcucugcuuccgggaaggcagauacaaaaauccucuuuauugaggaaggaaagaucgugcauaccucaacguuaagcgguagugcccaacacguggaggaaugcucuugcuauccucgcuacccaggcgucagauguguuugcagggacaacuggaagggguccaaucggccgauaguggauauuaacaucaaagaccacagcaucguaucgucuuacguguguuccggacuggucggcgacacaccccgcaagaaugauucaaguagcuccucucauugccuugacccuaacaaugaggaaggugggcacggagugaaaggcugggcuuucgaugacggcaacgauguuuggauggggcgaaccauuagcgagaagucaagauugggauaugagacuuuuaaagugaucgaagguuggaguaauccaaaguccaaacugcagauuaacaggcaggucauaguggaccggggcaaucguagcggguacucuggaaucuucucaguagagggcaagaguuguauuaaccgcugcuuuuauguugaacuaaucagagguaggaaggaggaaaccgaggugcucuggacaagcaauuccaucgucguguucugugggacuucuggcaccuacggaacaggcucguggcccgauggggccgacauuaaccugaugccuauauga

SEQ ID NO: 138764 - RNA, 1413 nt, Artificial Sequence; identical to SEQ ID NO: 138648
  derived and/or modified sequence opt3 from neuraminidase__InfluenzaA__ACQ65761

SEQ ID NO: 138765 - RNA, 1410 nt, Artificial Sequence; identical to SEQ ID NO: 138744
  derived and/or modified sequence opt3 from neuraminidase__InfluenzaA__ACQ73394

SEQ ID NO: 138766 - RNA, 1410 nt, Artificial Sequence; identical to SEQ ID NO: 138744
  derived and/or modified sequence opt3 from neuraminidase__InfluenzaA__ACQ73395

SEQ ID NO: 138767 - RNA, 1410 nt, Artificial Sequence; identical to SEQ ID NO: 138754
  derived and/or modified sequence opt3 from neuraminidase__InfluenzaA__ACQ73396

SEQ ID NO: 138768 - RNA, 1410 nt, Artificial Sequence; identical to SEQ ID NO: 138754
  derived and/or modified sequence opt3 from neuraminidase__InfluenzaA__ACQ76291

SEQ ID NO: 138769 - RNA, 1410 nt, Artificial Sequence
  derived and/or modified sequence opt3 from neuraminidase__InfluenzaA__ACQ76298
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccaucaugacagauggaccaucuaauggccaggcuuccuacaaaaucuuucggauugaaaaggguaaaaucgugaagucaguggagaugaacgcccccaauuaucauuacgaagagugcaguuguuacccugacagcuccgagauuacuugcgucugccgcgauaacuggcacgggucuaauagaccauggguuagcuucaaccagaaucucgaauaucagauaggauacaucuguucaggcauuuuuggcgacaacccgaggcccaaugauaaaaccgggaguugcggaccuguguccagcaacggugcgaacggcguaaagggguucucuuuuaaguauggaaauggcguguggaucggucggacaaaaucaaucaguagccgcaacggguucgagaugauuugggacccaaauggcuggaccggaacggauaacaauuuuuccauaaagcaagacaucgucggcauuaacgaauggucuggguacucggggagcuucgugcagcaucccgagcugacuggucuggacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 138770 - RNA, 1410 nt, Artificial Sequence; identical to SEQ ID NO: 138754
  derived and/or modified sequence opt3 from neuraminidase__InfluenzaA__ACQ76308

SEQ ID NO: 138771 - RNA, 1410 nt, Artificial Sequence; identical to SEQ ID NO: 138754
  derived and/or modified sequence opt3 from neuraminidase__InfluenzaA__ACQ76316

SEQ ID NO: 138772 - RNA, 1410 nt, Artificial Sequence; identical to SEQ ID NO: 138744
  derived and/or modified sequence opt3 from neuraminidase__InfluenzaA__ACQ76322

SEQ ID NO: 138773 - RNA, 1410 nt, Artificial Sequence; identical to SEQ ID NO: 138744
  derived and/or modified sequence opt3 from neuraminidase__InfluenzaA__ACQ76328

SEQ ID NO: 138774 - RNA, 1410 nt, Artificial Sequence; identical to SEQ ID NO: 138744
  derived and/or modified sequence opt3 from neuraminidase__InfluenzaA__ACQ76335

SEQ ID NO: 138775 - RNA, 1410 nt, Artificial Sequence; identical to SEQ ID NO: 138744
  derived and/or modified sequence opt3 from neuraminidase__InfluenzaA__ACQ76342

SEQ ID NO: 138776 - RNA, 1410 nt, Artificial Sequence; identical to SEQ ID NO: 138744
  derived and/or modified sequence opt3 from neuraminidase__InfluenzaA__ACQ76351

SEQ ID NO: 138777 - RNA, 1410 nt, Artificial Sequence; identical to SEQ ID NO: 138744
  derived and/or modified sequence opt3 from neuraminidase__InfluenzaA__ACQ76359

SEQ ID NO: 138778 - RNA, 1410 nt, Artificial Sequence; identical to SEQ ID NO: 138754
  derived and/or modified sequence opt3 from neuraminidase__InfluenzaA__ACQ76364

SEQ ID NO: 138779 - RNA, 1410 nt, Artificial Sequence; identical to SEQ ID NO: 138754
  derived and/or modified sequence opt3 from neuraminidase__InfluenzaA__ACQ76367

SEQ ID NO: 138780 - RNA, 1410 nt, Artificial Sequence
  derived and/or modified sequence opt3 from neuraminidase__InfluenzaA__ACQ76379
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacaaaaauaacaccuggguuaaucagacauaugugaacaucagcaauacuaacuucgcugcaggccaguccguagugucugucaagcuggccggaaauucgucauugugcccugugagcggaugggcgauauacaguaaagacaacuccguuagaauuggcucuaagggugauguguuugucaucagggaaccauucauuagcuguuccccguuagagugccggaccuuuuuccugacacagggggcucuacucaaugacaaacauucaaacggaaccaucaaggaucgcagucccuaucgaacucugaugagcuguccuaucggcgaagugccaucucccuacaacucccguuuugagucaguagccuggagcgcaagugccugccacgacggcauuaauuggcuuacaauagggaucucuggaccugauaacggugcuguugcagugcugaaguauaauggcauuaucaccgacacgauaaaauccuggagaaacaauauuuugaggacucaagaaagcgagugugccugcgucaacgggucguguuucaccgugaugacagauggaccaucuaauggccaggcuuccuacaagaucuuucggaucgagaaagguaagauugugaaaucagucgaaaugaacgcccccaauuaucauuacgaggaaugcaguuguuacccugacagcuccgagaucacuugcguuugccgcgauaacuggcacgggucuaauagaccaugggugagcuucaaccagaaucucgaguaucagauuggauacauauguucaggcaucuuuggcgacaacccgaggcccaaugauaagaccgggaguugcggaccuguauccagcaacggugcgaacggcgugaagggguucucuuuuaaauauggaaauggcgucuggauuggucggacaaagucaaucaguagccgcaacggguucgaaaugaucugggacccaaauggcuggaccggaacggauaacaauuuuuccauuaaacaagacauagugggcaucaacgaguggucuggguacucggggagcuucguucagcaucccgaacugacuggucuggacuguauucgaccuugcuucuggguggagcucaucagaggcaggccaaaggaaaauacaauuuggaccuccgggucaaguaucucuuuuuguggagucaacagcgauacugugggcugguccuggcccgacggugcagaguuaccguucacaauagauaaauga

SEQ ID NO: 138781 - RNA, 1410 nt, Artificial Sequence; identical to SEQ ID NO: 138754
  derived and/or modified sequence opt3 from neuraminidase__InfluenzaA__ACQ76385

SEQ ID NO: 138782 - RNA, 1410 nt, Artificial Sequence; identical to SEQ ID NO: 138754
  derived and/or modified sequence opt3 from neuraminidase__InfluenzaA__ACQ76388

SEQ ID NO: 138783 - RNA, 1410 nt, Artificial Sequence; identical to SEQ ID NO: 138754
  derived and/or modified sequence opt3 from neuraminidase__InfluenzaA__ACQ76403

SEQ ID NO: 138784 - RNA, 1410 nt, Artificial Sequence
  derived and/or modified sequence opt3 from neuraminidase__InfluenzaA__ACQ76407
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaacucgucauugugcccugugggaggcugggcgauauacagcaaggacaauaguguuagaauugguuccaaaggggauguguuugucaucagggagccauucauuucuuguagcccguuagaaugccggaccuuuuuccugacacagggagcucuacucaaugacaagcauuccaacggcaccaucaaagaucgcucacccuaucgaacucugaugaguuguccuaucggcgaggugccaagccccuacaacucucguuuugaauccguagccuggucagcaagcgccugccacgacgggauuaauuggcuuacaauaggaaucagugguccugauaacggcgcuguugcagugcugaaguauaaugggauuaucaccgacacgauaaagucuuggagaaacaauauuuugaggacucaagaguccgagugugccugcgucaacggaagcuguuucaccgugaugacagauggcccaucgaauggucaggcuucuuacaaaaucuuucggaucgaaaaggggaaaauugugaaguccgucgagaugaacgcccccaauuaucauuacgaagagugcucauguuacccugacaguagcgagaucacuugcguuugccgcgauaacuggcacggauccaauagaccaugggugucuuucaaccagaaucucgaauaucagauuggcuacauauguagcggcaucuuuggggacaacccgaggcccaaugauaaaaccggaucaugcgguccuguaaguuccaacggcgcgaacggggugaagggauucagcuuuaaguauggcaauggugucuggauugggcggacaaaaucuaucucaagucgcaacggcuucgagaugaucugggacccaaauggauggaccggcacggauaacaauuuuagcauuaagcaagacauaguggggaucaacgaaugguccggauacucugguucguucguucagcaucccgagcugacuggccuggacuguauucgaccuugcuucuggguggaacucaucagagggaggccaaaagagaauacaauuuggaccagcggauccucaaucaguuuuuguggcgucaacucugauacuguggguuggagcuggcccgacggggcagaguuaccguucacaauagauaaguga

SEQ ID NO: 138785 - RNA, 1410 nt, Artificial Sequence
  derived and/or modified sequence opt3 from neuraminidase__InfluenzaA__ACQ77603
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccccucugucagggagcgcucaacacguggaggaaugcaguuguuauccacgguacccgggaguccgcugcguuuguagagacaacuggaagggcucuaauaggcccaucguggauauaaacguaaaagacuacuccauugugagcucguaugucugcucuggucuugugggggacaccccucggaagaaugauuccucaaguagcucccauuguuuggacccaaacaaugaggaaggaggccacggcguuaaagggugggccuucgaugacggaaacgauguguggaugggucgcacgaucucugaaaagagccgaucaggcuacgagaccuuuaaagucaucgagggguggaguaagcccaauuccaaacugcagauuaacagacaggugaucguagacaggggaaaucggagcggcuauucugguauuuucucaguugaggggaagaguugcauaaaccguuguuuuuacguggaacuaauccgcggcagaaagcaggagacagaaguccucuggacuagcaauuccauuguggucuucugcggaaccucuggcacauaugggacuggaucguggccugauggugcggacaucaaccugaugccaaucuga

SEQ ID NO: 138786 - RNA, 1410 nt, Artificial Sequence; identical to SEQ ID NO: 138744
  derived and/or modified sequence opt3 from neuraminidase__InfluenzaA__ACQ83309

SEQ ID NO: 138787 - RNA, 1410 nt, Artificial Sequence; identical to SEQ ID NO: 138744
  derived and/or modified sequence opt3 from neuraminidase__InfluenzaA__ACQ84460

SEQ ID NO: 138788 - RNA, 1410 nt, Artificial Sequence; identical to SEQ ID NO: 138744
  derived and/or modified sequence opt3 from neuraminidase__InfluenzaA__ACQ84470

SEQ ID NO: 138789 - RNA, 1410 nt, Artificial Sequence
  derived and/or modified sequence opt3 from neuraminidase__InfluenzaA__ACQ84480
augaacaccaaucagagaaucauuacaauaggcacugugugccugaucgucgggauuguuagccuccuucugcaaaucggaaacauuguguccuuguggaucucucacucaauaaagacgggugagaaaaaucauagugaaaucuguaaccagaauauuaucaccuacgagaacaagacauggguaaaucagacuuaugugaacauuagcaauaccaacaucgccgacggccagggggucacauccauaauuuuagcuggaaauucuucgcugugccccaucucaggcugggcaauuuacagcaaagauaacaguaucaggaucgguuccaagggggacauuuucgugauacgggaaccuuuuaucucuuguagccaccuagagugccgcaccuucuuucucacucaaggagcccugcuuaaugaucgacauuccaacggcacaguuaaagaccguucaccauauagaacccugaugaguuguccgacgggcgaagcgcccagcccuuacaauucuagguucgaguccguggcuuggucagccagcgcaugccacgaugggaugggaugguugacuauugguaucaguggcccagacaacggggccgucgcugugcucaaguauaacggaauaauuaccgauacaaucaagucuuggcggaauaaaauccugcgcacucaggaguccgaauguguaugcauuaacggcagcuguuuuaccaucaugacagacggucccucgaaugggcaggcaucuuacaagauuuucaaaauggagaagggaaaaauaaucaaguccguugaacuggaugccccuaacuaucauuacgaggagugcucauguuacccagacaccggcaagguggucugcgugugcagagauaauuggcacgcuaguaacaggcccugggugagcuuugaccagaaucucgauuaucaaauuggcuacaucuguuccggggucuucggagacaacccucggucuaaugacgguaaaggcaacugcgggccaguuuuaagcaauggagccaacggcgugaaggguuuuucauuccgcuaugggaauggcguauggaucggacgaacgaaaaguauuuccagcagaucuggcuuugaaaugauaugggauccgaacggguggacugagacagacucaaguuucagcaucaagcaggauauuaucgcgcugaccgacugguccggauacucugguucguuugugcagcaccccgaacuuacuggcaugaauuguauuaggccuugcuucugggucgaguugauccgggggcagccaaaagaaagcacaauauggaccuccggaucaaguaucucuuucuguggcguggauagcgagacggcauccuggucauggcccgacggugccgaucugccuuuuaccauugacaaguga

SEQ ID NO: 138790 - RNA, 1410 nt, Artificial Sequence
  derived and/or modified sequence opt3 from neuraminidase__InfluenzaA__ACQ89891
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucuaauggccaggcuuccuacaaaaucuuucggauugaaaaggguaaaaucgugaagucaguggagaugaacgcccccaauuaucauuacgaagagugcaguuguuacccugacagcuccgagauuacuugcgucugccgcgauaacuggcacgggucuaauagaccauggguuagcuucaaccagaaucucgaauaucagauaggauacaucuguaggggcauuuuuggcgacaacccgcggcccaaugauaaaaccgggucaugcggaccugugaguuccaacggugcgaacggcguaaagggguucagcuuuaaguauggaaauggcguguggaucggucgcacaaaaucuaucucaagucgaaacggguucgagaugauuugggacccaaauggcuggaccggaacggauaacaauuuuagcauaaagcaagacaucgucggcauuaacgaaugguccggguacucuggaucguucgugcagcaucccgagcugacuggucuggacuguaucagaccuugcuucuggguugaacucauuaggggccggccaaaagagaauacaaucuggaccagcggguccucaauaaguuuuuguggagugaacucugauacugucggcuggagcuggcccgacggugcagaguuaccguucacaaucgauaaguga

SEQ ID NO: 138791 - RNA, 1410 nt, Artificial Sequence; identical to SEQ ID NO: 138744
  derived and/or modified sequence opt3 from neuraminidase__InfluenzaA__ACQ89918

SEQ ID NO: 138792 - RNA, 1410 nt, Artificial Sequence
  derived and/or modified sequence opt3 from neuraminidase__InfluenzaA__ACQ89919
augaaccccaaucagaagaucauuaccauaggcagcgugugcaugacaaucgggauggccaaccugauucuccaaaucggaaauauuaucuccauauggaucucuagaucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuaggauuggcucuaaaggugauguguuugucauccgggagccauucauuagcuguuccccguuagaaugccgcaccuuuuuccugacacagggggcucuacucaaugacaagcacucaaacggaaccaucaaagaucgaagucccuaucguacucugaugagcuguccuaucggcgaggugccaucucccuacaacuccagauuugaaucaguagccuggagcgcaagugccugccaugacggcauuaauuggcuuacaauagggaucucuggaccugauaacggugcuguugcagugcugaaguauaauggcauuaucaccgacacgauaaaguccuggaggaacaauauuuugcggacucaagagagcgagugugccugcgucaacgggucguguuucaccgugaugacagauggaccaucuaauggccaggcuuccuacaaaaucuuucgcaucgaaaaggguaaaauugugaagucagucgagaugaacgcccccaauuaucacuacgaagagugcaguuguuacccugacagcuccgagaucacuugcguuugcagagauaacuggcaugggucuaauaggccaugggugagcuucaaccagaaucucgaauaucagauuggauacauauguucaggcaucuuuggcgacaacccgcggcccaaugauaaaaccgggaguugcggaccuguauccagcaacggugcgaacggcgugaagggguucucuuuuaaguauggaaauggcgucuggauuggucgcacaaaaucaaucaguagccgaaacggguucgagaugaucugggacccaaauggcuggaccggaacggauaacaauuuuuccauuaagcaagacauagugggcaucaacgaauggucuggguacucggggagcuucguucagcaccccgagcugacuggucuggacuguauuagaccuugcuucuggguggaacucaucaggggccggccaaaagagaauacaauuuggaccuccgggucaaguaucucuuuuuguggagucaacagcgauacugugggcugguccuggcccgacggugcagaguuaccguucacaauagauaaguga

SEQ ID NO: 138793 - RNA, 1410 nt, Artificial Sequence; identical to SEQ ID NO: 138754
  derived and/or modified sequence opt3 from neuraminidase__InfluenzaA__ACQ89920

SEQ ID NO: 138794 - RNA, 1410 nt, Artificial Sequence; identical to SEQ ID NO: 138754
  derived and/or modified sequence opt3 from neuraminidase__InfluenzaA__ACQ89921

SEQ ID NO: 138795 - RNA, 1410 nt, Artificial Sequence; identical to SEQ ID NO: 138744
  derived and/or modified sequence opt3 from neuraminidase__InfluenzaA__ACQ89922

SEQ ID NO: 138796 - RNA, 1410 nt, Artificial Sequence; identical to SEQ ID NO: 138754
  derived and/or modified sequence opt3 from neuraminidase__InfluenzaA__ACQ89923

SEQ ID NO: 138797 - RNA, 1410 nt, Artificial Sequence; identical to SEQ ID NO: 138744
  derived and/or modified sequence opt3 from neuraminidase__InfluenzaA__ACQ99623

SEQ ID NO: 138798 - RNA, 1410 nt, Artificial Sequence; identical to SEQ ID NO: 138754
  derived and/or modified sequence opt3 from neuraminidase__InfluenzaA__ACQ99624

SEQ ID NO: 138799 - RNA, 1410 nt, Artificial Sequence; identical to SEQ ID NO: 138744
  derived and/or modified sequence opt3 from neuraminidase__InfluenzaA__ACQ99626

SEQ ID NO: 138800 - RNA, 1410 nt, Artificial Sequence; identical to SEQ ID NO: 138744
  derived and/or modified sequence opt3 from neuraminidase__InfluenzaA__ACQ99627

SEQ ID NO: 138801 - RNA, 1410 nt, Artificial Sequence; identical to SEQ ID NO: 138744
  derived and/or modified sequence opt3 from neuraminidase__InfluenzaA__ACQ99628

SEQ ID NO: 138802 - RNA, 1410 nt, Artificial Sequence; identical to SEQ ID NO: 138744
  derived and/or modified sequence opt3 from neuraminidase__InfluenzaA__ACQ99629

SEQ ID NO: 138803 - RNA, 1410 nt, Artificial Sequence; identical to SEQ ID NO: 138744
  derived and/or modified sequence opt3 from neuraminidase__InfluenzaA__ACQ99630

SEQ ID NO: 138804 - RNA, 1410 nt, Artificial Sequence; identical to SEQ ID NO: 138754
  derived and/or modified sequence opt3 from neuraminidase__InfluenzaA__ACQ99632

SEQ ID NO: 138805 - RNA, 1410 nt, Artificial Sequence; identical to SEQ ID NO: 138754
  derived and/or modified sequence opt3 from neuraminidase__InfluenzaA__ACQ99633

SEQ ID NO: 138806 - RNA, 1410 nt, Artificial Sequence; identical to SEQ ID NO: 138744
  derived and/or modified sequence opt3 from neuraminidase__InfluenzaA__ACQ99635

SEQ ID NO: 138807 - RNA, 1410 nt, Artificial Sequence; identical to SEQ ID NO: 138744
  derived and/or modified sequence opt3 from neuraminidase__InfluenzaA__ACQ99636

SEQ ID NO: 138808 - RNA, 1410 nt, Artificial Sequence
  derived and/or modified sequence opt3 from neuraminidase__InfluenzaA__ACQ99684
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacgaacaggcuuccuacaaaaucuuucggauugagaagggcaaaaucgugaagucaguggaaaugaaugcccccaacuaucauuacgaggagugcaguuguuacccugauagcuccgaaauuacuugcgucugccgcgacaauuggcacgguucuaacagaccauggguuagcuucaaucagaaccucgaguaucagauaggguacaucuguucaggaauuuuuggcgauaauccgaggcccaacgacaaaaccggcaguugcgggccuguguccagcaauggagcgaacgguguaaagggcuucucuuuuaaguaugggaacggaguguggaucggccggacaaaaucaaucaguagccgcaaugguuucgaaaugauuugggauccaaacggguggaccggcacggacaauaacuuuuccauaaagcaagacaucgucggaauuaaugaguggucuggcuacucggggagcuucgugcagcaucccgaacugacuggacuggauuguauccgaccuugcuucuggguugagcucauuagagguaggccaaaagagaacacaaucuggaccuccggcucaaguauaucuuuuuguggggugaauagcgacacugucggaugguccuggcccgauggcgcagaauuaccguucacaaucgacaaguga

SEQ ID NO: 138809 - RNA, 1410 nt, Artificial Sequence
  derived and/or modified sequence opt3 from neuraminidase__InfluenzaA__ACQ99824
augaacaccaaucagagaaucauuacaauaggcacuaucugccugauuguggggaucauuagccuccuucugcaaaucggaaacauaaucuuguuauggaugucccacucuauucagacgggugagaagucacaucccaaaguguguaaucagaguguuaucaccuacgaaaacaauacaugggugaaccagacuuauguaaauauuagcaacaccaauaucgccgcuggccaaggggugacaccuauaauucuggcaggaaacuccucucuaugcccaaucucgggcugggccauuuacucaaaggacaauagcaucaggaucgguaguaaaggggauauuuucgucaugcgggagccguuuauauccuguucucaccucgaaugccgcaccuucuuucugacucagggagcgcuucugaacgaccgacauagcaauggcacagugaaggaucguucccccuauagaaccuugaugucauguccuaucggcgaggcuccaagucccuacaacagcagguucgaaucuguugccugguccgcaucagccugccacgacgggaugggauggcucacgauugguaucagcggcccugauaauggggcuguggcaguccugaaauauaacggaauaauuacugacaccaucaagaguuggcggaacaagauccugcgcacacaggagucugagugugugugcauuaauggcuccuguuuuacuaucaugaccgaugguccaagcaacgggcaggccucguacaaacucuucaagauggaaaaaggaaagauuauaaaaucuaucgaguuagacgcucccaauuaucauuacgaagagugcuccuguuacccugauacaggcaagguaguuugcgugugcagagacaacuggcacgccucaaauaggccaugggucaguuuugaucaaaaccuggacuaucagauuggcuacaucuguagcgggguguucggagauaauccgcgguccaacgacgguaagggcaauugcgggcccgugcuuucuaacggagcgaauggcgucaaagguuuuagcuuccgcuaugggaacggcguuuggaucggacgaaccaagucaauuaguuccagaagcggcuuugagaugauaugggacccuaauggguggacggaaacugauucuucauucaguaugaaacaggacaucauugcauugacagauuggagcggauacuccgguucuuuugugcagcacccagagcugaccggcaugaacuguaucaggcccugcuucuggguagaacuaauucgggggcaaccuaaggagucgacuaucuggacaagcggauccucaauaaguuucuguggcgucaauucugguaccgccagcugguccuggccagacggggcugaucuccccuuuacgaucgacaaauga

SEQ ID NO: 138810 - RNA, 1410 nt, Artificial Sequence; identical to SEQ ID NO: 138754
  derived and/or modified sequence opt3 from neuraminidase__InfluenzaA__ACR01015

SEQ ID NO: 138811 - RNA, 1410 nt, Artificial Sequence; identical to SEQ ID NO: 138754
  derived and/or modified sequence opt3 from neuraminidase__InfluenzaA__ACR08422

SEQ ID NO: 138812 - RNA, 1410 nt, Artificial Sequence; identical to SEQ ID NO: 138754
  derived and/or modified sequence opt3 from neuraminidase__InfluenzaA__ACR08432

SEQ ID NO: 138813 - RNA, 1410 nt, Artificial Sequence; identical to SEQ ID NO: 138754
  derived and/or modified sequence opt3 from neuraminidase__InfluenzaA__ACR08442

SEQ ID NO: 138814 - RNA, 1410 nt, Artificial Sequence; identical to SEQ ID NO: 138754
  derived and/or modified sequence opt3 from neuraminidase__InfluenzaA__ACR08452

SEQ ID NO: 138815 - RNA, 1410 nt, Artificial Sequence
  derived and/or modified sequence opt3 from neuraminidase__InfluenzaA__ACR08462
augagccccaaccagaagaucauuaccauaggcuccgugugcaugacaaucgggauggccaaucugauucuccaaaucggaaacauuaucucuauauggaucucacacaguauucagcuugguaaucagaaccagaucgagacuuguaaucaaagcgucauuacguacgaaaacaauaccuggguuaaccagacauaugugaauaucuccaacacuaauuucgcugcaggccagucuguagugucggucaaacuggccgggaacagcucauugugcccugugaguggaugggcgauauacuccaaggacaauucuguuagaauuggcagcaaaggugauguguuugucaucagggagccauucauuuccuguucaccguuagaaugccggaccuuuuuccugacacagggggcucuacucaacgacaagcauaguaauggaaccaucaaagaucgcagccccuaucgaacucugaugucuuguccuaucggcgaggugccaucccccuacaacucacguuuugaaagcguagccuggagugcaucugccugccacgacggcauuaacuggcuuacaauagggaucuccggaccugauaauggugcuguugcagugcugaaguauaacggcauuaucaccgacacgauaaagagcuggagaaauaacauuuugaggacucaagagucggagugugccugcgucaaugggucuuguuucaccgugaugacagauggaccauccaacggccaggcuucauacaaaaucuuucggaucgaaaaggguaaaauugugaagagugucgagaugaaugcccccaacuaucauuacgaagagugcagcuguuacccugacuccucugagaucacuugcguuugccgcgauaauuggcacgggagcaacagaccaugggugucauucaaucagaaccucgaauaucagauuggauacauauguaguggcaucuuuggcgacaauccgaggcccaacgauaaaaccggguccugcggaccuguaagcucuaauggugcgaacggcgugaagggguucucauuuaaguauggaaacggcgucuggauuggucggacaaaaaguaucagcucccgcaauggguucgagaugaucugggacccaaacggcuggaccggaacggauaauaacuuuucuauuaagcaagacauagugggcaucaaugaauggucgggguacagcggauccuucguucagcaucccgagcugacuggucuggacuguauucgaccuugcuucuggguggaacucaucagaggcaggccaaaagagaacacaauuuggaccucagggaguucuaucagcuuuuguggagucaauuccgauacugugggcuggucauggcccgacggugcagaguuaccguucacaauagauaaguga

SEQ ID NO: 138816 - RNA, 1410 nt, Artificial Sequence
  derived and/or modified sequence opt3 from neuraminidase__InfluenzaA__ACR08565
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugccugucaaacuggccggaaauucuucguugugcccagugucagggugggcgauauacagcaaggacaacaguguuagaauuggcuccaaaggugauguguuugucaucagggagccguucauuucuuguagccccuuagaaugccggaccuuuuuccugacacagggggcucuacucaaugacaagcauuccaacggaaccaucaaagaucgcucaccuuaucgaacucugaugaguuguccaaucggcgaggugcccagcccuuacaacucucguuuugaauccguagccuggucagcaagcgccugccacgacggcauuaauuggcuuacaauagggaucaguggaccagauaacggugcuguugcagugcugaaguauaauggcauuaucaccgacacgauaaagucuuggagaaacaauauuuugaggacucaagaguccgagugugccugcgucaacgggagcuguuucaccgugaugacagauggacccucgaauggccaggcuucuuacaaaaucuuucggaucgaaaaggguaaaauugugaaguccgucgagaugaacgccccuaauuaucauuacgaagagugcucauguuacccagacaguagcgagaucacuugcguuugccgcgauaacuggcacggguccaauagaccgugggugucuuucaaccagaaucucgaauaucagauuggauacauauguagcggcaucuuuggcgacaaccccaggccuaaugauaaaaccgggucaugcggaccaguaaguuccaacggugcgaacggcgugaagggguucagcuuuaaguauggaaauggcgucuggauuggucggacaaaaucuaucucaagucgcaacggguucgagaugaucugggaccccaauggcuggaccggaacggauaacaauuuuagcauuaagcaagacauagugggcaucaacgaaugguccggguacucuggaucguucguucagcauccugagcugacuggucuggacuguauucgaccaugcuucuggguggaacucaucagaggcaggcccaaagagaauacaauuuggaccagcggguccucaaucaguuuuuguggagucaacucugauacugugggcuggagcuggccggacggugcagaguuaccuuucacaauagauaaguga

SEQ ID NO: 138817 - RNA, 1410 nt, Artificial Sequence; identical to SEQ ID NO: 138744
  derived and/or modified sequence opt3 from neuraminidase__InfluenzaA__ACR08566

SEQ ID NO: 138818 - RNA, 1410 nt, Artificial Sequence; identical to SEQ ID NO: 138754
  derived and/or modified sequence opt3 from neuraminidase__InfluenzaA__ACR08567

SEQ ID NO: 138819 - RNA, 1410 nt, Artificial Sequence; identical to SEQ ID NO: 138744
  derived and/or modified sequence opt3 from neuraminidase__InfluenzaA__ACR08568

SEQ ID NO: 138820 - RNA, 1410 nt, Artificial Sequence; identical to SEQ ID NO: 138744
  derived and/or modified sequence opt3 from neuraminidase__InfluenzaA__ACR08569

SEQ ID NO: 138821 - RNA, 1410 nt, Artificial Sequence; identical to SEQ ID NO: 138754
  derived and/or modified sequence opt3 from neuraminidase__InfluenzaA__ACR08570

SEQ ID NO: 138822 - RNA, 1410 nt, Artificial Sequence; identical to SEQ ID NO: 138744
  derived and/or modified sequence opt3 from neuraminidase__InfluenzaA__ACR08571

SEQ ID NO: 138823 - RNA, 1410 nt, Artificial Sequence; identical to SEQ ID NO: 138744
  derived and/or modified sequence opt3 from neuraminidase__InfluenzaA__ACR08572

SEQ ID NO: 138824 - RNA, 1410 nt, Artificial Sequence; identical to SEQ ID NO: 138744
  derived and/or modified sequence opt3 from neuraminidase__InfluenzaA__ACR08573

SEQ ID NO: 138825 - RNA, 1410 nt, Artificial Sequence; identical to SEQ ID NO: 138744
  derived and/or modified sequence opt3 from neuraminidase__InfluenzaA__ACR08574

SEQ ID NO: 138826 - RNA, 1410 nt, Artificial Sequence; identical to SEQ ID NO: 138754
  derived and/or modified sequence opt3 from neuraminidase__InfluenzaA__ACR08576

SEQ ID NO: 138827 - RNA, 1410 nt, Artificial Sequence; identical to SEQ ID NO: 138744
  derived and/or modified sequence opt3 from neuraminidase__InfluenzaA__ACR08577

SEQ ID NO: 138828 - RNA, 1410 nt, Artificial Sequence; identical to SEQ ID NO: 138744
  derived and/or modified sequence opt3 from neuraminidase__InfluenzaA__ACR09378

SEQ ID NO: 138829 - RNA, 1410 nt, Artificial Sequence; identical to SEQ ID NO: 138744
  derived and/or modified sequence opt3 from neuraminidase__InfluenzaA__ACR09379

SEQ ID NO: 138830 - RNA, 1410 nt, Artificial Sequence; identical to SEQ ID NO: 138754
  derived and/or modified sequence opt3 from neuraminidase__InfluenzaA__ACR09380

SEQ ID NO: 138831 - RNA, 1410 nt, Artificial Sequence; identical to SEQ ID NO: 138744
  derived and/or modified sequence opt3 from neuraminidase__InfluenzaA__ACR09381

SEQ ID NO: 138832 - RNA, 1410 nt, Artificial Sequence; identical to SEQ ID NO: 138744
  derived and/or modified sequence opt3 from neuraminidase__InfluenzaA__ACR09382

SEQ ID NO: 138833 - RNA, 1410 nt, Artificial Sequence; identical to SEQ ID NO: 138754
  derived and/or modified sequence opt3 from neuraminidase__InfluenzaA__ACR09383

SEQ ID NO: 138834 - RNA, 1410 nt, Artificial Sequence; identical to SEQ ID NO: 138744
  derived and/or modified sequence opt3 from neuraminidase__InfluenzaA__ACR09384

SEQ ID NO: 138835 - RNA, 1410 nt, Artificial Sequence; identical to SEQ ID NO: 138754
  derived and/or modified sequence opt3 from neuraminidase__InfluenzaA__ACR09385

SEQ ID NO: 138836 - RNA, 1410 nt, Artificial Sequence; identical to SEQ ID NO: 138744
  derived and/or modified sequence opt3 from neuraminidase__InfluenzaA__ACR09386

SEQ ID NO: 138837 - RNA, 1410 nt, Artificial Sequence; identical to SEQ ID NO: 138754
  derived and/or modified sequence opt3 from neuraminidase__InfluenzaA__ACR10189

SEQ ID NO: 138838 - RNA, 1410 nt, Artificial Sequence; identical to SEQ ID NO: 138754
  derived and/or modified sequence opt3 from neuraminidase__InfluenzaA__ACR10226

SEQ ID NO: 138839 - RNA, 1410 nt, Artificial Sequence; identical to SEQ ID NO: 138744
  derived and/or modified sequence opt3 from neuraminidase__InfluenzaA__ACR10236

SEQ ID NO: 138840 - RNA, 1410 nt, Artificial Sequence; identical to SEQ ID NO: 138744
  derived and/or modified sequence opt3 from neuraminidase__InfluenzaA__ACR10237

SEQ ID NO: 138841 - RNA, 1410 nt, Artificial Sequence
  derived and/or modified sequence opt3 from neuraminidase__InfluenzaA__ACR15186
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaaguggaguaaaccucaguguaauauaacaggguucgcaccauuuagcaaggacaacuccauucggcugucugccggaggugauaucuggguaacccgcgagcccuaugugucgugcgacccugauaaguguuaccaauucgcgcuaggccaggggacgacucucaauaacguccauucaaaugacaccgugcgagaucguacaccauauagaacucugcuuaugaacgaacugggaguucccuuucacuugggcaccaaacaggugugcauugcuuggagcaguuccucuugucaugacgguaaggccuggcuccacgucugcgugacaggggaugacaaaaaugcaaccgccagcuucaucuacaacggaaggcugguagauuccaucguuucauggaguaaggagauucugcggacgcaggaaagcgagugugugugcauaaauggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuauccucgccacccaggcguuagaugugugugcagggacaacuggcggggguccaaccgcccgauaguagauauuaauaugaaagacuacagcaucgugucgucuuacgucuguuccggacuggugggcgacacgccccgaaagaacgauucaaguagcuccggucauugccuugacccuaauaacgaggaagggggacacggcguuaaaggcugggcuuucgaugacgggaaugauguguggaugggaagaaccaucucugagaaguugaggagcgguuaugagacauuuaaagucauugaaggcuggucaaacccaaauaguaagcugcagaucaaccgucaggugauuguagaccgggggaaucgcuccggauacagcggcauauucucuguugaggguaaaucauguaucaacagaugcuuuuauguggaacuaauuagggggcggaaggaggaaacugagguccucuggaccaguaauagcaucguggucuucuguggcacauccggaacuuacggcaccgggucuuggcccgauggagccgacaucaaccugaugccuauuuga

SEQ ID NO: 138842 - RNA, 1413 nt, Artificial Sequence; identical to SEQ ID NO: 138648
  derived and/or modified sequence opt3 from neuraminidase__InfluenzaA__ACR15197

SEQ ID NO: 138843 - RNA, 1410 nt, Artificial Sequence
  derived and/or modified sequence opt3 from neuraminidase__InfluenzaA__ACR15208
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccauuguaucauggaguaaagagauacugcggacgcaggaaagcgaguguguuugcaucaauggcacuuguacaguggucaugaccgauggcucugcuuccgggaaggcagacacuaaaauucucuuuaucgaggaaggaaagauagugcauacaucaaccuuaagcgguagugcccaacacguggaggaaugcucuugcuauccucgcuacccaggcgucagauguguuugcagggauaacuggaagggguccaaccggccgauuguggacaucaauaucaaagaccacagcauuguaucgucuuacguguguuccggacuggucggcgauacgccccgcaagaacgacucaaguagcuccucucauugccuugauccuaauaacgaggaaggugggcacggagugaaaggcugggcuuucgacgauggcaaugacguuuggauggggcgaaccaucagcgagaagucaagauugggauaugagacauuuaaagugauugaagguuggaguaacccaaaguccaaacugcagauaaauaggcaggucaucguggauaagggcaaccggagcggguacucuggaauuuucucaguagagggcaagaguuguaucaaucguugcuuuuauguugaacuaauccgcgguagaaaagaggaaacugaggugcucuggaccagcaacuccauugucguguucugugggacaucuggcacuuacggaaccggcucguggcccgacggggccgauauaaaucugaugccuaucuga

SEQ ID NO: 138844 - RNA, 1410 nt, Artificial Sequence
  derived and/or modified sequence opt3 from neuraminidase__InfluenzaA__ACR15230
auggaccccaaccagaagaucauuaccauaggcagcgugucccugacaaucucugccauuugcuucuuuaugcaaaucgcuauucucaucacuacggucacccuucacuucaaacaguacgaguuuaauucaccuccaaacaaucagguuaugcugugugaaccgacaauaaucgagagaaacauuacugaaaucguguauuugaccaauacaaccauugagaaggaaaucugccccaaauuagcagaguacaggaacuggaguaagccucaguguaauauaacuggguucgccccauuuagcaaagauaacuccauucggcugucugcgggaggugacaucuggguaacacgcgagcccuaugugucgugcgauccugacaaguguuaccaauucgcucuaggccaggggaccacgcucaauaacguccauucaaaugauacugugcacgaccgaaccccauaucguacacugcuuaugaacgaacugggaguucccuuucauuugggcacuaaacaggugugcauugccuggagcaguuccucuugucacgaugguaaggcauggcuccaugucugcgugaccggggacgaugagaaugccacagcuagcuucaucuacaacggaagacugguagacuccguugugucauggaguaagaaaauccugaggacccaggaaagcgagugugucugcauuaauggcacguguacuguggugaugacagauggcucugcauccgggaaggccgacaccaaaauacucuuuaucgaggaaggaaagauuguccacacuucaacauuaagcgguagugcucaacacguugaggaaugcucuugcuauccucgguacccaggcgugcgcuguguaugcagagauaacuggaagggguccaacaggccgaucguggacauaaauauuaaagacuacagcaucgucucgucuuauguguguuccggacugguuggcgauacuccccggaagaacgacucaaguagcaauucccauugccuugauccuaacaaugaggaaggugggcacggagugaaaggcugggccuucgacgauggcaacgacgucuggauggggcgcacgaucucugagaaguugcgaagcggauacgagaccuuuaaagugauugaagguuggucaaauccaaacaguaagcugcagaucaauagacagguaauuguugauaggggcaaccgguccggguauagcggaauauucucuguggagggcaaaucauguaucaaucguugcuuuuacgucgaacuaauucgcgguagaaaccaggagacagaagugcucuggaccaguaauagcaucgucguguucugugggaccuccggcacauauggaacuggcucuuggcccgacggggcggauaucaaccugaugccuauuuga

SEQ ID NO: 138845 - RNA, 1413 nt, Artificial Sequence; identical to SEQ ID NO: 138648
  derived and/or modified sequence opt3 from neuraminidase__InfluenzaA__ACR15241

SEQ ID NO: 138846 - RNA, 1410 nt, Artificial Sequence; identical to SEQ ID NO: 137900
  derived and/or modified sequence opt3 from neuraminidase__InfluenzaA__ACR15252

SEQ ID NO: 138847 - RNA, 1413 nt, Artificial Sequence
  derived and/or modified sequence opt3 from neuraminidase__InfluenzaA__ACR15263
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuucauuaugaagaguguagcugcuacccagacaccggcaucguuaugugugugugcagggauaacuggcacggcuccaaucggcccugggucucuuucaaccagaaucuggacuaccaaauuggguauaucugcagcggaguguuuggugauaacccucgcccagaggacggcgaagggucauguaauccggugacggucgauggagccaacggcguuaaagguuucaguuacaaguaugacaaugggguguggaucggcagaacuaaauccaacaggcugcggaagggauuugagaugauuugggaccccaauggcuggacaaacaccgauagcgacuucucuguaaaacaggauguggucgcuauaacugacuggucaggguacagugguagcuuugugcagcacccugaacucacaggauuagauugcauccgcccauguuucuggguugagcuggugcgaggccuucccagagaaaacaccacgauuugguccucugggucgagcaucuccuucugcggagucaauucagacaccgccaacuggaguuggccugauggcgcagaguugccauuuacaauugacaaguga

SEQ ID NO: 138848 - RNA, 1413 nt, Artificial Sequence; identical to SEQ ID NO: 138648
  derived and/or modified sequence opt3 from neuraminidase__InfluenzaA__ACR15274

SEQ ID NO: 138849 - RNA, 1413 nt, Artificial Sequence
  derived and/or modified sequence opt3 from neuraminidase__InfluenzaA__ACR15307
augaaccccaaucagaagaucauuaccauaggcagcaucuccauuacaaucgggauuaucucucugaugcuccaaauaggaaacaucauuucaaucugggccagucacagcauucagacugguucccagaaucauacgggcaucugcaaccagagaauaauuaccuacgagaauaacacaugggugaaucacacuuaugucaacaucaauaacaccaauguuguggcugggaaagacaagacaucuguaacccuugcaggaaacucgucacuguguagcauuaguggcugggccaucuacacuaaagauaauuccaucaggauugguucuaagggggacguguucgucauacgggaaccuuuuaucagcugcucccauuuggagugucgcacauucuuuuuaacccaaggagcgcugcuaaacgauaaacacucaaauggcacggugaaggaccgaaguccauaucgugcucucaugagcugcccgcugggcgaagcccccucuccuuacaacuccaaguucgagucaguugcauggagcgccagugcuugucaugaugggaugggauggcuuacuauugguaucucuggcccagacaacggggcaguggccguccugaaauauaauggaauaauuaccgaaacaaucaaguccuggaaaaagagaaucuugaggacucaggagagcgagugcguguguguaaacggcucgugcuuuaccauuaugacagauggucccucuaauggggcugccuccuacaaaaucuucaagauugaaaagggaaaaguuaccaagucaauagagcucaacgcgccuaauuuucacuaugaagaguguaguugcuacccagacacgggcacugugaugugugucugccgggauaacuggcacggcagcaaucgccccuggguguccuucaaccagaaucuggacuaccagaucggguauauuugcucuggaguguuuggugauaacccuagaccaaaagacggcgaggggagcuguaauccggucacaguugauggagcagacggcgugaaggguuucucauacaaauaugggaacggcguauggaucggaaggaccaagaguaaucggcugcgcaaaggcuuugaaaugaucugggaccccaacggguggacugauacagacuccgauuucagcgugaagcaagacgucguggccauuaccgauuggucuggauacucagguaguuuuguucagcauccugagcucacgggcuuagacugcauacgaccauguuucuggguggaacuggucagagggcuucccagggagaauaccacaaucuggacuagcggauccucuauuucguucugcggcgugaacagcgauaccgcuaacugguccuggccugacggugccgaauugccauuuacaaucgauaaguga

SEQ ID NO: 138850 - RNA, 1413 nt, Artificial Sequence
  derived and/or modified sequence opt3 from neuraminidase__InfluenzaA__ACR15318
augaaccccaaucagaagaucauuaccauaggcagcaucuccauugccaucgggauuaucucucugaugcuccaaauaggaaacaucauuucaaucugggcuagucacagcauucagacagguucccagaaucauacuggcgugugcaaccagagaaucauaacguacgaaaauucuaccugggucaaccacacauauguuaauauuaacaauacuaacgugaucgcagggaaagacaagaccucgguaacacuugccggaaauucaagccuguguaguauuuccggcugggcgaucuacaccaaagauaacucuaucaggauugguagcaagggggacguguucgucauacgggagccuuuuaucuccugcucacauuuggagugucgcacuuucuuuuuaacacaaggagcucugcuaaaugauaaacacaguaacggcaccgugaaggaccgaagcccauaucgugcccucaugucuugcccgcugggcgaagcacccuccccuuacaauucaaaguucgagagcguugccuggagugcuucugcaugucaugaugggaugggauggcuuacgauugguaucuccggcccagacaacggggccguggcuguccugaaauauaacggaauaauuacugaaaccaucaagagcuggaaaagacagaucuugaggacacaggagucggagugcguguguguaaauggcucuugcuuuacuauuaugaccgauggucccuccaacggggccgcgucauacaagaucuucaaaauugaaaagggaaagguuacaaaaaguauagagcucaaugcaccuaacuuucacuaugaagaguguagcugcuacccagacaccggcacggugaugugugucugccgggauaauuggcacggcuccaaccgccccugggugucuuucaaucagaaccuggacuaccaaaucggguauauuugcagcggaguguuuggugauaauccuagaccaaaggacggcgaggggucauguaacccggucacuguugauggagccaauggcgugaaagguuucaguuacaaguaugggaacggcguauggaucggaaggacaaaauccaaucggcugcgcaagggcuuugaaaugaucugggaccccaacggguggaccgacacugauagcgacuucucugugaaacaggaugucguggcuauuacagacuggucaggauacagugguagcuuuguucagcauccugagcucaccggcuuagauugcauacgaccauguuucuggguggaacuggucagagggcuucccaaggagaauacgaccaucuggacauccggaucuucgauuagcuucugcggcgugaacuccgacacugccaacuggucauggccugauggugcagaauugccauuuaccaucgacaaguga

SEQ ID NO: 138851 - RNA, 1413 nt, Artificial Sequence
  derived and/or modified sequence opt3 from neuraminidase__InfluenzaA__ACR15329
augaaccccaaucagaagaucauuaccauaggcagcaucuccauugccaucgggauuaucucucugaugcuccaaauaggaaacaucauuucaaucugggcuagucacagcauucagacaagaucccagaaucauacuggugugugcaaccagaggaucauaacguacgaaaauucuaccugggucaaccacacauauguuaauauuaacaauacuaacgugaucgcaggcaaagacaagaccucgguaacacuugccggaaauucaagccuguguaguauuuccggaugggcgaucuacaccaaagauaacucuauccggauuggcagcaagggugacguguucgucauacgcgagccuuuuaucuccugcucacauuuggagugucgaacuuucuuuuuaacacaaggggcucugcuaaaugauaaacacaguaacggaaccgugaaggaccguagcccauauagagcccucaugucuugcccgcugggcgaagcacccuccccuuacaauucaaaguucgagagcguugccuggagugcuucugcaugucaugauggcaugggguggcuuacgauuggaaucuccgguccagacaacggcgccguggcuguccugaaauauaacgggauaauuacugaaaccaucaagagcuggaaaaagcagaucuugaggacacaggagucggagugcguguguguaaauggaucuugcuuuacuauuaugaccgauggccccuccaacggugccgcgucauacaaaaucuucaagauugaaaaggggaaaguuacaaagaguauagagcucaaugcaccuaacuuucacuaugaagaguguagcugcuacccagacaccggaacggugaugugugucugccgggauaauuggcacggcuccaaccgccccugggugucuuucaaucagaaccuggacuaccaaaucggcuauauuugcagcgggguguuuggagauaauccuagaccaaaagacggugagggcucauguaacccggucacuguugauggggccaauggagugaagggcuucaguuacaaauaugguaacgggguauggaucggcaggacaaaguccaaucggcugcgcaaaggauuugaaaugaucugggaccccaacggcuggaccgacacugauagcgacuucucugugaagcaggaugucguggcuauuacagacuggucaggguacagugggagcuuuguucagcauccugagcucaccgguuuagauugcauacgaccauguuucuggguggaacuggucagaggccuucccaaggagaauacgaccaucuggacauccgggucuucgauuagcuucugcggagugaacuccgacacugccaacuggucauggccugauggcgcagaauugccauuuaccaucgacaaauga

SEQ ID NO: 138852 - RNA, 1413 nt, Artificial Sequence; identical to SEQ ID NO: 138648
  derived and/or modified sequence opt3 from neuraminidase__InfluenzaA__ACR15340

SEQ ID NO: 138853 - RNA, 1413 nt, Artificial Sequence; identical to SEQ ID NO: 138648
  derived and/or modified sequence opt3 from neuraminidase__InfluenzaA__ACR15362

SEQ ID NO: 138854 - RNA, 1413 nt, Artificial Sequence; identical to SEQ ID NO: 138648
  derived and/or modified sequence opt3 from neuraminidase__InfluenzaA__ACR15373

SEQ ID NO: 138855 - RNA, 1413 nt, Artificial Sequence
  derived and/or modified sequence opt3 from neuraminidase__InfluenzaA__ACR15428
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguguguccggcugggcgauuuacaccaaggauaauucuaucaggaucgguagcaaaggggacgucuucgugauucgggagccuuuuauauccugcucacacuuggaaugucgcacuuucuuuuuaacaaagggagcucugcuaaacgauaaacauaguaauggcaccguuaaggaccgaagcccauaucgugcccucaugucuugcccgcugggcgaggcacccuccccuuacaacucaaaguucgaaagcguggccuggagugcuucugcaugucacgaugggaugggauggcuuacgaucgguauuuccggcccagacaacggggccgucgcugugcugaaauauaauggaaucauaacuggcaccauuaagagcuggaaaaagcaaaucuugagaacacaggagucggagugcguauguaugaacgguucuugcuuuacuaucaugaccgaugggcccuccaauaaagccgcgucauacaagauuuucaagaucgaaaaaggaaagguuacaaaaaguauugagcucaacgcaccuaauuuucauuaugaagaguguagcugcuacccagacaccggcauagugaugugugucugcagggauaacuggcacggcuccaaucggcccugggugucuuucaaccagaaucuggacuaccagaucggguauauuugcagcggaguguuuggugauaacccucgcccagaggacggcgaagggucauguaauccggucacgguugauggagccaacggcgugaaggguuucaguuacaaauaugacaaugggguauggaucggcagaacuaaguccaacaggcugcggaaaggauuugagaugaucugggaccccaauggcuggacaaacaccgauagcgacuucucugugaagcaagaugucguggcuauuacugacuggucaggguacaguggauccuuuguucagcacccugaacucacagguuuagauugcauacgcccauguuucuggguggagcugguccgaggccuucccagagaaaacaccacgaucuggaccuccgggucuucgauuagcuucugcggagugaauagcgacacagccaacuggucauggccugauggcgcagaguugccauuuacuaucgacaaguga

SEQ ID NO: 138856 - RNA, 1413 nt, Artificial Sequence
  derived and/or modified sequence opt3 from neuraminidase__InfluenzaA__ACR15472
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugugaacaucaauaacacuaauguuguggcaggggaagacaaaaccccuguaacacuugccggaaacucgucacuguguagcauuaguggcugggcgaucuacaccaaggauaauuccaucaggauugguucuaaaggggacguguucgucauacgggagccauuuaucgcuugcagccacuuggaaugucgcacuuucuuuuuaacacaaggagcccugcuaaacgauaagcauuccaauggcaccgugaaagaccgaucaccguaucgugcacucaugaguugcccccugggcgaggccccuagcccauacaacucuaaguucgaauccguugcuuggucagcaagcgccugucacgaugggaugggauggcuuacgauugguaucaguggccccgacaacggggcuguggccguccugaaguauaauggaauaauuacuggcaccaucaaaucuuggaagaaacagaucuugagaacacaggaguccgagugcguguguaugaacgguagcugcuuuacuauuaugaccgaugggccuucgaauaaggcggcaucuuacaaaaucuucaagauugaaaagggaaaaguaacaaaguccauagagcucaacgccccaaauuuucauuaugaagaguguucaugcuaccccgacaccggcaucguuaugugugugugcagggauaacuggcacggcaguaaucggccuugggucagcuucaaccagaaucuggacuaccaaauuggguauaucugcuccggaguguuuggugauaacccacgcccggaggacggcgaagggucuuguaaucccgugacggucgauggagcuaacggcguuaaagguuucagcuacaaguaugacaaugggguguggaucggcagaacuaaaucaaacaggcugcggaagggauuugagguaauuugggacccuaauggcuggacaaacaccgauagugacuucuccgugaaacaggaugucguggccauaacugacuggagcggguacucuggaucauuuguucagcacccagaacucacagguuuagauugcauccgccccuguuucuggguggagcugguccgaggccuuccuagagaaaacaccacgauuuggaccagugggagcuccaucucuuucugcggagucaauucggacacagcaaacuggagcuggccagauggcgcugaguugcccuuuacuauugacaaguga

SEQ ID NO: 138857 - RNA, 1413 nt, Artificial Sequence; identical to SEQ ID NO: 138648
  derived and/or modified sequence opt3 from neuraminidase__InfluenzaA__ACR15483

SEQ ID NO: 138858 - RNA, 1413 nt, Artificial Sequence; identical to SEQ ID NO: 138648
  derived and/or modified sequence opt3 from neuraminidase__InfluenzaA__ACR15505

SEQ ID NO: 138859 - RNA, 1413 nt, Artificial Sequence; identical to SEQ ID NO: 138732
  derived and/or modified sequence opt3 from neuraminidase__InfluenzaA__ACR15516

SEQ ID NO: 138860 - RNA, 1410 nt, Artificial Sequence; identical to SEQ ID NO: 136730
  derived and/or modified sequence opt3 from neuraminidase__InfluenzaA__ACR15527

SEQ ID NO: 138861 - RNA, 1410 nt, Artificial Sequence
  derived and/or modified sequence opt3 from neuraminidase__InfluenzaA__ACR15538
augauccccauucagaagauaaucaccauuggcagcgugucccugacaaucucuacuauuugcuucuuuaugcaaaucgccauacucaucacgaccgucacacuucacuucaaacaguacgaguuuaacucaccuccaaauaaccagguuaugcugugugaaccgacuauuaucgagagaaauauuaccgaaaucguguauuugacaaacaccacuauagagaaggaaauuugccccaaauuagcugaguacaggaauuggaguaagccucagugugacaucacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcacgaccgaacaccauaucguacucugcuuaugaacgaacugggaguucccuuucauuugggcaccaaacaggugugcaucgcuuggagcaguuccucuugucacgaugguaaggccuggcuccaugucugcgugacaggggacgauaagaaugcaaccgccagcuucauuuacaacggaagacugguagacuccauaguuucauggaguaaagagauccugaggacgcaggaaagcgagugugugugcauuaauggcacuuguacagucgugaugaccgauggcucugcuuccgggaaggcagacacuaaaauccucuuuauagaggaaggaaagauugugcacacaucaaccuuaagcgguagugcccaacacgucgaggaaugcucuugcuauccucgguacccaggcguucgcugugugugcagagauaacuggaagggguccaauaggccgaucguagacaucaacauuaaagacuacagcaucgugucgucuuaugucuguuccggacuggugggcgauacgccccggaagaacgacucaaguagcuccucucauugccuugauccuaauaacgaggaaggugggcacggaguuaaaggcugggcuuucgacgauggcaaugacguguggauggggcgcaccauuagcgagaaguugcgaucaggauacgagacauuuaaagucauagaagguuggaguaacccaaauuccaagcugcagaucaacagacaggugauuguagauaggggcaaucggagcggguauucuggaaucuucucaguugagggcaaaaguuguaucaaccguugcuuuuacguggaacuaauucgcgguagaaaggaggaaacugagguccucuggaccagcaauuccauaguggucuucugugggacaucuggcacuuauggaaccggcucguggcccgacggggccgauaucaaccugaugccuauuuga

SEQ ID NO: 138862 - RNA, 1410 nt, Artificial Sequence; identical to SEQ ID NO: 136343
  derived and/or modified sequence opt3 from neuraminidase__InfluenzaA__ACR15549

SEQ ID NO: 138863 - RNA, 1410 nt, Artificial Sequence; identical to SEQ ID NO: 136728
  derived and/or modified sequence opt3 from neuraminidase__InfluenzaA__ACR15560

SEQ ID NO: 138864 - RNA, 1410 nt, Artificial Sequence; identical to SEQ ID NO: 136728
  derived and/or modified sequence opt3 from neuraminidase__InfluenzaA__ACR15582

SEQ ID NO: 138865 - RNA, 1410 nt, Artificial Sequence
  derived and/or modified sequence opt3 from neuraminidase__InfluenzaA__ACR15593
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaacaggcugaguacaggaauuggaguaagccucaauguaacauaacaggguucgcaccauuuagcaaagacaauuccauucgguuaucugccggaggugauaucuggguaacccgcgagcccuaugugucgugcgacccugauaaguguuaccaguucgcgcugggccaggggacgacucuaaacaauguccauucaaacgacaccgugcacgaucgaacaccauaucguacucuccugaugaaugaacuuggaguucccuuucaucugggcaccaaacaggugugcauugcuuggagcaguuccucuugucacgacgguaaggccugguugcaugucugcgugacaggggaugacaagaacgcaaccgccagcuucaucuacaauggaagacucguagauuccaucguuucauggaguaaagagauucugaggacgcaagaaagcgagugugugugcauaaacggcacuuguacagucgugaugaccgacggcucugcuuccgggaaggcagauacuaaaauccuguuuauugaggaaggaaagaucgugcacacaucaacccucagcgguagugcccagcacgucgaggaaugcucuugcuauccucgguacccaggcguucgcugugugugcagagacaacuggaagggguccaauaggccgauaguagauauuaacaucaaagacuacagcaucgugucgucuuaugucuguuccggauuagugggcgacacgccccggaagaaugauucaaguagcuccucucauugccuggacccuaacaaugaggaaggugggcacggaguuaaaggcugggcuuucgaugacggcaacgauguguggauggggcgcaccauuagcgagaaacuucgaucaggauacgagacauuuaaggucaucgaagguuggaguaauccaaacuccaaguugcagauuaauagacaggugauaguagacaggggcaaccggagcggguauucuggaaucuucucaguugagggcaaaaguuguauuaaucguugcuuuuacguggaacugauccgcgguagaaaggaggaaacugagguccuauggaccagcaacuccaucguggucuucugugggacaucuggcacuuauggaaccggcucguggcccgauggggccgacauuaaucucaugccuauauga

SEQ ID NO: 138866 - RNA, 1410 nt, Artificial Sequence
  derived and/or modified sequence opt3 from neuraminidase__InfluenzaA__ACR15604
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaagcugcagauuaauagacaggugauaguagacaggggcgaucggagcggguauucuggaaucuucucaguugagggcaaaaguuguauuaaccguugcuuuuacguggaacuaauccgcgguagaaaggaggaaacugagguccucuggaccagcaauuccaucguggucuucugugggacaucuggcacuuauggaaccggcucguggcccgacggggccgauauuaaccugaugccuauauga

SEQ ID NO: 138867 - RNA, 1410 nt, Artificial Sequence; identical to SEQ ID NO: 138744
  derived and/or modified sequence opt3 from neuraminidase__InfluenzaA__ACR15618

SEQ ID NO: 138868 - RNA, 1410 nt, Artificial Sequence; identical to SEQ ID NO: 138744
  derived and/or modified sequence opt3 from neuraminidase__InfluenzaA__ACR18924

SEQ ID NO: 138869 - RNA, 1410 nt, Artificial Sequence; identical to SEQ ID NO: 138744
  derived and/or modified sequence opt3 from neuraminidase__InfluenzaA__ACR18925

SEQ ID NO: 138870 - RNA, 1410 nt, Artificial Sequence; identical to SEQ ID NO: 138754
  derived and/or modified sequence opt3 from neuraminidase__InfluenzaA__ACR18926

SEQ ID NO: 138871 - RNA, 1410 nt, Artificial Sequence; identical to SEQ ID NO: 138754
  derived and/or modified sequence opt3 from neuraminidase__InfluenzaA__ACR18927

SEQ ID NO: 138872 - RNA, 1410 nt, Artificial Sequence; identical to SEQ ID NO: 138754
  derived and/or modified sequence opt3 from neuraminidase__InfluenzaA__ACR18928

SEQ ID NO: 138873 - RNA, 1410 nt, Artificial Sequence; identical to SEQ ID NO: 138754
  derived and/or modified sequence opt3 from neuraminidase__InfluenzaA__ACR18929

SEQ ID NO: 138874 - RNA, 1410 nt, Artificial Sequence; identical to SEQ ID NO: 138754
  derived and/or modified sequence opt3 from neuraminidase__InfluenzaA__ACR18930

SEQ ID NO: 138875 - RNA, 1410 nt, Artificial Sequence; identical to SEQ ID NO: 138754
  derived and/or modified sequence opt3 from neuraminidase__InfluenzaA__ACR18931

SEQ ID NO: 138876 - RNA, 1410 nt, Artificial Sequence; identical to SEQ ID NO: 138754
  derived and/or modified sequence opt3 from neuraminidase__InfluenzaA__ACR18933

SEQ ID NO: 138877 - RNA, 1410 nt, Artificial Sequence; identical to SEQ ID NO: 138744
  derived and/or modified sequence opt3 from neuraminidase__InfluenzaA__ACR18934

SEQ ID NO: 138878 - RNA, 1410 nt, Artificial Sequence; identical to SEQ ID NO: 138754
  derived and/or modified sequence opt3 from neuraminidase__InfluenzaA__ACR18935

SEQ ID NO: 138879 - RNA, 1410 nt, Artificial Sequence; identical to SEQ ID NO: 138754
  derived and/or modified sequence opt3 from neuraminidase__InfluenzaA__ACR23301

SEQ ID NO: 138880 - RNA, 1410 nt, Artificial Sequence; identical to SEQ ID NO: 138754
  derived and/or modified sequence opt3 from neuraminidase__InfluenzaA__ACR32997

SEQ ID NO: 138881 - RNA, 1410 nt, Artificial Sequence
  derived and/or modified sequence opt3 from neuraminidase__InfluenzaA__ACR33740
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcggcacugucgguugguccuggcccgacggggcagaguuaccguucacaaucgauaaguga

SEQ ID NO: 138882 - RNA, 1410 nt, Artificial Sequence; identical to SEQ ID NO: 138744
  derived and/or modified sequence opt3 from neuraminidase__InfluenzaA__ACR38792

SEQ ID NO: 138883 - RNA, 1410 nt, Artificial Sequence; identical to SEQ ID NO: 138754
  derived and/or modified sequence opt3 from neuraminidase__InfluenzaA__ACR38793

SEQ ID NO: 138884 - RNA, 1410 nt, Artificial Sequence; identical to SEQ ID NO: 138754
  derived and/or modified sequence opt3 from neuraminidase__InfluenzaA__ACR38794

SEQ ID NO: 138885 - RNA, 1410 nt, Artificial Sequence; identical to SEQ ID NO: 138754
  derived and/or modified sequence opt3 from neuraminidase__InfluenzaA__ACR38878

SEQ ID NO: 138886 - RNA, 1410 nt, Artificial Sequence; identical to SEQ ID NO: 138754
  derived and/or modified sequence opt3 from neuraminidase__InfluenzaA__ACR39357

SEQ ID NO: 138887 - RNA, 1410 nt, Artificial Sequence; identical to SEQ ID NO: 138754
  derived and/or modified sequence opt3 from neuraminidase__InfluenzaA__ACR39396

SEQ ID NO: 138888 - RNA, 1410 nt, Artificial Sequence; identical to SEQ ID NO: 138754
  derived and/or modified sequence opt3 from neuraminidase__InfluenzaA__ACR39406

SEQ ID NO: 138889 - RNA, 1410 nt, Artificial Sequence; identical to SEQ ID NO: 138754
  derived and/or modified sequence opt3 from neuraminidase__InfluenzaA__ACR39416

SEQ ID NO: 138890 - RNA, 1410 nt, Artificial Sequence; identical to SEQ ID NO: 138754
  derived and/or modified sequence opt3 from neuraminidase__InfluenzaA__ACR39426

SEQ ID NO: 138891 - RNA, 1410 nt, Artificial Sequence; identical to SEQ ID NO: 138754
  derived and/or modified sequence opt3 from neuraminidase__InfluenzaA__ACR39436

SEQ ID NO: 138892 - RNA, 1410 nt, Artificial Sequence; identical to SEQ ID NO: 138754
  derived and/or modified sequence opt3 from neuraminidase__InfluenzaA__ACR39446

SEQ ID NO: 138893 - RNA, 1410 nt, Artificial Sequence; identical to SEQ ID NO: 138754
  derived and/or modified sequence opt3 from neuraminidase__InfluenzaA__ACR39456

SEQ ID NO: 138894 - RNA, 1410 nt, Artificial Sequence; identical to SEQ ID NO: 138754
  derived and/or modified sequence opt3 from neuraminidase__InfluenzaA__ACR39466

SEQ ID NO: 138895 - RNA, 1410 nt, Artificial Sequence; identical to SEQ ID NO: 138754
  derived and/or modified sequence opt3 from neuraminidase__InfluenzaA__ACR39476

SEQ ID NO: 138896 - RNA, 1410 nt, Artificial Sequence; identical to SEQ ID NO: 138754
  derived and/or modified sequence opt3 from neuraminidase__InfluenzaA__ACR39486

SEQ ID NO: 138897 - RNA, 1410 nt, Artificial Sequence; identical to SEQ ID NO: 138754
  derived and/or modified sequence opt3 from neuraminidase__InfluenzaA__ACR39496

SEQ ID NO: 138898 - RNA, 1410 nt, Artificial Sequence; identical to SEQ ID NO: 138754
  derived and/or modified sequence opt3 from neuraminidase__InfluenzaA__ACR40291

SEQ ID NO: 138899 - RNA, 1410 nt, Artificial Sequence; identical to SEQ ID NO: 138754
  derived and/or modified sequence opt3 from neuraminidase__InfluenzaA__ACR40301

SEQ ID NO: 138900 - RNA, 1410 nt, Artificial Sequence
  derived and/or modified sequence opt3 from neuraminidase__InfluenzaA__ACR40311
augaaccccaaucagaagaucauuaccauaggcagcgugugcaugacaaucgggauggccaaccugauucuccaaaucggaaauauuaucuccauauggaucucucacucaauucagcuugguaaccagaaucagacugagacguguaaccaaagugucaucaccuacgaaaauaacacauggguuaaucagacuuaugugaacauuagcaauaccaacuucgcugcaggccaguccguagugucugucaaacuggccggaaauucgucauugugcccugugagcggaugggcgaucuacaguaaggacaacuccguuagaauaggcucuaaaggugauguguuugucauuagggagccauucaucagcuguuccccguuagaaugccggacauuuuuccugacccagggggcucuacucaaugacaagcauucaaacggaacuauuaaagaucgcagucccuaucgaacacugaugagcuguccuaucggcgaggugccaucucccuacaacucccguuuugaaucaguagccuggagcgcaagugccugccacgacggcaucaauuggcuuaccauugggauaucuggaccugauaacggugcuguugcagugcugaaguauaauggcaucauuacggacacuaucaaguccuggagaaacaauauauugaggacccaagagagcgagugugccugcgucaacgggucguguuucacagugaugacugauggaccaucuaauggccaggcuuccuacaaaauuuuucggaucgaaaaggguaaaaucgugaagucagucgagaugaacgcccccaauuaucauuacgaagagugcaguuguuacccugacagcuccgagauuaccugcguuugccgcgauaacuggcacgggucuaauagaccaugggugagcuucaaccagaaucucgaauaucagaucggauacauuuguucaggcauauuuggcgacaacccgaggcccaaugauaaaacagggaguugcggaccuguauccagcaacggugcgaacggcgugaagggguucucuuuuaaguauggaaauggcgucuggaucggucggaccaaaucaauuaguagccgcaacggguucgagaugaucugggacccaaauggcuggacgggaacugauaacaauuuuuccaucaagcaagacauugugggcauaaacgaauggucuggguacucggggagcuucguucagcaucccgagcugacaggucuggacuguauccgaccuugcuucuggguggaacucauuagaggcaggccaaaagagaauaccaucuggacuuccgggucaaguauuucuuuuuguggagucaacagcgauacagugggcugguccuggcccgacggugcagaguuaccguucaccaucgauaaguga

SEQ ID NO: 138901 - RNA, 1410 nt, Artificial Sequence
  derived and/or modified sequence opt3 from neuraminidase__InfluenzaA__ACR40321
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaauggaaccgacaacaauuuuuccauaaagcaagacaucgucggcauuaacgaauggucuggguacucggggagcuucgugcagcaucccgagcugacgggucuggauuguauccgaccuugcuucuggguugaacucauuagaggcaggccaaaagagaauacuaucuggacauccgggucaaguauaucuuuuuguggagugaacagcgacaccgucggcugguccuggcccgauggugcagaguuaccguucacuaucgacaaguga

SEQ ID NO: 138902 - RNA, 1410 nt, Artificial Sequence; identical to SEQ ID NO: 138754
  derived and/or modified sequence opt3 from neuraminidase__InfluenzaA__ACR40341

SEQ ID NO: 138903 - RNA, 1410 nt, Artificial Sequence; identical to SEQ ID NO: 138754
  derived and/or modified sequence opt3 from neuraminidase__InfluenzaA__ACR40351

SEQ ID NO: 138904 - RNA, 1410 nt, Artificial Sequence; identical to SEQ ID NO: 138754
  derived and/or modified sequence opt3 from neuraminidase__InfluenzaA__ACR40361

SEQ ID NO: 138905 - RNA, 1410 nt, Artificial Sequence; identical to SEQ ID NO: 138754
  derived and/or modified sequence opt3 from neuraminidase__InfluenzaA__ACR40371

SEQ ID NO: 138906 - RNA, 1410 nt, Artificial Sequence; identical to SEQ ID NO: 138754
  derived and/or modified sequence opt3 from neuraminidase__InfluenzaA__ACR40391

SEQ ID NO: 138907 - RNA, 1410 nt, Artificial Sequence; identical to SEQ ID NO: 138744
  derived and/or modified sequence opt3 from neuraminidase__InfluenzaA__ACR46663

SEQ ID NO: 138908 - RNA, 1410 nt, Artificial Sequence; identical to SEQ ID NO: 138744
  derived and/or modified sequence opt3 from neuraminidase__InfluenzaA__ACR46673

SEQ ID NO: 138909 - RNA, 1410 nt, Artificial Sequence
  derived and/or modified sequence opt3 from neuraminidase__InfluenzaA__ACR46996
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucuaauggccaggcuuccuacaaaaucuuucggauugaaaaggguaaaaucgugaagucaguggagaugaacgcccccaauuaucauuacgaagagugcaguuguuacccugacagcuccgagauuacuugcgucugccgcgauaacuggcacgggucuaauagaccauggguuagcuucaaccagaaucucgaauaucagauaggauacaucuguucaggcauuuuuggcgacaacccgaggcccaaugauaaaaccgggaguugcggaccuguguccagcaacggugcgaacggcguaaagggguucucuuuuaaguauggaaauggcguguggaucggucggacaaaaucaaucaguagccgcaacggguucgagaugauuugggacccaaauggcuggaccggaacggauaacaauuuuuccauaaagcaagacaucgucggcauuaacgaauggucuggguacucggggagcuucgugcagcaucccgagcugacuggucuggacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 138910 - RNA, 1410 nt, Artificial Sequence; identical to SEQ ID NO: 138909
  derived and/or modified sequence opt3 from neuraminidase__InfluenzaA__ACR46997

SEQ ID NO: 138911 - RNA, 1410 nt, Artificial Sequence; identical to SEQ ID NO: 138909
  derived and/or modified sequence opt3 from neuraminidase__InfluenzaA__ACR46998

SEQ ID NO: 138912 - RNA, 1410 nt, Artificial Sequence; identical to SEQ ID NO: 138909
  derived and/or modified sequence opt3 from neuraminidase__InfluenzaA__ACR46999

SEQ ID NO: 138913 - RNA, 1410 nt, Artificial Sequence; identical to SEQ ID NO: 138909
  derived and/or modified sequence opt3 from neuraminidase__InfluenzaA__ACR47000

SEQ ID NO: 138914 - RNA, 1410 nt, Artificial Sequence; identical to SEQ ID NO: 138909
  derived and/or modified sequence opt3 from neuraminidase__InfluenzaA__ACR47001

SEQ ID NO: 138915 - RNA, 1410 nt, Artificial Sequence; identical to SEQ ID NO: 138909
  derived and/or modified sequence opt3 from neuraminidase__InfluenzaA__ACR47002

SEQ ID NO: 138916 - RNA, 1410 nt, Artificial Sequence; identical to SEQ ID NO: 138909
  derived and/or modified sequence opt3 from neuraminidase__InfluenzaA__ACR47003

SEQ ID NO: 138917 - RNA, 1410 nt, Artificial Sequence
  derived and/or modified sequence opt3 from neuraminidase__InfluenzaA__ACR47008
augaaccccaaucagaagaucauuaccauaggcagcgugugcaugacaaucgggauggccaaccugauucuccaaaucggaaauauuaucuccauauggccuguccacucuauccagcuugguaaccagaaucagauugagacuuguaaccaaucaguuaucacguacgaaaauaacaccugggugaaucagacauauguaaacauuaguaauacuaacuucgcugcaggccagagcguggucuccaugaaacuggccgggaacucuucguugugcccagugggaggcugggcgaucuacucaaaggacaauagcguuagaauagguaguaaaggggauguguuugucauuagggagccguucaucuccuguucucccuuagaaugccggaccuuuuuccugacacagggagcucuacucaaugacaagcauagcaacggcaccauuaaagaucgcuccccuuaucgaacucugaugucauguccaaucggcgaggugcccaguccuuacaacagccguuuugaaucuguagccugguccgcaucagccugccacgacgggaucaauuggcuuacaauuggaauaagcgguccagauaacggcgcuguugcagugcugaaguauaaugggaucauuaccgacacgaucaagaguuggagaaacaauauauugaggacucaagagucugagugugccugcgucaacggauccuguuucaccgugaugacagauggccccagcaauggucaggcuucguacaaaauuuuucggaucgaaaaggggaaaaucgugaagucugucgagaugaacgccccuaauuaucauuacgaagagugcuccuguuacccagacucaagugagauuacuugcguuugccgcgauaacuggcacggaagcaauagaccguggguguccuucaaccagaaucucgaauaucagaucggcuacauuuguucuggcauauuuggggacaaccccaggccuaaugauaaaaccggaagcugcgguccaguaucaaguaacggcgcgaacggggugaagggauucuccuuuaaguauggcaauggugucuggaucgggcggacaaaaagcauuucuucacgcaacggcuucgagaugaucugggaccccaauggauggaccggcacggauaacaauuuuaguaucaagcaagacauuguggggauaaacgaauggagcggauacuccgguucuuucguucagcauccugagcugacuggccuggacuguauccgaccaugcuucuggguggaacucauuagagggaggcccaaagagaauacaaucuggaccucgggaagcuccauuucauuuuguggcgucaacagugauacuguggguuggucuuggccggacggggcagaguuaccuuucacaaucgauaaguga

SEQ ID NO: 138918 - RNA, 1410 nt, Artificial Sequence; identical to SEQ ID NO: 138754
  derived and/or modified sequence opt3 from neuraminidase__InfluenzaA__ACR49267

SEQ ID NO: 138919 - RNA, 1410 nt, Artificial Sequence; identical to SEQ ID NO: 138744
  derived and/or modified sequence opt3 from neuraminidase__InfluenzaA__ACR49268

SEQ ID NO: 138920 - RNA, 1410 nt, Artificial Sequence; identical to SEQ ID NO: 138744
  derived and/or modified sequence opt3 from neuraminidase__InfluenzaA__ACR49269

SEQ ID NO: 138921 - RNA, 1410 nt, Artificial Sequence; identical to SEQ ID NO: 138744
  derived and/or modified sequence opt3 from neuraminidase__InfluenzaA__ACR49270

SEQ ID NO: 138922 - RNA, 1410 nt, Artificial Sequence; identical to SEQ ID NO: 138784
  derived and/or modified sequence opt3 from neuraminidase__InfluenzaA__ACR49271

SEQ ID NO: 138923 - RNA, 1410 nt, Artificial Sequence; identical to SEQ ID NO: 138754
  derived and/or modified sequence opt3 from neuraminidase__InfluenzaA__ACR49272

SEQ ID NO: 138924 - RNA, 1410 nt, Artificial Sequence; identical to SEQ ID NO: 138744
  derived and/or modified sequence opt3 from neuraminidase__InfluenzaA__ACR49273

SEQ ID NO: 138925 - RNA, 1410 nt, Artificial Sequence; identical to SEQ ID NO: 138744
  derived and/or modified sequence opt3 from neuraminidase__InfluenzaA__ACR49274

SEQ ID NO: 138926 - RNA, 1410 nt, Artificial Sequence; identical to SEQ ID NO: 138784
  derived and/or modified sequence opt3 from neuraminidase__InfluenzaA__ACR49275

SEQ ID NO: 138927 - RNA, 1410 nt, Artificial Sequence; identical to SEQ ID NO: 138784
  derived and/or modified sequence opt3 from neuraminidase__InfluenzaA__ACR49277

SEQ ID NO: 138928 - RNA, 1410 nt, Artificial Sequence; identical to SEQ ID NO: 138784
  derived and/or modified sequence opt3 from neuraminidase__InfluenzaA__ACR49278

SEQ ID NO: 138929 - RNA, 1410 nt, Artificial Sequence; identical to SEQ ID NO: 138744
  derived and/or modified sequence opt3 from neuraminidase__InfluenzaA__ACR49279

SEQ ID NO: 138930 - RNA, 1410 nt, Artificial Sequence; identical to SEQ ID NO: 138744
  derived and/or modified sequence opt3 from neuraminidase__InfluenzaA__ACR50994

SEQ ID NO: 138931 - RNA, 1410 nt, Artificial Sequence; identical to SEQ ID NO: 138754
  derived and/or modified sequence opt3 from neuraminidase__InfluenzaA__ACR50998

SEQ ID NO: 138932 - RNA, 1410 nt, Artificial Sequence; identical to SEQ ID NO: 138754
  derived and/or modified sequence opt3 from neuraminidase__InfluenzaA__ACR51008

SEQ ID NO: 138933 - RNA, 1410 nt, Artificial Sequence; identical to SEQ ID NO: 138754
  derived and/or modified sequence opt3 from neuraminidase__InfluenzaA__ACR51018

SEQ ID NO: 138934 - RNA, 1410 nt, Artificial Sequence; identical to SEQ ID NO: 138754
  derived and/or modified sequence opt3 from neuraminidase__InfluenzaA__ACR51028

SEQ ID NO: 138935 - RNA, 1410 nt, Artificial Sequence
  derived and/or modified sequence opt3 from neuraminidase__InfluenzaA__ACR51038
augaaccccaaucagaagaucauuaccauaggcagcgugugcauguccaucgggauggccaaccugauucuccaaaucggaaauauuaucucuauauggaucucacacaguauucagcuugguaaccagaaucagaucgagacauguaaccaaagcgucauuacuuacgaaaauaacacguggguuaaucagaccuaugugaacaucuccaauacaaacuucgcugcaggccagucuguagugucggucaaacuggccgggaauagcagcuugugcccugugaguggaugggcgauauacuccaaggacaacucuauuagaaucggcagcaaaggugauguuuuugugauuagggagccauucaucuccuguucaccguuagaaugccggaccuuuuuccugacucagggggcucuacucaaugacaagcauaguaacggaacaaucaaagaucgcagccccuaucgaacccugaugucuuguccuauuggcgaggucccaucccccuacaacucacguuuugaaagcguggccuggagugcaucugccugccacgacggcauaaauuggcuuacuaucgggauuuccggaccugauaacggugcuguagcaguucugaaguauaauggcaucauaacagacaccauuaagagcuggagaaacaauaucuugaggacgcaagagucggagugugccugcgugaacgggucuuguuucacugucaugaccgauggaccauccgacggccaggcuucauacaaaaucuuucggauugaaaaggguaaaaucgugaagaguguggagaugaaugcccccaacuaucauuacgaagagugcagcuguuacccugauuccucugagauuacaugcgucugccgcgacaauuggcacgggagcaacagaccauggguuucauucaaucagaaccucgaauaucagauaggauacaucuguaguggcauuuuuggcgauaauccgaggcccaacgacaaaacuggguccugcggaccugugagcucuaauggugcgaacggcguaaagggguucucauuuaaguauggaaacggcguguggaucggucggaccaaaaguaucagcucccgcaauggguucgagaugauuugggauccaaacggcuggacaggaaccgacaauaacuuuucuauaaagcaagacaucgucggcauuaaugaauggucgggguacagcggauccuucgugcagcaucccgagcugacgggucuggauuguauccgaccuugcuucuggguugaacucauuagaggcaggccaaaagagaacacuaucuggacaucagggaguucuauaucauuuuguggagucaauuccgacaccgugggcuggucauggcccgauggugcagaguuaccguucacuaucgacaaguga

SEQ ID NO: 138936 - RNA, 1410 nt, Artificial Sequence; identical to SEQ ID NO: 138754
  derived and/or modified sequence opt3 from neuraminidase__InfluenzaA__ACR51048

SEQ ID NO: 138937 - RNA, 1410 nt, Artificial Sequence; identical to SEQ ID NO: 138754
  derived and/or modified sequence opt3 from neuraminidase__InfluenzaA__ACR51058

SEQ ID NO: 138938 - RNA, 1410 nt, Artificial Sequence; identical to SEQ ID NO: 138744
  derived and/or modified sequence opt3 from neuraminidase__InfluenzaA__ACR51068

SEQ ID NO: 138939 - RNA, 1410 nt, Artificial Sequence; identical to SEQ ID NO: 138754
  derived and/or modified sequence opt3 from neuraminidase__InfluenzaA__ACR52371

SEQ ID NO: 138940 - RNA, 1410 nt, Artificial Sequence; identical to SEQ ID NO: 138754
  derived and/or modified sequence opt3 from neuraminidase__InfluenzaA__ACR52381

SEQ ID NO: 138941 - RNA, 1410 nt, Artificial Sequence; identical to SEQ ID NO: 138754
  derived and/or modified sequence opt3 from neuraminidase__InfluenzaA__ACR52391

SEQ ID NO: 138942 - RNA, 1410 nt, Artificial Sequence; identical to SEQ ID NO: 138754
  derived and/or modified sequence opt3 from neuraminidase__InfluenzaA__ACR52401

SEQ ID NO: 138943 - RNA, 1410 nt, Artificial Sequence; identical to SEQ ID NO: 138754
  derived and/or modified sequence opt3 from neuraminidase__InfluenzaA__ACR52411

SEQ ID NO: 138944 - RNA, 1410 nt, Artificial Sequence; identical to SEQ ID NO: 138754
  derived and/or modified sequence opt3 from neuraminidase__InfluenzaA__ACR52421

SEQ ID NO: 138945 - RNA, 1410 nt, Artificial Sequence; identical to SEQ ID NO: 138754
  derived and/or modified sequence opt3 from neuraminidase__InfluenzaA__ACR52431

SEQ ID NO: 138946 - RNA, 1410 nt, Artificial Sequence; identical to SEQ ID NO: 138754
  derived and/or modified sequence opt3 from neuraminidase__InfluenzaA__ACR52441

SEQ ID NO: 138947 - RNA, 1410 nt, Artificial Sequence; identical to SEQ ID NO: 138754
  derived and/or modified sequence opt3 from neuraminidase__InfluenzaA__ACR52451

SEQ ID NO: 138948 - RNA, 1410 nt, Artificial Sequence; identical to SEQ ID NO: 138754
  derived and/or modified sequence opt3 from neuraminidase__InfluenzaA__ACR52471

SEQ ID NO: 138949 - RNA, 1410 nt, Artificial Sequence; identical to SEQ ID NO: 138754
  derived and/or modified sequence opt3 from neuraminidase__InfluenzaA__ACR52481

SEQ ID NO: 138950 - RNA, 1410 nt, Artificial Sequence; identical to SEQ ID NO: 138754
  derived and/or modified sequence opt3 from neuraminidase__InfluenzaA__ACR52491

SEQ ID NO: 138951 - RNA, 1410 nt, Artificial Sequence; identical to SEQ ID NO: 138754
  derived and/or modified sequence opt3 from neuraminidase__InfluenzaA__ACR54046

SEQ ID NO: 138952 - RNA, 1410 nt, Artificial Sequence; identical to SEQ ID NO: 138744
  derived and/or modified sequence opt3 from neuraminidase__InfluenzaA__ACR54052

SEQ ID NO: 138953 - RNA, 1410 nt, Artificial Sequence; identical to SEQ ID NO: 138754
  derived and/or modified sequence opt3 from neuraminidase__InfluenzaA__ACR54966

SEQ ID NO: 138954 - RNA, 1410 nt, Artificial Sequence; identical to SEQ ID NO: 138754
  derived and/or modified sequence opt3 from neuraminidase__InfluenzaA__ACR54976

SEQ ID NO: 138955 - RNA, 1410 nt, Artificial Sequence; identical to SEQ ID NO: 138754
  derived and/or modified sequence opt3 from neuraminidase__InfluenzaA__ACR54986

SEQ ID NO: 138956 - RNA, 1410 nt, Artificial Sequence; identical to SEQ ID NO: 138744
  derived and/or modified sequence opt3 from neuraminidase__InfluenzaA__ACR54996

SEQ ID NO: 138957 - RNA, 1410 nt, Artificial Sequence; identical to SEQ ID NO: 138754
  derived and/or modified sequence opt3 from neuraminidase__InfluenzaA__ACR55006

SEQ ID NO: 138958 - RNA, 1410 nt, Artificial Sequence; identical to SEQ ID NO: 138744
  derived and/or modified sequence opt3 from neuraminidase__InfluenzaA__ACR56383

SEQ ID NO: 138959 - RNA, 1410 nt, Artificial Sequence; identical to SEQ ID NO: 138744
  derived and/or modified sequence opt3 from neuraminidase__InfluenzaA__ACR56393

SEQ ID NO: 138960 - RNA, 1410 nt, Artificial Sequence; identical to SEQ ID NO: 138754
  derived and/or modified sequence opt3 from neuraminidase__InfluenzaA__ACR56403

SEQ ID NO: 138961 - RNA, 1410 nt, Artificial Sequence; identical to SEQ ID NO: 138754
  derived and/or modified sequence opt3 from neuraminidase__InfluenzaA__ACR56413

SEQ ID NO: 138962 - RNA, 1410 nt, Artificial Sequence; identical to SEQ ID NO: 138754
  derived and/or modified sequence opt3 from neuraminidase__InfluenzaA__ACR56423

SEQ ID NO: 138963 - RNA, 1410 nt, Artificial Sequence; identical to SEQ ID NO: 138754
  derived and/or modified sequence opt3 from neuraminidase__InfluenzaA__ACR56433

SEQ ID NO: 138964 - RNA, 1410 nt, Artificial Sequence; identical to SEQ ID NO: 138754
  derived and/or modified sequence opt3 from neuraminidase__InfluenzaA__ACR56443

SEQ ID NO: 138965 - RNA, 1410 nt, Artificial Sequence; identical to SEQ ID NO: 138754
  derived and/or modified sequence opt3 from neuraminidase__InfluenzaA__ACR56453

SEQ ID NO: 138966 - RNA, 1413 nt, Artificial Sequence; identical to SEQ ID NO: 138732
  derived and/or modified sequence opt3 from neuraminidase__InfluenzaA__ACR58555

SEQ ID NO: 138967 - RNA, 1413 nt, Artificial Sequence
  derived and/or modified sequence opt3 from neuraminidase__InfluenzaA__ACR61658
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucucgaucaauaacacuaauguugugaccgggaaagacaagacaucaguaacccuugcaggaaacagcagucuguguuccauuucuggcugggccaucuacacuaaagauaauagcaucaggauugguuccaagggggacguguucgucauacgggagccuuuuaucucaugcagucauuuggagugucgcacauucuuuuuaacccaaggagcgcugcuaaacgauaaacacagcaauggcacggugaaggaccgaucuccauaucgugcucucauguccugcccgcugggcgaagcccccucaccuuacaacagcaaguucgagaguguugcauggucugccuccgcuugucaugaugggaugggauggcuuacuauugguaucagcggcccagacaauggggcaguggccguccugaaauauaacggaauaauuaccgaaacaaucaagucguggaaaaagagaaucuugaggacucaggagucugagugcguguguguaaacggcuccugcuuuaccauuaugacagauggucccucaaauggggcugccaguuacaaaaucuucaagauugaaaagggaaaaguuaccaagagcauagagcucaacgcgccuaauuuucacuaugaagaguguuccugcuacccagacacgggcacugugaugugugucugccgggauaacuggcacggcucuaaucgccccugggugagcuucaaccagaaucuggacuaccagaucggguauauuugcucaggaguguuuggugauaacccuagaccaaaagacggcaaggggaguuguaauccggucacaguugauggagcagacggcgugaaagguuucuccuacaaguaugggaacggcguauggaucggaaggaccaaaagcaaucggcugcgcaagggcuuugagaugaucugggaccccaacggguggacugauacagacucugauuucucagugaagcaagacgucguggccauuaccgauuggaguggauacagcgguuccuuuguucagcauccugaacucacgggcuuagacugcauacgaccauguuucuggguggagcuggucagagggcuucccagggaaaauaccacaaucuggacuucuggaucgagcauuuccuucugcggcguggauucagacaccgcuaacuggaguuggccugauggugccgaguugccauuuacaaucgacaaauga

SEQ ID NO: 138968 - RNA, 1410 nt, Artificial Sequence
  derived and/or modified sequence opt3 from neuraminidase__InfluenzaA__ACR61680
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaaugauaccgugcgagaccguacaccauauagaacucugcuuaugaacgaacugggaguucccuuucacuugggcaccaaacaggugugcauugcuuggagcaguuccucuugucaugaugguaaggccuggcuccacgucugcaucacaggggacgauaagaaugcaaccgccagcuucaucuacaacggaaggcugguggacuccguaguuucauggaguaaagagauucugcggacgcaggaaagcgagugugugugcauaaauggcacuuguaucgucgugaugacagauggcucugcuuccgggaaggcagacaccaaaauucucuuuaucgaggaaggaaagauagugcauacuucaacauuaagcgguagugcccaacacgucgaggaaugcucuugcuauccucgcuacccaggcguuagaugugugugcagggauaacuggaagggguccaaccggccgauuguagacaucaauaucaaagaccacagcauugugucgucuuacgucuguuccggacuggugggcgauacccccaggaagaacgacucaaguagcuccucucauugccuugauccuaauaacgaggaaggugggcacggaguuaaaggcugggcuuucgacgauggcaaugacguguggauggggcgaacgaucagcgagaagucaagauugggauaugagaccuuuaaagucauugaagguuggaguaacccaaaguccaaacugcagauaaaucgccaggugaucguagaucggggcaaccguagcggguacucuggaauuuucucaguugagggcaagaguuguaucaaucgcugcuuuuauguggaacuaaucagagguaggaaggaggaaacagagguccucuggacuagcaacuccauuguggucuucugugggaccucuggcacauacggaacuggcucguggcccgacggggccgauauaaaucugaugccuaucuga

SEQ ID NO: 138969 - RNA, 1410 nt, Artificial Sequence
  derived and/or modified sequence opt3 from neuraminidase__InfluenzaA__ACR61691
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccauaaauuagcugaguacaggaauuggaguaagccccagugugacauaacaggguucgcaccuuuuagcaaagauaacuccauucggcugucugccggaggugacaucuggguaacccgcgagccauaugugucgugcgaucccgacaaguguuaccaauucgcgcuaggccaggggacgacucucaauaacguccacucaaauaacaccgugcgagaucguacaccuuauagaacucugcuuaugaaugaacugggaguuccauuucauuugggcaccaaacaggugugcauugcuuggagcaguuccucuugucacgacgguaaggccuggcuccaugucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccccgcuacccuggcguuagaugugugugcagggacaacuggaagggguccaaucggccaauaguagauauuaacaucaaagaccauagcaucgugucgucuuacgucuguuccggacuggugggcgacacgccgcgcaagaaugauucaaguagcuccucucacugccuugaccccaacaaugaggaaggugggcauggaguuaaaggcugggcuuucgaugacggcaacgauguguggauggggcgaaccauuagcgagaagucaagauugggauaugagacauuuaaagucaucgaagguuggaguaauccuaaguccaaacugcagauuaacaggcaagugauaguagaccggggcaaucguagcggguacucuggaaucuucucaguugagggcaagaguuguauuaaccgcugcuuuuauguggaacuaaucagagguaggaaggaggaaacugagguccucuggaccagcaauuccaucguggucuucugugggacaucuggcacuuacggaaccggcucguggccagauggggccgacauuaaccugaugcccauauga

SEQ ID NO: 138970 - RNA, 1410 nt, Artificial Sequence
  derived and/or modified sequence opt3 from neuraminidase__InfluenzaA__ACR61702
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucuaacugccuugacccuaauaacgaggaaggugggcauggaguuaaaggcugggcuuucgaugacggcaaugauguguggauggggcgaaccauuagcgagaagucaagauugggauaugagacauuuaaagucaucgaagguuggaguaacccaaaguccaaacugcagauuaauaggcaagugauaguagaccggggcaaccguagcggguacucuggaaucuucucaguugagggcaagaguuguauuaaucgcugcuuuuauguggaacuaaucagagguaggaaggaggaaacugagguccucuggaccagcaacuccaucguggucuucugugggacaucuggcacuuacggaaccggcucguggcccgauggggccgacauuaaucugaugccuauauga

SEQ ID NO: 138971 - RNA, 1410 nt, Artificial Sequence; identical to SEQ ID NO: 138744
  derived and/or modified sequence opt3 from neuraminidase__InfluenzaA__ACR67201

SEQ ID NO: 138972 - RNA, 1410 nt, Artificial Sequence; identical to SEQ ID NO: 138754
  derived and/or modified sequence opt3 from neuraminidase__InfluenzaA__ACR67202

SEQ ID NO: 138973 - RNA, 1410 nt, Artificial Sequence; identical to SEQ ID NO: 138744
  derived and/or modified sequence opt3 from neuraminidase__InfluenzaA__ACR67203

SEQ ID NO: 138974 - RNA, 1410 nt, Artificial Sequence; identical to SEQ ID NO: 138754
  derived and/or modified sequence opt3 from neuraminidase__InfluenzaA__ACR67204

SEQ ID NO: 138975 - RNA, 1410 nt, Artificial Sequence; identical to SEQ ID NO: 138754
  derived and/or modified sequence opt3 from neuraminidase__InfluenzaA__ACR67246

SEQ ID NO: 138976 - RNA, 1410 nt, Artificial Sequence; identical to SEQ ID NO: 138744
  derived and/or modified sequence opt3 from neuraminidase__InfluenzaA__ACR67256

SEQ ID NO: 138977 - RNA, 1410 nt, Artificial Sequence; identical to SEQ ID NO: 138754
  derived and/or modified sequence opt3 from neuraminidase__InfluenzaA__ACR77451

SEQ ID NO: 138978 - RNA, 1410 nt, Artificial Sequence; identical to SEQ ID NO: 138754
  derived and/or modified sequence opt3 from neuraminidase__InfluenzaA__ACR77461

SEQ ID NO: 138979 - RNA, 1410 nt, Artificial Sequence; identical to SEQ ID NO: 138754
  derived and/or modified sequence opt3 from neuraminidase__InfluenzaA__ACR77471

SEQ ID NO: 138980 - RNA, 1410 nt, Artificial Sequence; identical to SEQ ID NO: 138754
  derived and/or modified sequence opt3 from neuraminidase__InfluenzaA__ACR77481

SEQ ID NO: 138981 - RNA, 1410 nt, Artificial Sequence; identical to SEQ ID NO: 138754
  derived and/or modified sequence opt3 from neuraminidase__InfluenzaA__ACR77491

SEQ ID NO: 138982 - RNA, 1410 nt, Artificial Sequence; identical to SEQ ID NO: 138754
  derived and/or modified sequence opt3 from neuraminidase__InfluenzaA__ACR77501

SEQ ID NO: 138983 - RNA, 1410 nt, Artificial Sequence; identical to SEQ ID NO: 138754
  derived and/or modified sequence opt3 from neuraminidase__InfluenzaA__ACR83527

SEQ ID NO: 138984 - RNA, 1410 nt, Artificial Sequence; identical to SEQ ID NO: 138754
  derived and/or modified sequence opt3 from neuraminidase__InfluenzaA__ACR83539

SEQ ID NO: 138985 - RNA, 1410 nt, Artificial Sequence; identical to SEQ ID NO: 138754
  derived and/or modified sequence opt3 from neuraminidase__InfluenzaA__ACS14669

SEQ ID NO: 138986 - RNA, 1410 nt, Artificial Sequence; identical to SEQ ID NO: 138754
  derived and/or modified sequence opt3 from neuraminidase__InfluenzaA__ACS14679

SEQ ID NO: 138987 - RNA, 1410 nt, Artificial Sequence; identical to SEQ ID NO: 138754
  derived and/or modified sequence opt3 from neuraminidase__InfluenzaA__ACS14689

SEQ ID NO: 138988 - RNA, 1410 nt, Artificial Sequence; identical to SEQ ID NO: 138754
  derived and/or modified sequence opt3 from neuraminidase__InfluenzaA__ACS14699

SEQ ID NO: 138989 - RNA, 1410 nt, Artificial Sequence; identical to SEQ ID NO: 138754
  derived and/or modified sequence opt3 from neuraminidase__InfluenzaA__ACS14709

SEQ ID NO: 138990 - RNA, 1410 nt, Artificial Sequence; identical to SEQ ID NO: 138754
  derived and/or modified sequence opt3 from neuraminidase__InfluenzaA__ACS14719

SEQ ID NO: 138991 - RNA, 1410 nt, Artificial Sequence; identical to SEQ ID NO: 138754
  derived and/or modified sequence opt3 from neuraminidase__InfluenzaA__ACS14729

SEQ ID NO: 138992 - RNA, 1410 nt, Artificial Sequence; identical to SEQ ID NO: 138754
  derived and/or modified sequence opt3 from neuraminidase__InfluenzaA__ACS14739

SEQ ID NO: 138993 - RNA, 1410 nt, Artificial Sequence; identical to SEQ ID NO: 138744
  derived and/or modified sequence opt3 from neuraminidase__InfluenzaA__ACS27192

SEQ ID NO: 138994 - RNA, 1410 nt, Artificial Sequence; identical to SEQ ID NO: 138754
  derived and/or modified sequence opt3 from neuraminidase__InfluenzaA__ACS27202

SEQ ID NO: 138995 - RNA, 1410 nt, Artificial Sequence; identical to SEQ ID NO: 138754
  derived and/or modified sequence opt3 from neuraminidase__InfluenzaA__ACS27212

SEQ ID NO: 138996 - RNA, 1410 nt, Artificial Sequence; identical to SEQ ID NO: 138744
  derived and/or modified sequence opt3 from neuraminidase__InfluenzaA__ACS27222

SEQ ID NO: 138997 - RNA, 1410 nt, Artificial Sequence; identical to SEQ ID NO: 138754
  derived and/or modified sequence opt3 from neuraminidase__InfluenzaA__ACS27232

SEQ ID NO: 138998 - RNA, 1410 nt, Artificial Sequence; identical to SEQ ID NO: 138744
  derived and/or modified sequence opt3 from neuraminidase__InfluenzaA__ACS27242

SEQ ID NO: 138999 - RNA, 1410 nt, Artificial Sequence; identical to SEQ ID NO: 138754
  derived and/or modified sequence opt3 from neuraminidase__InfluenzaA__ACS27252

SEQ ID NO: 139000 - RNA, 1410 nt, Artificial Sequence; identical to SEQ ID NO: 138744
  derived and/or modified sequence opt3 from neuraminidase__InfluenzaA__ACS27771

SEQ ID NO: 139001 - RNA, 1410 nt, Artificial Sequence; identical to SEQ ID NO: 138909
  derived and/or modified sequence opt3 from neuraminidase__InfluenzaA__ACS34969

SEQ ID NO: 139002 - RNA, 1410 nt, Artificial Sequence; identical to SEQ ID NO: 138909
  derived and/or modified sequence opt3 from neuraminidase__InfluenzaA__ACS34970

SEQ ID NO: 139003 - RNA, 1410 nt, Artificial Sequence; identical to SEQ ID NO: 138909
  derived and/or modified sequence opt3 from neuraminidase__InfluenzaA__ACS34971

SEQ ID NO: 139004 - RNA, 1410 nt, Artificial Sequence; identical to SEQ ID NO: 138754
  derived and/or modified sequence opt3 from neuraminidase__InfluenzaA__ACS34972

SEQ ID NO: 139005 - RNA, 1410 nt, Artificial Sequence; identical to SEQ ID NO: 138754
  derived and/or modified sequence opt3 from neuraminidase__InfluenzaA__ACS50081

SEQ ID NO: 139006 - RNA, 1410 nt, Artificial Sequence; identical to SEQ ID NO: 138754
  derived and/or modified sequence opt3 from neuraminidase__InfluenzaA__ACS50087

SEQ ID NO: 139007 - RNA, 1410 nt, Artificial Sequence; identical to SEQ ID NO: 138754
  derived and/or modified sequence opt3 from neuraminidase__InfluenzaA__ACS50094

SEQ ID NO: 139008 - RNA, 1410 nt, Artificial Sequence; identical to SEQ ID NO: 138744
  derived and/or modified sequence opt3 from neuraminidase__InfluenzaA__ACS54264

SEQ ID NO: 139009 - RNA, 1410 nt, Artificial Sequence; identical to SEQ ID NO: 138909
  derived and/or modified sequence opt3 from neuraminidase__InfluenzaA__ACS54265

SEQ ID NO: 139010 - RNA, 1410 nt, Artificial Sequence; identical to SEQ ID NO: 138754
  derived and/or modified sequence opt3 from neuraminidase__InfluenzaA__ACS54266

SEQ ID NO: 139011 - RNA, 1410 nt, Artificial Sequence; identical to SEQ ID NO: 138754
  derived and/or modified sequence opt3 from neuraminidase__InfluenzaA__ACS54267

SEQ ID NO: 139012 - RNA, 1410 nt, Artificial Sequence; identical to SEQ ID NO: 138754
  derived and/or modified sequence opt3 from neuraminidase__InfluenzaA__ACS54268

SEQ ID NO: 139013 - RNA, 1410 nt, Artificial Sequence; identical to SEQ ID NO: 138754
  derived and/or modified sequence opt3 from neuraminidase__InfluenzaA__ACS54303

SEQ ID NO: 139014 - RNA, 1410 nt, Artificial Sequence; identical to SEQ ID NO: 138754
  derived and/or modified sequence opt3 from neuraminidase__InfluenzaA__ACS68823

SEQ ID NO: 139015 - RNA, 1410 nt, Artificial Sequence; identical to SEQ ID NO: 138754
  derived and/or modified sequence opt3 from neuraminidase__InfluenzaA__ACS75824

SEQ ID NO: 139016 - RNA, 1410 nt, Artificial Sequence; identical to SEQ ID NO: 138754
  derived and/or modified sequence opt3 from neuraminidase__InfluenzaA__ACS77929

SEQ ID NO: 139017 - RNA, 1410 nt, Artificial Sequence; identical to SEQ ID NO: 138754
  derived and/or modified sequence opt3 from neuraminidase__InfluenzaA__ACS77939

SEQ ID NO: 139018 - RNA, 1410 nt, Artificial Sequence; identical to SEQ ID NO: 138744
  derived and/or modified sequence opt3 from neuraminidase__InfluenzaA__ACS77949

SEQ ID NO: 139019 - RNA, 1410 nt, Artificial Sequence; identical to SEQ ID NO: 138754
  derived and/or modified sequence opt3 from neuraminidase__InfluenzaA__ACS77959

SEQ ID NO: 139020 - RNA, 1410 nt, Artificial Sequence; identical to SEQ ID NO: 138754
  derived and/or modified sequence opt3 from neuraminidase__InfluenzaA__ACS77969

SEQ ID NO: 139021 - RNA, 1410 nt, Artificial Sequence; identical to SEQ ID NO: 138754
  derived and/or modified sequence opt3 from neuraminidase__InfluenzaA__ACS77979

SEQ ID NO: 139022 - RNA, 1410 nt, Artificial Sequence; identical to SEQ ID NO: 138754
  derived and/or modified sequence opt3 from neuraminidase__InfluenzaA__ACS77989

SEQ ID NO: 139023 - RNA, 1410 nt, Artificial Sequence; identical to SEQ ID NO: 138754
  derived and/or modified sequence opt3 from neuraminidase__InfluenzaA__ACS77999

SEQ ID NO: 139024 - RNA, 1410 nt, Artificial Sequence; identical to SEQ ID NO: 138754
  derived and/or modified sequence opt3 from neuraminidase__InfluenzaA__ACS78009

SEQ ID NO: 139025 - RNA, 1410 nt, Artificial Sequence; identical to SEQ ID NO: 138754
  derived and/or modified sequence opt3 from neuraminidase__InfluenzaA__ACS78019

SEQ ID NO: 139026 - RNA, 1410 nt, Artificial Sequence; identical to SEQ ID NO: 138754
  derived and/or modified sequence opt3 from neuraminidase__InfluenzaA__ACS78039

SEQ ID NO: 139027 - RNA, 1410 nt, Artificial Sequence; identical to SEQ ID NO: 138754
  derived and/or modified sequence opt3 from neuraminidase__InfluenzaA__ACS78049

SEQ ID NO: 139028 - RNA, 1410 nt, Artificial Sequence; identical to SEQ ID NO: 138754
  derived and/or modified sequence opt3 from neuraminidase__InfluenzaA__ACS88274

SEQ ID NO: 139029 - RNA, 1410 nt, Artificial Sequence; identical to SEQ ID NO: 138754
  derived and/or modified sequence opt3 from neuraminidase__InfluenzaA__ACS88275

SEQ ID NO: 139030 - RNA, 1410 nt, Artificial Sequence; identical to SEQ ID NO: 138744
  derived and/or modified sequence opt3 from neuraminidase__InfluenzaA__ACS92572

SEQ ID NO: 139031 - RNA, 1410 nt, Artificial Sequence; identical to SEQ ID NO: 138744
  derived and/or modified sequence opt3 from neuraminidase__InfluenzaA__ACS92582

SEQ ID NO: 139032 - RNA, 1410 nt, Artificial Sequence; identical to SEQ ID NO: 138754
  derived and/or modified sequence opt3 from neuraminidase__InfluenzaA__ACS92592

SEQ ID NO: 139033 - RNA, 1410 nt, Artificial Sequence; identical to SEQ ID NO: 138754
  derived and/or modified sequence opt3 from neuraminidase__InfluenzaA__ACS92603

SEQ ID NO: 139034 - RNA, 1410 nt, Artificial Sequence; identical to SEQ ID NO: 138744
  derived and/or modified sequence opt3 from neuraminidase__InfluenzaA__ACS92614

SEQ ID NO: 139035 - RNA, 1410 nt, Artificial Sequence; identical to SEQ ID NO: 138754
  derived and/or modified sequence opt3 from neuraminidase__InfluenzaA__ACT09115

SEQ ID NO: 139036 - RNA, 1410 nt, Artificial Sequence; identical to SEQ ID NO: 138754
  derived and/or modified sequence opt3 from neuraminidase__InfluenzaA__ACT10309

SEQ ID NO: 139037 - RNA, 1410 nt, Artificial Sequence; identical to SEQ ID NO: 138754
  derived and/or modified sequence opt3 from neuraminidase__InfluenzaA__ACT10315

SEQ ID NO: 139038 - RNA, 1410 nt, Artificial Sequence; identical to SEQ ID NO: 138744
  derived and/or modified sequence opt3 from neuraminidase__InfluenzaA__ACT11059

SEQ ID NO: 139039 - RNA, 1350 nt, Artificial Sequence
  derived and/or modified sequence opt3 from neuraminidase__InfluenzaA__ACT15313
augaaccccaaucagaagaucauuaccauaggcagcaucugcauggugauugggaucgucucccugaugcuccaaauuggaaacaugaucucuauauggguuucacacaguauccagacagguaaucagugucaggacgagccuauuagcaacacuaaauuccuuacggaaaaggccguggcuuccguaacccuggcaggcaauucuucguugugcccaaucucagggugggccguguacagcaaagauaacaguauuagaaucggauccaggggcgacgucuuugugauacgggagccguucauuucuuguagccauuuagaaugccgcacauuuuuccugacucaaggugcgcuacucaaugauaagcacuccaacgggaccguuaaagaccgaucaccccaucguacacugaugaguuguccugugggagaggcuccaagccccuauaauucuagauuugaauccgucgccuggucagcaagcgccugccacgauggcaccaguuggcuuacuaucggcauuucugggccugacaacggagcuguggcaguacugaaguacaaugguaucaucacagauaccauuaaguccuggaggaacaauauaaugcggacgcaggagagcgagugugccugcguuaacggcucguguuucacugugaugaccgacgggccaucuuccggacaggcuucauauaaaaucuuuaagauggaaaaaggcaaggucgugaaaaguguggaguuggaugcccccaauuaccauuaugaagagugcagcuguuacccugacgcgggugagauuacaugcgucugccgcgauaacuggcacggguccaacagaccauggguuucuuucaaucagaaccucgaauaucaaaucggauacauauguagcggcguguuuggcgacaauccgaggcccaacgaugggacuggaucaugcgguccuguauucccaaauggcgcauacggggugaagggauuuaguuucaaguauggcaacggugucuggauugggcggaccaaauccacaaauagccgcucuggcuuugagaugaucugggaccccaacggauggaccggcacggacucaaguuucagcgugaagcaggauaucguugccauuacugacugguccggguacucuggaucguucgugcagcacccugaacugacaggucuggauuguauccgaccaugcuuuugggucgagcucauuagaggcaggcccaaagaaagcaccauauggacuuccgggucaaguaucucuuucuguggagugaauggcgacacaguaagcugguccuggccggauggugcugaguuaccuuuuaccauugacaaguga

SEQ ID NO: 139040 - RNA, 1350 nt, Artificial Sequence
  derived and/or modified sequence opt3 from neuraminidase__InfluenzaA__ACT15315
augaaccccaaucagaagaucauuaccauaggcagcaucugcauggugauugggaucgucucccugaugcuccaaauuggaaacaugaucucuauauggguuucacacaguauccagacagguaaucagugucaggacgagccuauuagcaacacuaaauuccuuacggaaaaggccguggcuuccguaacccuggcaggcaauucuucguugugcccaaucucagggugggccguguacagcaaagauaacaguauuagaaucggauccaggggcgacgucuuugugaugcgggagccguucauaucuuguagccauuuagaaugccgcacauuuuuccugacucaaggugcgcuacucaaugauaagcacuccaacgggaccguuaaagaccgaucaccccaucguacacugaugaguuguccugugggagaggcuccaagccccuauaauucuagauuugaauccgucgccuggucagcaagcgccugccacgauggcaccaguuggcuuacuauuggcaucucugggccugacaacggagcuguggcaguacugaaguacaaugguauuaucacagauaccaucaaguccuggaggaacaauauuaugcggacgcaggagagcgagugugccugcguuaacggcucguguuucacugugaugaccgacgggccaucuuccggacaggcuucauauaaaauauuuaagauggaaaaaggcaaggucgugaaaaguguggaguuggaugcccccaauuaccauuaugaagagugcagcuguuacccugacgcgggugagaucacaugcgucugccgcgauaacuggcacggguccaacagaccauggguuucuuucaaucagaaccucgaauaucaaauuggauacaucuguagcggcguguuuggcgacaauccgaggcccaacgaugggacuggaucaugcgguccuguauucccaaauggcgcauacggggugaagggauuuaguuucaaguauggcaacggugucuggauagggcggaccaaauccacaaauagccgcucuggcuuugagaugauuugggaccccaacggauggaccggcacggacucaaguuucagcgugaagcaggauaucguugccaucacugacugguccggguacucuggaucguucgugcagcacccugaacugacaggucuggauuguauucgaccaugcuuuugggucgagcucaucagaggcaggcccaaagaaagcaccauuuggacuuccgggucaaguauaucuuucuguggagugaauggcgacacaguaagcugguccuggccggauggugcugaguuaccuuuuaccaucgacaaguga

SEQ ID NO: 139041 - RNA, 1350 nt, Artificial Sequence; identical to SEQ ID NO: 139039
  derived and/or modified sequence opt3 from neuraminidase__InfluenzaA__ACT15319

SEQ ID NO: 139042 - RNA, 1350 nt, Artificial Sequence
  derived and/or modified sequence opt3 from neuraminidase__InfluenzaA__ACT15321
augaaccccaaucagaagaucauuaccauaggcagcaucugcauggugauugggaucgucucccugaugcuccaaauuggaaacaugaucucuauauggguuucacacaguauccagacagguaaucagugucaggacgagccuauuagcaacacuaaauuccuuacggaaagagccguggcuuccguaacccuggcaggcaauucuucguugugcccaaucucagggugggccguguacagcaaggauaacaguauuaggaucggaucccggggcgacgucuuugugauacgcgagccguucauuucuuguagccauuuagaaugccgaacauuuuuccugacucaaggugcgcuacucaaugauaaacacuccaacgggaccguuaaggaccguucaccccauagaacacugaugaguuguccugugggagaggcuccaagccccuauaauucuagguuugaauccgucgccuggucagcaagcgccugccacgauggcaccaguuggcuuacuaucggcauuucugggccugacaacggagcuguggcaguacugaaauacaaugguaucaucacagauaccauuaaguccuggcggaacaauauaaugcgcacgcaggagagcgagugugccugcguuaacggcucguguuucacugugaugaccgacgggccaucuuccggacaggcuucauauaagaucuuuaaaauggaaaagggcaaagucgugaagaguguggaguuggaugcccccaauuaccauuaugaagagugcagcuguuacccugacgcgggugagauuacaugcgucugcagagauaacuggcacggguccaacaggccauggguuucuuucaaucagaaccucgaauaucaaaucggauacauauguagcggcguguuuggcgacaauccgcggcccaacgaugggacuggaucaugcgguccuguauucccaaauggcgcauacggggugaaaggauuuaguuucaaguauggcaacggugucuggauugggcgcaccaaguccacaaauagccgaucuggcuuugagaugaucugggaccccaacggauggaccggcacggacucaaguuucagcgugaaacaggauaucguugccauuacugacugguccggguacucuggaucguucgugcagcacccugaacugacaggucuggauuguaucagaccaugcuuuugggucgagcucauuaggggccggcccaaggaaagcaccauauggacuuccgggucaaguaucucuuucuguggagugaauggcgacacaguaagcugguccuggccggauggugcugaguuaccuuuuaccauugacaaauga

SEQ ID NO: 139043 - RNA, 1350 nt, Artificial Sequence; identical to SEQ ID NO: 139039
  derived and/or modified sequence opt3 from neuraminidase__InfluenzaA__ACT15323

SEQ ID NO: 139044 - RNA, 1350 nt, Artificial Sequence; identical to SEQ ID NO: 139039
  derived and/or modified sequence opt3 from neuraminidase__InfluenzaA__ACT15325

SEQ ID NO: 139045 - RNA, 1350 nt, Artificial Sequence
  derived and/or modified sequence opt3 from neuraminidase__InfluenzaA__ACT15327
augaaccccaaucagaagaucauuaccauaggcagcaucugcauggugauugggaucgucucccugaugcuccaaauuggaaacaugaucucuauauggguuucacacaguauccagacagguaauagaugucaggacgagccuauuagcaacacuaaauuccuuacggaaaaggccguggcuuccguaacccuggcaggcaauucuucguugugcccaaucucagggugggccguguacagcaaagauaacaguauuaggaucggaucccggggcgacgucuuugugauacgcgagccguucauuucuuguagccauuuagaaugccgaacauuuuuccugacucagggugcgcuacucaaugauaagcacuccaacgggaccguuaaagaccguucaccccauagaacacugaugaguuguccugugggagaggcuccaagccccuauaauucuagguuugaauccgucgccuggucagcaagcgccugccacgauggcaccaguuggcuuacuaucggcauuucugggccugacaacggagcuguggcaguacugaaguacaaugguaucaucacagauaccauuaaguccuggcggaacaauauaaugcgcacgcaagagagcgagugugccugcguuaacggcucguguuucacugugaugaccgacgggccaucuuccggacaggcuucauauaaaaucuuuaagauggaaaaaggcaaggucgugaaaaguguggaguuggaugcccccaauuaccauuaugaagagugcagcuguuacccugacgcgggugagauuacaugcgucugcagagauaacuggcacggguccaacaggccauggguuucuuucaaucagaaccucgaauauaagaucggauacauauguagcggcauuuuuggcgacaauccgcggcccaacgaugggacuggaucaugcgguccuguguucccaaauggcgcauacgggguaaagggauuuaguuucaaauauggcaacgguguguggaucgggcgcaccaaguccacaaauagccgaucuggcuuugagaugaucugggaccccaacggauggaccggcacggacucaaguuucagcgucaaacaggauauuguggccaucacugacugguccggguacucuggaucguucguucaacacccugaacugacaggucuggauuguauuagaccaugcuuuuggguggagcucauaaggggccggcccaaggaaagcaccaucuggacuuccgggucaaguauuucuuucuguggagucaauggcgacacagugagcugguccuggccggauggugcugaguuaccuuuuaccaucgacaaauga

SEQ ID NO: 139046 - RNA, 1350 nt, Artificial Sequence
  derived and/or modified sequence opt3 from neuraminidase__InfluenzaA__ACT15331
augaaccccaaucagaagaucauuaccauaggcagcaucugcauggugauugggaucgucucccugaugcuccaaauuggaaacaugaucucuauauggguuucacacaguauccagacagguaaucagugucaggacgagccuauuagcaacacuaaauuccuuacggaaaaggccguggcuuccguaacccuggcaggcaauucuucguugugcccaaucucagggugggccguguacagcaaagauaacaguauuagaaucggauccaggggcgacgucuuugugauacgggagccguucauuucuuguagccauuuagaaugccgcacauuuuuccugacucaaggugcgcuacucaaugauaagcacuccaacgggaccguuaaagaccgaucaccccaucguacacugaugaguuguccugugggagaggcuccaagccccuauaauucuagauuugaauccgucgccuggucagcaagcgccugccacgauggcaccaguuggcuuacuaucggcauuucugggccugacaacggagcuguggcaguacugaaguacaaugguaucaucacagauaccauuaaguccuggaggaacaauauaaugcggacgcaggagagcgagugugccugcguuaacggcucguguuucacugugaugaccgacgggccaucuuccggacaggcuucauauaaaaucuuuaagauggaaaaaggcaaggucgugaaaaguguggaguuggaugcccccaauuaccauuaugaagagugcagcuguuacccugacgcgggugagauuacaugcgucugccgcgauaacuggcacggguccaacagaccauggguuucuuucaaucagaaccucgaauaucaaaucggauacauauguagcggcguguuuggcgacaauccgaggcccaacgaugggacuggaucaugcgguccuguauucccaaauggcgcauacggggugaagggauuuaguuucaaguauggcaacggugucuggauugggcggaccaaauccacaaauagccgcucuggcuuugagaugaucugggaccccaacggauggaccggcacggacucaaguuucagcgugaagcaggauaucguugccauuacugacugguccggguacucuggaucguucgugcagcacccugaacugacaggucuggauuguauccgaccaugcuuuugggucgagcucauuagaggcaggcccaaagaaagcaccauauggacuuccgggucaaguaucucuuucuguggagugaauagcgacacaguauccuggucauggccggauggcgcugaguuaccuuuuaccauugacaaguga

SEQ ID NO: 139047 - RNA, 1350 nt, Artificial Sequence
  derived and/or modified sequence opt3 from neuraminidase__InfluenzaA__ACT15333
augaaccccaaucagaagaucauuaccauaggcagcaucugcauggugauugggaucgucucccugaugcuccaaauuggaaacaugaucucuauauggguuucacacaguauccagacagguaaucagugucagggcgagccuauuagcaacacuaaauuccuuacggaaaaggccguggcuuccguaacccuggcaggaaauucuucguugugcccaaucucagggugggccguguacagcaaagacaacaguauuagaaucggcuccaggggugaugucuuugugauacgggagccguucauuucuuguagccauuuagaaugccgcacauuuuuccugacucaaggggcgcuacucaaugacaagcacuccaacggaaccguuaaagaucgaucaccccaucguacacugaugaguuguccugugggcgaggcuccaagccccuauaauucuagauuugaauccgucgccuggucagcaagcgccugccacgacggcaccaguuggcuuacuaucgggauuucuggaccugauaacggugcuguggcaguacugaaguacaauggcaucaucacagacaccauuaaguccuggaggaacaauauauugcggacgcaggagagcgagugugccugcguuaacgggucguguuucacugugaugaccgauggaccaucuuccggccaggcuucauauaaaaucuuuaagauggaaaaagguaaggucgugaaaaguguggagcucgacgcccccaauuaccauuaugaagagugcagcuguuacccugaugcgggggagauuacaugcgucugccgcgacaacuggcacggauccaacagaccauggguuucuuucaaucagaaccuggaauaucaaaucggcuacauauguagcggcguguuuggggauaauccgaggcccaacgacggaacugguucaugcggcccuguagugaguaauggggcauacggagucaagggcuucuccuuuaaguaugguaacgggguguggauuggccggaccaaaagcacaaauucucgcucaggauucgagaugaucugggauccaaacggcuggaccgggacggacaguagcuuuuccggaaagcaggacaucguugccauuacugauuggucugguuacucgggcagcuucgugcagcaccccgaacugacagggcucgacuguauccgaccuugcuucugggucgaguuaauuagaggaaggccaaaagaauccaccauauggacuucaggcaguucuaucagcuuuugugguguaaauuccgauacagugucauggagcuggcccgacggggcugagcugccguucaccauugauaaguga

SEQ ID NO: 139048 - RNA, 1350 nt, Artificial Sequence
  derived and/or modified sequence opt3 from neuraminidase__InfluenzaA__ACT15335
augaaccccaaucagaagaucauuaccauaggcagcaucugcauggugauugggaucgucucccugaugcuccaaauuggaaacaugaucucuauauggguuucacacaguauccagacagguaauagaugucaggacgagccuauuagcaacacuaaauuccuuacggaaaaggccguggcuuccguaacccuggcaggcaauucuucguugugcccaaucucagggugggccguguacagcaaagauaacaguauuaggaucggaucccggggcgacgucuuugugauacgcgagccguucauuucuuguagccauuuagaaugccgaacauuuuuccugacucagggugcgcuacucaaugauaagcacuccaacgggaccguuaaagaccguucaccccauagaacacugaugaguuguccugugggagaggcuccaagccccuauaauucuagguuugaauccgucgccuggucagcaagcgccugccacgauggcaccaguuggcuuacuaucggcauuucugggccugacaacggagcuguggcaguacugaaguacaaugguaucaucacagauaccauuaaguccuggcggaacaauauaaugcgcacgcaagagagcgagugugccugcguuaacggcucguguuucacugugaugaccgacgggccaucuuccggacaggcuucauauaaaaucuuuaagauggaaaaaggcaaggucgugaaaaguguggaguuggaugcccccaauuaccauuaugaagagugcagcuguuacccugacgcgggugagauuacaugcgucugcagagauaacuggcacggguccaacaggccauggguuucuuucaaucagaaccucgaauauaagaucggauacauauguagcggcauuuuuggcgacaauccgcggcccaacgaugggacuggaucaugcgguccugugcugccaaauggcgcauacgggguaaagggauucaguuuuaaauauggcaacgguguguggaucgggcgcaccaaguccacaaauagccgaucuggcuucgagaugaucugggaccccaacggauggaccggcacggacucaaguuuuagcgucaaacaggauauuguggccaucacugacugguccggguacucuggaucguucguucaacacccugaacugacaggucucgauuguauuagaccaugcuucuggguggaguuaauaaggggccggcccaaggaaagcaccaucuggacuuccgggucaaguauuucuuuuuguggagucaauggcgacacagugagcugguccuggccggauggugcugagcugccuuucaccaucgacaaauga

SEQ ID NO: 139049 - RNA, 1350 nt, Artificial Sequence
  derived and/or modified sequence opt3 from neuraminidase__InfluenzaA__ACT15337
augaaccccaaucagaagaucauuaccauaggcagcaucugcauggugauugggaucgucucccugaugcuccaaauuggaaacaugaucucuauauggguuucacacaguauccagacagguaaucagugucaggacgagccuauuagcaacacuaaauuccuuacggaaaaggccguggcuuccguaacccuggcaggcaauucuucguugugcccaaucucagggugggccguguacagcaaagauaacaguauuagaaucggauccaggggcgacgucuuugugauacgggagccguucauuucuuguagccauuuagaaugccgcacauuuuuccugacucaaggugcgcuacucaaugauaagcacuccaacgggaccguuaaagaccgaucaccccaucguacacugaugaguuguccugugggagaggcuccaagccccuauaauucuagauuugaauccgucgccuggucagcaagcgccugccacgauggcaccaguuggcuuacuaucggcauuucugggccugacaacggagcuguggcaguacugaaguacaaugguaucaucacagauaccauuaaguccuggaggaacaauauaaugcggacgcaggagagcgagugugccugcguuaacggcucguguuucacugugaugaccgacgggccaucuuccggacaggcuucauauaaaaucuuuaagauggaaaaaggcaaggucgugaaaaguguggaguuggaugcccccaauuaccauuaugaagagugcagcuguuacccugacgcgggugagauuacaugcgucugccgcgauaacuggcacggguccaacagaccauggguuucuuucaaucagaaccucgaauaucaaaucggauacauauguagcggcguguuuggcgacaauccgaggcccaacgaugggacuggaucaugcgguccuguauucccaaauggcgcauacggggugaagggauuuaguuucaaguauggcaacggugucuggauugggcggaccaaauccacaaauagccgcucuggcuuugagaugaucugggaccccaacggauggaccggcacggacucaaguuucagcgugaagcaggauaucguugccgugacugacugguccggguacucuggaucguucguccagcacccugaacugacaggucuggauuguauucgaccaugcuuuuggguggagcucaucagaggcaggcccaaagaaagcaccauuuggacuuccgggucaaguauaucuuucuguggaguaaauggcgacacaguuagcugguccuggccggauggugcugaguuaccuuuuaccaucgacaaguga

SEQ ID NO: 139050 - RNA, 1350 nt, Artificial Sequence; identical to SEQ ID NO: 139039
  derived and/or modified sequence opt3 from neuraminidase__InfluenzaA__ACT15341

SEQ ID NO: 139051 - RNA, 1350 nt, Artificial Sequence
  derived and/or modified sequence opt3 from neuraminidase__InfluenzaA__ACT15344
augaaccccaaucagaagaucauuaccauaggcagcaucugcauggugauugggaucgucucccugaugcuccaaauuggaaacaugaucucuauauggguuucacacaguauccagacagguaaucagugucaggacgagccuauuagcaacacuaaauuccuuacggaaaaggccguggcuuccguaacccuggcaggcaauucuucguugugcccaaucucagggugggccguguacagcaaagauaacaguauuagaaucggauccaggggcgacgucuuugugauacgggagccguucauuucuuguagccauuuagaaugccgcacauuuuuccugacucaaggugcgcuacucaaugauaagcacuccaacgggaccguuaaagaccgaucaccccaucguacacugaugaguuguccugugggagaggcuccaagccccuauaauucuagauuugaauccgucgccuggucagcaagcgccugccacgauggcaccaguuggcuuacuaucggcauuucugggccugacaacggagcuguggcaguacugaaguacaaugguaucaucacagauaccauuaaguccuggaggagcaacauaaugcggacgcaggagucggagugugccugcguuaauggcucuuguuucacugugaugaccgacgggccauccucaggacaggcuaguuauaaaaucuuuaagauggaaaaaggcaaggucgugaaaagcguggaguuggaugcccccaacuaccauuaugaagagugcuccuguuacccugacgcgggugagauuacaugcgucugccgcgauaauuggcacgggucuaacagaccauggguuagcuucaaccagaaucucgaauaucaaaucggauacauauguucaggcguguuuggcgacaacccgaggcccaaugaugggacuggaaguugcgguccuguauucccaaacggcgcauacggggugaagggauuuuccuucaaguauggcaauggugucuggauugggcggaccaaaagcacaaacucucgcucaggcuuugagaugaucugggaccccaauggauggaccggcacggacaguagcuucuccgugaagcaggauaucguugccauuacugacuggucuggguacucggguagcuucgugcagcacccugaacugacaggacuggauuguauccgaccaugcuuuugggucgagcucauuagaggcaggcccaaagaauccaccauauggacuucagggaguucuaucagcuucuguggagugaacggcgacacaguauccuggucauggccggauggugcugaguuaccuuuuaccauugacaaguga

SEQ ID NO: 139052 - RNA, 1350 nt, Artificial Sequence
  derived and/or modified sequence opt3 from neuraminidase__InfluenzaA__ACT15346
augaaccccaaucagaagaucauuaccauaggcagcaucugcauggugauugggaucgucucccugaugcuccaaauuggaaacaugaucucuauauggguuucacacaguauccagacagguaaucagugucaggacgagccuauuagcaacacuaaauuccuuacggaaaaggccguggcuuccguaacccuggcaggcaauucuucguugugcccaaucucagggugggccguguacagcaaagauaacaauauuagaaucggaaguaggggcgacgucuuugugauacgggagccguucauuuccuguucucauuuagaaugccgcacauuuuuccugacucaaggugcgcuacucaacgauaagcacagcaaugggaccguuaaagaccgaucaccccaucguacacugauguccuguccugugggagaggcuccaagucccuauaacagcagauuugaaucugucgccugguccgcaucagccugccacgauggcaccagcuggcuuacuaucggcauuagugggccugacaauggagcuguggcaguacugaaguacaacgguaucaucacagauaccauuaagucuuggaggaauaacauaaugcggacgcaggaguccgagugugccugcguuaauggcagcuguuucacugugaugaccgacgggccaucgucuggacaggcuuccuauaaaaucuuuaagauggaaaaaggcaaggucgugaaaucaguggaguuggaugcccccaacuaccauuaugaagagugcaguuguuacccugacgcgggugagauuacaugcgucugccgcgauaacuggcacgggagcaauagaccauggguuuccuucaaccagaaucucgaauaucaaaucggauacauauguucuggcguguuuggcgacaacccgaggcccaaugaugggacuggaagcugcgguccuguauucccaaacggcgcauacggggugaagggauuuucauucaaguauggcaauggugucuggauugggcggaccaaaaguacaaacucccgcagcggcuuugagaugaucugggaccccaauggauggaccggcacggacucuucauucagugugaagcaggauaucguugccauuacugacuggagcggguacuccggaucuuucgugcagcacccugaacugacaggucuggauuguauccgaccaugcuuuugggucgagcucauuagaggcaggcccaaagaaucgaccauauggacuagcggguccucaaucaguuucuguggagugaacggcgacacaguaucuuggagcuggccggauggugcugaguuaccuuuuaccauugacaaguga

SEQ ID NO: 139053 - RNA, 1350 nt, Artificial Sequence
  derived and/or modified sequence opt3 from neuraminidase__InfluenzaA__ACT15348
augaaccccaaucagaagaucauuaccauaggcagcaucugcauggugauugggacagucucccugaugcuccaaaucggaaacaugauuucuaucuggguuucacacaguauacagacugguaaucagugucagggcgagccuaucagcaacacgaaauuccuuaccgaaaaggccguggcuuccguaacacuggcagggaauagcucguugugcccaauuucaggaugggccguguacagcaaagacaacaguaucagaauuggcuccaggggugaugucuuugugauccgggagccguucauaucuuguagccauuuagaaugccgcaccuuuuuccugacucaaggggcgcuacucaaugacaagcacuccaacggaacaguuaaagaucgaucaccccaucguacccugaugaguuguccugugggcgaggcuccaagccccuauaauucuagauuugaauccgucgccuggucagcaagcgccugccacgacggcacuuccuggcuuacaauugggaucucuggaccugauaacggugcuguggcaguacugaaguacaauggcauuaucaccgacacgaucaaguccuggaggaacaauauuuugcggacucaggagagcgagugugccugcguuaacgggucguguuucaccgugaugacagauggaccaucuuccggccaggcuucauauaaaauauuuaagauggaaaaagguaaggucgugaaaaguguggagcucgacgcccccaauuaccauuaugaagagugcagcuguuacccugaugcgggggagaucacuugcgucugccgcgacaacuggcacggauccaacagaccauggguuucuuucaaucagaaccuggaauaucaaauuggcuacaucuguagcggcguguuuggggauaauccgaggcccaacgacggaaccgguucaugcggcccuguagugaguaauggggcauacggagucaagggcuucuccuuuaaguaugguaacgggguguggauaggccggacaaaaagcaccaauucucgcucaggauucgagaugauuugggauccaaacggcuggacggggacugacaguagcuuuuccggaaagcaggacaucguugccaucacagauuggucugguuacucgggcagcuucgugcagcaccccgaacugaccgggcucgacuguauucgaccuugcuucugggucgaguuaaucagaggaaggccaaaagaauccacuauuuggacaucaggcaguucuauaucuuuuuguggugugaauagugauaccguaucauggagcuggcccgacggggcugagcugccguucacgaucgauaaguga

SEQ ID NO: 139054 - RNA, 1350 nt, Artificial Sequence
  derived and/or modified sequence opt3 from neuraminidase__InfluenzaA__ACT15350
augaaccccaaucagaagaucauuaccauaggcagcaucugcauggugauugggaucgucucccugaugcuccaaauuggaaacaugaucucuauauggguuucacacaguauccagacagguaauagaugucaggacgagccuauuagcaacacuaaauuccuuacggaaaaggccguggcuuccguaacccuggcaggcaauucuucguugugcccaaucucagggugggccguguacagcaaagauaacaguauuaggaucggaucccggggcgacgucuuugugauacgcgagccguucauuucuuguagccauuuagaaugccgaacauuuuuccugacucagggugcgcuacucaaugauaagcacuccaacgggaccguuaaagaccguucaccccauagaacacugaugaguuguccugugggagaggcuccaagccccuauaauucuagguuugaauccgucgccuggucagcaagcgccugccacgauggcaccaguuggcuuacuaucggcauuucugggccugacaacggagcuguggcaguacugaaguacaaugguaucaucacagauaccauuaaguccuggcggaacaauauaaugcgcacgcaagagagcgagugugccugcguuaacggcucguguuucacugugaugaccgacgggccaucuuccggacaggcuucauauaaaaucuuuaagauggaaaaaggcaaggucgugaaaaguguggaguuggaugcccccaauuaccauuaugaagagugcagcuguuacccugacgcgggugagauuacaugcgucugcagagauaacuggcacggguccaacaggccauggguuucuuucaaucagaaccucgaauauaagaucggauacauauguagcggcauuuuuggcgacaauccgcggcccaacgaugggacuggaucaugcgguccuguguucccaaauggcgcauacgggguaaagggauuuaguuucaaauauggcaacgguguguggaucgggcgcaccaaguccacaaauagccgaucuggcuuugagaugaucugggaccccaacggauggaccggcacggacucaaguuucagcgucaaacaggauauuguggccaucacugacugguccggguacucuggaucguucguucaacacccugaacugacaggucuggauuguauuagaccaugcuuuuggguggagcucauaaggggccggcccaaggaacguaccaucuggacuagcggguccucaauuaguuucuguggagucaauggcgacacagugucuuggagcuggccggauggugcugaguuaccuuuuaccaucgacaaauga

SEQ ID NO: 139055 - RNA, 1350 nt, Artificial Sequence
  derived and/or modified sequence opt3 from neuraminidase__InfluenzaA__ACT15352
augaaccccaaucagaagaucauuaccauaggcagcaucugcauggugauugggaucgucucccugaugcuccaaauuggaaacaugaucucuauauggguuucacacaguauccagacagguaaucagugucaggacgagccuauuagcaacacuaaauuccuuacggaaaaggccguggcuuccguaacccuggcaggcaauucuucguugugcccaaucucagggugggccguguacagcaaagauaacaguauuagaaucggauccaggggcgacgucuuugugauacgggagccguucauuucuuguagccauuuagaaugccgcacauuuuuccugacucaaggugcgcuacucaaugauaagcacuccaacgggaccguuaaagaccgaucaccccaucguacacugaugaguuguccugugggagaggcuccaagccccuauaauucuagauuugaauccgucgccuggucagcaagcgccugccacgauggcaccaguuggcuuacuaucggcauuucugggccugacaacggagcuguggcaguacugaaguacaaugguaucaucacagauaccauuaaguccuggaggaacaauauauugcggacgcaggagagcgagugugccugcguuaacggcucguguuucacugugaugaccgacgggccaucuuccggacaggcuucauauaaaaucuuuaagauggaaaaaggcaaggucgugaaaaguguggagcucgaugcccccaauuaccauuaugaagagugcagcuguuacccugacgcgggugagauuacaugcgucugccgcgauaacuggcacggguccaacagaccauggguuucuuucaaucagaaccuggaauaucaaaucggauacauauguagcggcguguuuggcgacaauccgaggcccaacgaugggacuggaucaugcgguccuguagugaguaauggcgcauacggggucaagggauucuccuuuaaguauggcaacgguguguggauugggcggaccaaaagcacaaauucucgcucaggcuucgagaugaucugggacccaaacggauggaccggcacggacaguagcuuuuccgggaagcaggauaucguugccauuacugacuggucuggauacucggguagcuucgugcagcaccccgaacugacaggccucgauuguauccgaccuugcuucugggucgaguuaauuagagggaggccaaaagaauccaccauauggacuucaggaaguucuaucagcuuuuguggcguaaauuccgacacagugucauggagcuggcccgauggugcugagcugccguucaccauugacaaguga

SEQ ID NO: 139056 - RNA, 1350 nt, Artificial Sequence
  derived and/or modified sequence opt3 from neuraminidase__InfluenzaA__ACT15354
augaaccccagccagaagaucauuaccauaggcuccaucugcauggugauugggaucgucucucugaugcuccaaauuggaaauaugaucucaauauggaucagucacagcauucagacagguaaccagugucaggacgagccuaucuccaauacuaaauuccuuacggaaaaggccguugcuucugugacccuggcaggcaacucgucauugugcccaauuagcgggugggccguauacaguaaagauaauuccaucagaauaggaucuaggggcgacguguuugucauucgggagccguucaucagcuguucccauuuagaaugccgcacauuuuuccugacucaaggugcgcuacucaacgauaagcacucaaaugggaccgugaaagaccgaaguccccaucguacacugaugagcuguccuguuggagaggcuccaucucccuauaacuccagauuugaaucaguggccuggagcgcaagugccugccacgauggcaccucuuggcuuacuauuggcaucuccgggccugacaauggagcugucgcagugcugaaguacaacgguaucauuacagauaccauaaagagcuggaggaauaacaucaugcggacgcaggagucggagugugccugcguaaauggcucuuguuucacuguuaugaccgacgggccauccucaggacaggcuaguuauaaaauuuuuaagauggaaaaaggcaagguggucaaaagcguggaguuggaugcccccaacuaccauuaugaagagugcuccuguuacccugacgcgggugagaucacaugcgugugccgcgauaauuggcacgggucuaacagaccaugggucagcuucaaccagaaucucgaauaucaaauaggauacauuuguucaggcguuuuuggcgacaacccgaggcccaaugaugggacuggaaguugcgguccuguguucccaaacggcgcauacgggguaaagggauuuuccuucaaguauggcaaugguguguggaucgggcggaccaaaagcacaaacucucgcucaggcuuugagaugaucugggaccccaauggauggaccggcacggacaguagcuucuccgucaagcaggauauuguggccaucacugacuggucuggguacucggguagcuucguucagcacccugaacugacaggacuggauuguauucgaccaugcuuuuggguggagcucauaagaggcaggcccaaagaauccaccaucuggacuucagggaguucuauuagcuucuguggagucaacggcgacacaguguccuggucauggccggauggugcugaguuaccuuuuaccaucgacaaguga

SEQ ID NO: 139057 - RNA, 1350 nt, Artificial Sequence
  derived and/or modified sequence opt3 from neuraminidase__InfluenzaA__ACT15356
augaaccccaaucagaagaucauuaccauaggcagcaucugcauggugauugggaucgucucccugaugcuccaaauuggaaacaugaucucuauauggguuucacacaguauccagacagguaaucagugucaggacgagccuauuagcaacacuaaauuccuuacggaaaaggccguggcuuccguaacccuggcaggcaauucuucguugugcccaaucucagggugggccguguacagcaaagauaacaguauuagaaucggauccaggggcgacgucuuugugauacgggagccguucauuucuuguagccauuuagaaugccgcacauuuuuccugacucaaggugcgcuacucaaugauaagcacuccaacgggaccguuaaagaccgaucaccccaucguacacugaugaguuguccugugggagaggcuccaagccccuauaauucuagauuugaauccgucgccuggucagcaagcgccugccacgauggcaccaguuggcuuacuaucggcauuucugggccugacaacggagcuguggcaguacugaaguacaaugguaucaucacagauaccauuaaguccuggaggaacaauauauugcggacgcaggagagcgagugugccugcguuaacggcucguguuucacugugaugaccgacgggccaucuuccggacaggcuucauauaaaaucuuuaagauggaaaaaggcaaggucgugaaaaguguggagcucgaugcccccaauuaccauuaugaagagugcagcuguuacccugacgcgggugagauuacaugcgucugccgcgauaacuggcacggguccaacagaccauggguuucuuucaaucagaaccuggaauaucaaaucggauacauauguagcggcguguuuggcgacaauccgaggcccaacgaugggacuggaucaugcgguccuguauucaguaauggcgcauacggggugaagggauuuuccuucaaguauggcaacggugucuggauugggcggaccaaaagcacaaauucucgcucaggcuuugagaugaucugggacccaaacggauggaccggcacggacaguagcuucuccgggaagcaggauaucguggccauuacugacuggucuggauacucggguagcuucguucagcaccccgaacugacaggccucgauuguauccgaccuugcuuuuggguggaguuaauuagagggaggccaaaagaauccaccauauggacuucaggaaguucuaucagcuucuguggcgucaauuccgacacagugucauggagcuggcccgauggugcugagcugccguuuaccauugacaaguga

SEQ ID NO: 139058 - RNA, 1350 nt, Artificial Sequence
  derived and/or modified sequence opt3 from neuraminidase__InfluenzaA__ACT15358
augaaccccaaucagaagaucauuaccauaggcagcaucugcauggugauugggaucgucucccugaugcuccaaauuggaaacaugaucucuauauggguuucacacaguauccagacagguaauagaugucaggacgagccuauuagcaacacuaaauuccuuacggaaaaggccguggcuuccguaacccuggcaggcaauucuucguugugcccaaucucagggugggccguguacagcaaagauaacaguauuaggaucggaucccggggcgacgucuuugugauacgcgagccguucauuucuuguagccauuuagaaugccgaacauuuuuccugacucacggugcgcuacucaaugauaagcauuccaacgggaccguuaaagaccguucaccccacagaacacugaugaguuguccugugggagaggcuccaagccccuauaauucuagguuugaauccgucgccuggucagcaagcgccugccaugauggcaccaguuggcuuacuaucggcauuucugggccugacaacggagcuguggcaguacugaaguacaaugguaucaucacagauaccauuaaguccuggcggaacaauauaaugcgcacgcaggagagcgagugugccugcguuaacggcucguguuucacugugaugaccgacgggccaucuuccggacaggcuucauauaaaaucuuuaagauggaaaaaggcaaggucgugaaaaguguggaguuggaugcccccaauuaccacuaugaagagugcagcuguuacccugacgcgggugagauuacaugcgucugcagagauaacuggcacggguccaacaggccauggaucucuuucaaucaaaaccucgaauauaagauaggauacauuuguagcggcaucuuuggcgacaauccgcggcccaacgaugggacuggaucaugcgguccuguucugccaaauggcgcauacggggugaagggauucaguuuuaaauauggcaacgguguauggaucgggcgcaccaaguccacaaauagccgaucuggcuucgagaugauuugggaccccaacggauggaccggcacggacucaaguuuuagcgugaaacaggauaucgucgccauuacugacugguccggguacucuggaucguucgugcagcauccugaacugacaggucucgauuguauaagaccaugcuucuggguugaguuaaucaggggccggcccaaggaaagcaccauuuggacuuccgggucaaguaucucuuuuuguggagugaauggcgacacagucagcugguccuggccggauggugcugagcugccuuucaccaucgacaaauga

SEQ ID NO: 139059 - RNA, 1410 nt, Artificial Sequence; identical to SEQ ID NO: 136343
  derived and/or modified sequence opt3 from neuraminidase__InfluenzaA__ACT21515

SEQ ID NO: 139060 - RNA, 1410 nt, Artificial Sequence
  derived and/or modified sequence opt3 from neuraminidase__InfluenzaA__ACT21516
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucgcuuauuugacaaacaccacuauugagaaggaaaucugccccaaauuagcagaguacaggaauuggaguaagccucagugugacauaacaggguucgccccauuuagcaaagauaacuccauucggcugucugcgggaggugacaucugggugacccgcgagcccuauguaucgugcgauccugacaaguguuaccaauucgcucuaggccaggggacgacucucaauaacgugcauucaaaugauaccguccacgaccgaacaccauaucguacucugcuuaugaacgaacugggagugcccuuucauuugggcaccaagcagguuugcguggccuggagcaguuccucuugucacgaugguaaagcauggcuccaugucugcgugacaggggacgagaagaaugccaccgcuagcuucauuuacaacggaagacugguagauuccaucguuucauggaguaaagaaauccugaggacgcaggagagcgagugugugugcauuaauggcacuuguacagucgugaugaccgacggcucugcauccgggaaggccgauacuaaaauacucuuuaucgaagagggaaagauugugcacacaucaaccuuaagcgguagugcucaacacgucgaagagugcucuugcuauccucgguacccaggcguucgcugugugugcagagacaacuggaagggguccaacaggccgaucguagauauaaauauuaaagacuacagcaucgugucgucuuaugucuguuccggacuggugggcgacacgccccggaagaacgauucaaguagcuccucucauugccuugacccuaauaacgaagagggugggcacggaguuaaaggcugggccuucgaugacggcaaugauguguggauggggcgcaccaucagcgagaaguugcgaucaggauacgaaacauuuaaagucauugaggguuggaguaacccaaauuccaagcugcagaucaacagacaggugauuguagacaggggcaaucggagcggguauucuggaauauucucaguugaaggcaaaaguuguaucaaccguugcuuuuacguggagcuaauucgcgguagaaaggaagagaaugagguccucuggacuagcaacuccaucguggucuucugugggaccucuggcacauauggaacuggcucguggcccgauggggcggacaucaaucugaugccuauuuga

SEQ ID NO: 139061 - RNA, 1410 nt, Artificial Sequence
  derived and/or modified sequence opt3 from neuraminidase__InfluenzaA__ACT21517
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggagugagccucagugugacauaacaggguucgcaccauuuagcaaggauaacuccauucggcugucugccggaggugacaucuggguaacccgcgaacccuaugugucgugcgauccugacaaauguuaccaauucgcgcuaggccaggggacgacucucaauaacguccauucaaaugauaccgugcacgaccgaacaccauaucguacucugguuaugaacgagcuuggagugcccuuucaucugggcaccaagcaggucugcauugcuuggagcaguuccucuugucacgaugguaaggccugguugcaugugugcguaacaggggacgauaaaaaugcaaccgccagcuucaucuacaacggaagacucguugacuccaucgugucauggaguaaggaaauucugaggacgcaggagagcgagugugucugcauaaauggcacuuguacaguggugaugaccgauggcucugcuuccgggaaagcagacacuaagauccuguuuauugaagagggaaaaaucguccacacaucaacccucagcgguagugcccaacacguugaagagugcucuugcuauccucgguacccaggcgugcgcuguguaugcagagauaacuggaagggguccaacaggccgauaguggacauuaauaucaaggacuacagcaucgucucgucuuauguguguuccggauuagcuggcgauacgccccggaaaaacgacucaaguagcuccucucauugccuggauccuaauaacgaagagggugggcacggaguuaagggcugggccuucgacgauggcaaugacguguggauggggcgcaccauuagcgagaaacuucgaucaggauacgaaacauuuaaggucaucgaggguuggaguaacccaaauuccaaauugcagauuaacagacaggugauaguagauaggggcaaucggagcggguauucuggaaucuucucaguugaaggcaagaguuguauuaaccguugcuuuuacguggagcugauccgcgguagaaaagaagagacugagguccuauggaccagcaauuccaucguggucuucugugggacaucuggcacuuauggaaccggcucguggcccgacggggcggauauuaaccucaugccuauauga

SEQ ID NO: 139062 - RNA, 1410 nt, Artificial Sequence; identical to SEQ ID NO: 138754
  derived and/or modified sequence opt3 from neuraminidase__InfluenzaA__ACT21574

SEQ ID NO: 139063 - RNA, 1410 nt, Artificial Sequence; identical to SEQ ID NO: 138754
  derived and/or modified sequence opt3 from neuraminidase__InfluenzaA__ACT21585

SEQ ID NO: 139064 - RNA, 1410 nt, Artificial Sequence; identical to SEQ ID NO: 138754
  derived and/or modified sequence opt3 from neuraminidase__InfluenzaA__ACT22011

SEQ ID NO: 139065 - RNA, 1410 nt, Artificial Sequence; identical to SEQ ID NO: 138754
  derived and/or modified sequence opt3 from neuraminidase__InfluenzaA__ACT22012

SEQ ID NO: 139066 - RNA, 1410 nt, Artificial Sequence; identical to SEQ ID NO: 138754
  derived and/or modified sequence opt3 from neuraminidase__InfluenzaA__ACT22013

SEQ ID NO: 139067 - RNA, 1410 nt, Artificial Sequence; identical to SEQ ID NO: 138754
  derived and/or modified sequence opt3 from neuraminidase__InfluenzaA__ACT22014

SEQ ID NO: 139068 - RNA, 1410 nt, Artificial Sequence; identical to SEQ ID NO: 138744
  derived and/or modified sequence opt3 from neuraminidase__InfluenzaA__ACT22015

SEQ ID NO: 139069 - RNA, 1410 nt, Artificial Sequence
  derived and/or modified sequence opt3 from neuraminidase__InfluenzaA__ACT22016
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucuaauggccaggcuuccuacaaaaucuuucggauugaaaaggguaaaaucgugaagucaguggagaugaacgcccccaauuauuacuacgaagagugcaguuguuauccugacagcuccgagauuacuugcgucugccgcgauaacuggcaugggucuaauagaccauggguuagcuucaaccagaaucucgaauaccagauaggauauaucuguucaggcauuuuuggcgacaacccgaggcccaaugauaaaaccgggaguugcggaccuguguccagcaacggugcgaacggcguaaagggguucucuuuuaaguacggaaauggcguguggaucggucggacaaaaucaaucaguagccgcaacggguucgagaugauuugggacccaaauggcuggaccggaacggauaacaauuuuuccauaaagcaagacaucgucggcauuaacgaauggucuggguauucggggagcuucgugcagcaccccgagcugacuggucuggacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 139070 - RNA, 1410 nt, Artificial Sequence; identical to SEQ ID NO: 138754
  derived and/or modified sequence opt3 from neuraminidase__InfluenzaA__ACT22017

SEQ ID NO: 139071 - RNA, 1410 nt, Artificial Sequence; identical to SEQ ID NO: 138754
  derived and/or modified sequence opt3 from neuraminidase__InfluenzaA__ACT22018

SEQ ID NO: 139072 - RNA, 1410 nt, Artificial Sequence; identical to SEQ ID NO: 138744
  derived and/or modified sequence opt3 from neuraminidase__InfluenzaA__ACT22506

SEQ ID NO: 139073 - RNA, 1410 nt, Artificial Sequence; identical to SEQ ID NO: 138754
  derived and/or modified sequence opt3 from neuraminidase__InfluenzaA__ACT22511

SEQ ID NO: 139074 - RNA, 1410 nt, Artificial Sequence; identical to SEQ ID NO: 138754
  derived and/or modified sequence opt3 from neuraminidase__InfluenzaA__ACT33121

SEQ ID NO: 139075 - RNA, 1410 nt, Artificial Sequence; identical to SEQ ID NO: 138754
  derived and/or modified sequence opt3 from neuraminidase__InfluenzaA__ACT33124

SEQ ID NO: 139076 - RNA, 1410 nt, Artificial Sequence; identical to SEQ ID NO: 138754
  derived and/or modified sequence opt3 from neuraminidase__InfluenzaA__ACT33126

SEQ ID NO: 139077 - RNA, 1410 nt, Artificial Sequence; identical to SEQ ID NO: 138744
  derived and/or modified sequence opt3 from neuraminidase__InfluenzaA__ACT35526

SEQ ID NO: 139078 - RNA, 1410 nt, Artificial Sequence; identical to SEQ ID NO: 138754
  derived and/or modified sequence opt3 from neuraminidase__InfluenzaA__ACT36507

SEQ ID NO: 139079 - RNA, 1410 nt, Artificial Sequence; identical to SEQ ID NO: 138754
  derived and/or modified sequence opt3 from neuraminidase__InfluenzaA__ACT36672

SEQ ID NO: 139080 - RNA, 1410 nt, Artificial Sequence; identical to SEQ ID NO: 138754
  derived and/or modified sequence opt3 from neuraminidase__InfluenzaA__ACT36673

SEQ ID NO: 139081 - RNA, 1410 nt, Artificial Sequence; identical to SEQ ID NO: 138754
  derived and/or modified sequence opt3 from neuraminidase__InfluenzaA__ACT36674

SEQ ID NO: 139082 - RNA, 1410 nt, Artificial Sequence; identical to SEQ ID NO: 138754
  derived and/or modified sequence opt3 from neuraminidase__InfluenzaA__ACT36675

SEQ ID NO: 139083 - RNA, 1410 nt, Artificial Sequence; identical to SEQ ID NO: 138754
  derived and/or modified sequence opt3 from neuraminidase__InfluenzaA__ACT36677

SEQ ID NO: 139084 - RNA, 1410 nt, Artificial Sequence
  derived and/or modified sequence opt3 from neuraminidase__InfluenzaA__ACT36678
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaagacaguccguagugucugucaaacuggccggcaauucgucauugugcccugugagcgggugggcgauauacaguaaggacaacuccguuaggauuggaucuaaaggcgauguguuugucauccgggagccauucauuagcuguuccccguuagaaugccgcaccuuuuuccugacacagggugcucuacucaaugacaagcauucaaacgggaccaucaaagaucgaagucccuaucguacucugaugagcuguccuaucggagaggugccaucucccuacaacuccagauuugaaucaguagccuggagcgcaagugccugccacgacggcauuaauuggcuuacaauaggcaucucugggccugauaacggagcuguugcagugcugaaguauaaugguauuaucaccgacacgauaaaguccuggaggaacaauauuuugcggacucaagagagcgagugugccugcgucaacggcucguguuucaccgugaugacagaugggccaucuaauggacaggcuuccuacaaaaucuuucgcaucgaaaagggcaaaauugugaagucagucgagaugaacgcccccaauuaucauuacgaagagugcaguuguuacccugacagcuccgagaucacuugcguuugcagagauaacuggcacgguucuaauaggccaugggugagcuucaaccagaaucucgaauaucagauuggguacauauguucaggaaucuuuggcgacaacccgcggcccaaugauaaaaccggcaguugcgggccuguauccagcaacggagcgaacggugugaagggcuucucuuuuaaguaugggaauggagucuggauuggccgcacaaaaucaaucaguagccgaaacgguuucgagaugaucugggacccaaauggguggaccggcacggauaacaauuuuuccauuaagcaagacauagugggaaucaacgaauggucuggcuacucggggagcuucguucagcaucccgagcugacuggacuggacuguauuagaccuugcuucuggguggaacucaucaggggucggccaaaagagaauacaauuuggaccuccggcucaaguaucucuuuuuguggggucaacagcgauacugugggaugguccuggcccgacggcgcagaguuaccguucacaauagauaaguga

SEQ ID NO: 139085 - RNA, 1410 nt, Artificial Sequence; identical to SEQ ID NO: 138744
  derived and/or modified sequence opt3 from neuraminidase__InfluenzaA__ACT36679

SEQ ID NO: 139086 - RNA, 1410 nt, Artificial Sequence; identical to SEQ ID NO: 138754
  derived and/or modified sequence opt3 from neuraminidase__InfluenzaA__ACT36680

SEQ ID NO: 139087 - RNA, 1410 nt, Artificial Sequence; identical to SEQ ID NO: 138744
  derived and/or modified sequence opt3 from neuraminidase__InfluenzaA__ACT36682

SEQ ID NO: 139088 - RNA, 1410 nt, Artificial Sequence; identical to SEQ ID NO: 138744
  derived and/or modified sequence opt3 from neuraminidase__InfluenzaA__ACT36683

SEQ ID NO: 139089 - RNA, 1410 nt, Artificial Sequence; identical to SEQ ID NO: 138754
  derived and/or modified sequence opt3 from neuraminidase__InfluenzaA__ACT36684

SEQ ID NO: 139090 - RNA, 1410 nt, Artificial Sequence; identical to SEQ ID NO: 138744
  derived and/or modified sequence opt3 from neuraminidase__InfluenzaA__ACT36685

SEQ ID NO: 139091 - RNA, 1410 nt, Artificial Sequence; identical to SEQ ID NO: 138744
  derived and/or modified sequence opt3 from neuraminidase__InfluenzaA__ACT36686

SEQ ID NO: 139092 - RNA, 1410 nt, Artificial Sequence; identical to SEQ ID NO: 138744
  derived and/or modified sequence opt3 from neuraminidase__InfluenzaA__ACT36687

SEQ ID NO: 139093 - RNA, 1410 nt, Artificial Sequence
  derived and/or modified sequence opt3 from neuraminidase__InfluenzaA__ACT36688
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuucggaucgaaaaggguaaaauugugaagucagucgagaugaacgcccccaauuaucauuacgaagagugcaguuguuacccugacagcuccgagaucacuugcguuugccgcgauaacuggcacgggucuaauagaccaugggugagcuucaaccagaaucucgaauaucagauuggauacauauguucaggcaucuuuggcgacaacccgaggcccaaugauaaaaccgggaguugcggaccuguauccagcaacggugcgaacggcgugaagggguucucuuauaaguacggaaauggcgucuggauuggucggacaaaaucaaucaguagccgcaacggguuugagaugaucugggacccaaauggcuggaccggaacggauaacaauuucuccauuaagcaagacauagugggcaucaacgaauggucuggguauucggggagcuuuguucagcaucccgagcugacuggucuggacuguauucgaccuugcuucuggguggaacucaucagaggcaggccaaaagagaauacaauuuggaccuccgggucaaguaucucuuucuguggagucaacagcgauacugugggcugguccuggcccgacggugcagaguuaccguuuacaauagauaaguga

SEQ ID NO: 139094 - RNA, 1410 nt, Artificial Sequence; identical to SEQ ID NO: 138744
  derived and/or modified sequence opt3 from neuraminidase__InfluenzaA__ACT36689

SEQ ID NO: 139095 - RNA, 1410 nt, Artificial Sequence; identical to SEQ ID NO: 138784
  derived and/or modified sequence opt3 from neuraminidase__InfluenzaA__ACT36690

SEQ ID NO: 139096 - RNA, 1410 nt, Artificial Sequence; identical to SEQ ID NO: 138744
  derived and/or modified sequence opt3 from neuraminidase__InfluenzaA__ACT36691

SEQ ID NO: 139097 - RNA, 1410 nt, Artificial Sequence; identical to SEQ ID NO: 138784
  derived and/or modified sequence opt3 from neuraminidase__InfluenzaA__ACT36693

SEQ ID NO: 139098 - RNA, 1410 nt, Artificial Sequence; identical to SEQ ID NO: 138754
  derived and/or modified sequence opt3 from neuraminidase__InfluenzaA__ACT36694

SEQ ID NO: 139099 - RNA, 1410 nt, Artificial Sequence; identical to SEQ ID NO: 138754
  derived and/or modified sequence opt3 from neuraminidase__InfluenzaA__ACT36695

SEQ ID NO: 139100 - RNA, 1410 nt, Artificial Sequence; identical to SEQ ID NO: 138754
  derived and/or modified sequence opt3 from neuraminidase__InfluenzaA__ACT52684

SEQ ID NO: 139101 - RNA, 1410 nt, Artificial Sequence; identical to SEQ ID NO: 138744
  derived and/or modified sequence opt3 from neuraminidase__InfluenzaA__ACT54608

SEQ ID NO: 139102 - RNA, 1410 nt, Artificial Sequence
  derived and/or modified sequence opt3 from neuraminidase__InfluenzaA__ACT66157
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucuaauggccaggcuuccuacaaaauccuccggauugaaaaggguaaaaucgugaagucaguggagaugaacgcccccaauuaucauuacgaagagugcaguuguuacccugacagcuccgagauuacuugcgucugccgcgauaacuggcacgggucuaauagaccauggguuagcuuuaaccagaaucuggaauaucagauaggauacaucuguucaggcauuuucggcgacaacccgaggcccaaugauaaaaccgggaguugcggaccuguguccagcaacggugcgaacggcguaaagggguuuucuuucaaguauggaaauggcguguggaucggucggacaaaaucaaucaguagccgcaacggguuugagaugauuugggacccaaauggcuggaccggaacggauaacaauuucuccauaaagcaagacaucgucggcauuaacgaauggucuggguacucggggagcuuugugcagcaucccgagcugacuggucucgacuguauccgaccuugcuucuggguugaauuaauuagaggcaggccaaaagagaauacaaucuggaccuccgggucaaguauaucuuucuguggagugaacagcgauacugucggcugguccuggcccgacggugcagagcugccguuuacaaucgauaaguga

SEQ ID NO: 139103 - RNA, 1410 nt, Artificial Sequence; identical to SEQ ID NO: 138754
  derived and/or modified sequence opt3 from neuraminidase__InfluenzaA__ACT67117

SEQ ID NO: 139104 - RNA, 1410 nt, Artificial Sequence; identical to SEQ ID NO: 138744
  derived and/or modified sequence opt3 from neuraminidase__InfluenzaA__ACT67121

SEQ ID NO: 139105 - RNA, 1410 nt, Artificial Sequence; identical to SEQ ID NO: 138754
  derived and/or modified sequence opt3 from neuraminidase__InfluenzaA__ACT67240

SEQ ID NO: 139106 - RNA, 1410 nt, Artificial Sequence; identical to SEQ ID NO: 138754
  derived and/or modified sequence opt3 from neuraminidase__InfluenzaA__ACT67241

SEQ ID NO: 139107 - RNA, 1410 nt, Artificial Sequence; identical to SEQ ID NO: 138754
  derived and/or modified sequence opt3 from neuraminidase__InfluenzaA__ACT67243

SEQ ID NO: 139108 - RNA, 1410 nt, Artificial Sequence
  derived and/or modified sequence opt3 from neuraminidase__InfluenzaA__ACT67256
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuauuacuacgaagagugcaguuguuauccugauagcuccgagauuacuugcgucugccgcgacaauuggcaugggucuaacagaccauggguuagcuucaaucagaaccucgaauaccagauaggauauaucuguucaggcauuuuuggcgauaauccgaggcccaacgacaaaaccgggaguugcggaccuguguccagcaauggugcgaacggcguaaagggguucucuuuuaaguacggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguauucggggagcuucgugcagcaccccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 139109 - RNA, 1410 nt, Artificial Sequence
  derived and/or modified sequence opt3 from neuraminidase__InfluenzaA__ACT68161
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaagcggggaguugcggaccuguguccagcaauggugcaaacggcguaaagggguucucuuuuaaguauggaaacggcguguggaucggucggaccaaaucaaucaguagccgcaauggguucgagaugauuugggauccaaacggcuggacaggaaccgacaauaacuuuuccauaaagcaagacaucgucggcauuaaugaauggucuggguacucggggagcuucgugcagcaucccgagcugacgggucuggauuguauccgaccuugcuucuggguugaacucauuagaggcaggccaaaagagaacacuaucuggacauccgggucaaguauaucuuuuuguggagugaauagcgacaccgucggcugguccuggcccgauggugccgaguuaccguucacuaucgacaaguga

SEQ ID NO: 139110 - RNA, 1410 nt, Artificial Sequence; identical to SEQ ID NO: 138744
  derived and/or modified sequence opt3 from neuraminidase__InfluenzaA__ACT68162

SEQ ID NO: 139111 - RNA, 1410 nt, Artificial Sequence; identical to SEQ ID NO: 138744
  derived and/or modified sequence opt3 from neuraminidase__InfluenzaA__ACT68163

SEQ ID NO: 139112 - RNA, 1410 nt, Artificial Sequence; identical to SEQ ID NO: 138744
  derived and/or modified sequence opt3 from neuraminidase__InfluenzaA__ACT68164

SEQ ID NO: 139113 - RNA, 1410 nt, Artificial Sequence; identical to SEQ ID NO: 138754
  derived and/or modified sequence opt3 from neuraminidase__InfluenzaA__ACT68166

SEQ ID NO: 139114 - RNA, 1410 nt, Artificial Sequence; identical to SEQ ID NO: 138754
  derived and/or modified sequence opt3 from neuraminidase__InfluenzaA__ACT68167

SEQ ID NO: 139115 - RNA, 1410 nt, Artificial Sequence; identical to SEQ ID NO: 138784
  derived and/or modified sequence opt3 from neuraminidase__InfluenzaA__ACT68168

SEQ ID NO: 139116 - RNA, 1410 nt, Artificial Sequence
  derived and/or modified sequence opt3 from neuraminidase__InfluenzaA__ACT68169
augaaccccaaucagaagaucauuaccauaggcagcgugugcaugacaaucgggauggccaaccugauucuccaaaucggaaauauuaucuccauauggaucucucacucaauucagcuuggugaccagaaccagaucgagacuuguaaucaaagugucauuacguacgaaaacaauaccuggguuaaccagacauaugugaauaucagcaacacuaauuucgcugcaggccaguccguagugucugucaaacuggccgggaacucgucauugugcccugugagcggaugggcgauauacaguaaggauaauuccauuagaaucggcucuaaaggugacguuuuugugauuagggagccauucaucagcuguuccccguuagaaugccggaccuuuuuccugacacagggggcucuacucaacgauaagcauucaaaugagaccaucaaagaccgcagucccuaucgaacucugaugagcuguccuauuggagaagucccaucucccuacaacucccguuuugagucaguggccuggagcgcaagugccugccacgauggcauaaacuggcuuacaaucggcauuucugggccugacaauggagcuguagcaguucugaaguauaacgguaucauaaccgauacgauuaaguccuggagaaauaacaucuugaggacucaagagagcgaaugugccugcgugaauggcucguguuucaccgucaugacagacgggccaucugauggacaggcuuccuacaaaaucuuucggauugagaagggcaaaaucgugaagucaguggaaaugaacgcccccaauuaucauuacgaggagugcaguuguuacccugacagcuccgaaauuacuugcgucugccgcgauaacuggcacgguucuaauagaccauggguuagcuucaaccagaaucucgaguaucagauaggguacaucuguucaggaauuuuuggcgacaacccgaggcccaaugauaaaaccggcaguugcgggccuguguccagcaacggagcgaaugguguaaagggcuucucuuuuaaguaugggaacggaguguggaucggccggacaaaaucaaucaguagccgcaacgguuucgaaaugauuugggacccaaauggguggaccggcacggacaacaauuuuuccauaaagcaagauaucgucggaauuucugaguggucgggcuacagcggguccuucgugcagcaucccgaacugacuggacuggacuguauccgaccuugcuucuggguugagcucauuagagguaggccaaaagagaacacaaucuggaccucaggcaguucuauauccuuuuguggggugaauagcgauacugucggauggucauggcccgacggcgcagaauuaccguucacaaucgauaaguga

SEQ ID NO: 139117 - RNA, 1410 nt, Artificial Sequence; identical to SEQ ID NO: 138744
  derived and/or modified sequence opt3 from neuraminidase__InfluenzaA__ACT68171

SEQ ID NO: 139118 - RNA, 1410 nt, Artificial Sequence; identical to SEQ ID NO: 138744
  derived and/or modified sequence opt3 from neuraminidase__InfluenzaA__ACT68172

SEQ ID NO: 139119 - RNA, 1410 nt, Artificial Sequence; identical to SEQ ID NO: 138754
  derived and/or modified sequence opt3 from neuraminidase__InfluenzaA__ACT68173

SEQ ID NO: 139120 - RNA, 1410 nt, Artificial Sequence; identical to SEQ ID NO: 138754
  derived and/or modified sequence opt3 from neuraminidase__InfluenzaA__ACT68174

SEQ ID NO: 139121 - RNA, 1410 nt, Artificial Sequence
  derived and/or modified sequence opt3 from neuraminidase__InfluenzaA__ACT68175
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuucggaucgaaaaggguaaaauugugaagucagucgagaugaacgcccccaauuaucauuacgaagagugcaguuguuacccugacagcggggagaucacuugcguuugccgcgauaacuggcacggauccaauagaccaugggugucuuucaaccagaaucucgaauaucagauuggcuacauauguagcggcaucuuuggggacaacccgaggcccaaugauaaaaccggaucaugcgguccuguaaguuccaacggcgcgaacggggugaagggauucagcuuuaaguauggcaauggugucuggauugggcggacaaaaucuaucucaagucgcaacggcuucgagaugaucugggacccaaauggauggaccggcacggauaacaauuuuagcauuaagcaagacauaguggggaucaacgaaugguccggauacucugguucguucguucagcaucccgagcugacuggccuggacuguauucgaccuugcuucuggguggaacucaucagagggaggccaaaagagaauacaauuuggaccagcggauccucaaucaguuuuuguggcgucaacucugauacuguggguuggagcuggcccgacggggcagaguuaccguucacaauagauaaguga

SEQ ID NO: 139122 - RNA, 1410 nt, Artificial Sequence; identical to SEQ ID NO: 138754
  derived and/or modified sequence opt3 from neuraminidase__InfluenzaA__ACT68176

SEQ ID NO: 139123 - RNA, 1410 nt, Artificial Sequence; identical to SEQ ID NO: 138754
  derived and/or modified sequence opt3 from neuraminidase__InfluenzaA__ACT68177

SEQ ID NO: 139124 - RNA, 1410 nt, Artificial Sequence; identical to SEQ ID NO: 138754
  derived and/or modified sequence opt3 from neuraminidase__InfluenzaA__ACT68178

SEQ ID NO: 139125 - RNA, 1410 nt, Artificial Sequence; identical to SEQ ID NO: 139121
  derived and/or modified sequence opt3 from neuraminidase__InfluenzaA__ACT68179

SEQ ID NO: 139126 - RNA, 1410 nt, Artificial Sequence; identical to SEQ ID NO: 138754
  derived and/or modified sequence opt3 from neuraminidase__InfluenzaA__ACT68180

SEQ ID NO: 139127 - RNA, 1410 nt, Artificial Sequence; identical to SEQ ID NO: 138784
  derived and/or modified sequence opt3 from neuraminidase__InfluenzaA__ACT79145

SEQ ID NO: 139128 - RNA, 1410 nt, Artificial Sequence
  derived and/or modified sequence opt3 from neuraminidase__InfluenzaA__ACT79155
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaacucgucauugugcccugugggaggcugggcgauauacagcaaggacaauaguguuagaauugguuccaaaggggauguguuugucaucagggagccauucauuucuuguagcuuacuggaaugccggaccuuuuuccuaacacagggagcucuccugaaugacaagcauuccaacggcaccaucaaagaucgcucaccguaucgaacucuuaugaguugucccaucggcgaggugccuagcccauacaacucucguuuugaauccguagccuggucagcaagcgccugccacgacgggauuaauuggcugacaauaggaaucaguggucccgauaacggcgcuguugcaguguugaaguauaaugggauuaucaccgacacgauaaagucuuggagaaacaauauucucaggacucaagaguccgagugugccugcgucaacggaagcuguuucaccgugaugacagauggcccuucgaauggucaggcuucuuacaaaaucuuucggaucgaaaaggggaaaauugugaaguccgucgagaugaacgccccaaauuaucauuacgaagagugcucauguuaccccgacaguagcgagaucacuugcguuugccgcgauaacuggcacggauccaauagaccuugggugucuuucaaccagaaucuggaauaucagauuggcuacauauguagcggcaucuuuggggacaacccaaggccgaaugauaaaaccggaucaugcggucccguaaguuccaacggcgcgaacggggugaagggauucagcuuuaaguauggcaauggugucuggauugggcggacaaaaucuaucucaagucgcaacggcuucgagaugaucugggacccuaauggauggaccggcacggauaacaauuuuagcauuaagcaagacauaguggggaucaacgaaugguccggauacucugguucguucguucagcauccagagcugacuggccucgacuguauucgacccugcuucuggguggaauuaaucagagggaggccuaaagagaauacaauuuggaccagcggauccucaaucaguuuuuguggcgucaacucugauacuguggguuggagcuggccagacggggcagagcugcccuucacaauagauaaguga

SEQ ID NO: 139129 - RNA, 1410 nt, Artificial Sequence; identical to SEQ ID NO: 138744
  derived and/or modified sequence opt3 from neuraminidase__InfluenzaA__ACT79165

SEQ ID NO: 139130 - RNA, 1410 nt, Artificial Sequence; identical to SEQ ID NO: 138744
  derived and/or modified sequence opt3 from neuraminidase__InfluenzaA__ACT79175

SEQ ID NO: 139131 - RNA, 1410 nt, Artificial Sequence; identical to SEQ ID NO: 138754
  derived and/or modified sequence opt3 from neuraminidase__InfluenzaA__ACT79185

SEQ ID NO: 139132 - RNA, 1410 nt, Artificial Sequence; identical to SEQ ID NO: 138754
  derived and/or modified sequence opt3 from neuraminidase__InfluenzaA__ACT79622

SEQ ID NO: 139133 - RNA, 1410 nt, Artificial Sequence; identical to SEQ ID NO: 139121
  derived and/or modified sequence opt3 from neuraminidase__InfluenzaA__ACT79630

SEQ ID NO: 139134 - RNA, 1410 nt, Artificial Sequence; identical to SEQ ID NO: 138754
  derived and/or modified sequence opt3 from neuraminidase__InfluenzaA__ACT83798

SEQ ID NO: 139135 - RNA, 1410 nt, Artificial Sequence; identical to SEQ ID NO: 138754
  derived and/or modified sequence opt3 from neuraminidase__InfluenzaA__ACT83808

SEQ ID NO: 139136 - RNA, 1410 nt, Artificial Sequence; identical to SEQ ID NO: 138754
  derived and/or modified sequence opt3 from neuraminidase__InfluenzaA__ACT83818

SEQ ID NO: 139137 - RNA, 1410 nt, Artificial Sequence; identical to SEQ ID NO: 138754
  derived and/or modified sequence opt3 from neuraminidase__InfluenzaA__ACT83828

SEQ ID NO: 139138 - RNA, 1410 nt, Artificial Sequence; identical to SEQ ID NO: 138754
  derived and/or modified sequence opt3 from neuraminidase__InfluenzaA__ACT83838

SEQ ID NO: 139139 - RNA, 1410 nt, Artificial Sequence; identical to SEQ ID NO: 138744
  derived and/or modified sequence opt3 from neuraminidase__InfluenzaA__ACT83848

SEQ ID NO: 139140 - RNA, 1410 nt, Artificial Sequence; identical to SEQ ID NO: 138744
  derived and/or modified sequence opt3 from neuraminidase__InfluenzaA__ACT83858

SEQ ID NO: 139141 - RNA, 1410 nt, Artificial Sequence; identical to SEQ ID NO: 138754
  derived and/or modified sequence opt3 from neuraminidase__InfluenzaA__ACT83868

SEQ ID NO: 139142 - RNA, 1410 nt, Artificial Sequence; identical to SEQ ID NO: 138754
  derived and/or modified sequence opt3 from neuraminidase__InfluenzaA__ACT83878

SEQ ID NO: 139143 - RNA, 1410 nt, Artificial Sequence; identical to SEQ ID NO: 138754
  derived and/or modified sequence opt3 from neuraminidase__InfluenzaA__ACT86002

SEQ ID NO: 139144 - RNA, 1410 nt, Artificial Sequence; identical to SEQ ID NO: 138754
  derived and/or modified sequence opt3 from neuraminidase__InfluenzaA__ACT86012

SEQ ID NO: 139145 - RNA, 1410 nt, Artificial Sequence; identical to SEQ ID NO: 138754
  derived and/or modified sequence opt3 from neuraminidase__InfluenzaA__ACT86022

SEQ ID NO: 139146 - RNA, 1410 nt, Artificial Sequence; identical to SEQ ID NO: 138744
  derived and/or modified sequence opt3 from neuraminidase__InfluenzaA__ACT86032

SEQ ID NO: 139147 - RNA, 1410 nt, Artificial Sequence; identical to SEQ ID NO: 138754
  derived and/or modified sequence opt3 from neuraminidase__InfluenzaA__ACT86042

SEQ ID NO: 139148 - RNA, 1410 nt, Artificial Sequence; identical to SEQ ID NO: 138754
  derived and/or modified sequence opt3 from neuraminidase__InfluenzaA__ACT86052

SEQ ID NO: 139149 - RNA, 1410 nt, Artificial Sequence; identical to SEQ ID NO: 138754
  derived and/or modified sequence opt3 from neuraminidase__InfluenzaA__ACT86062

SEQ ID NO: 139150 - RNA, 1410 nt, Artificial Sequence; identical to SEQ ID NO: 138754
  derived and/or modified sequence opt3 from neuraminidase__InfluenzaA__ACT86072

SEQ ID NO: 139151 - RNA, 1410 nt, Artificial Sequence; identical to SEQ ID NO: 138754
  derived and/or modified sequence opt3 from neuraminidase__InfluenzaA__ACT86082

SEQ ID NO: 139152 - RNA, 1410 nt, Artificial Sequence; identical to SEQ ID NO: 138754
  derived and/or modified sequence opt3 from neuraminidase__InfluenzaA__ACT86092

SEQ ID NO: 139153 - RNA, 1410 nt, Artificial Sequence; identical to SEQ ID NO: 138754
  derived and/or modified sequence opt3 from neuraminidase__InfluenzaA__ACT86102

SEQ ID NO: 139154 - RNA, 1410 nt, Artificial Sequence; identical to SEQ ID NO: 138754
  derived and/or modified sequence opt3 from neuraminidase__InfluenzaA__ACT86112

SEQ ID NO: 139155 - RNA, 1410 nt, Artificial Sequence; identical to SEQ ID NO: 138754
  derived and/or modified sequence opt3 from neuraminidase__InfluenzaA__ACT86122

SEQ ID NO: 139156 - RNA, 1410 nt, Artificial Sequence; identical to SEQ ID NO: 138754
  derived and/or modified sequence opt3 from neuraminidase__InfluenzaA__ACT86132

SEQ ID NO: 139157 - RNA, 1410 nt, Artificial Sequence; identical to SEQ ID NO: 138754
  derived and/or modified sequence opt3 from neuraminidase__InfluenzaA__ACT86142

SEQ ID NO: 139158 - RNA, 1410 nt, Artificial Sequence; identical to SEQ ID NO: 138744
  derived and/or modified sequence opt3 from neuraminidase__InfluenzaA__ACT97323

SEQ ID NO: 139159 - RNA, 1410 nt, Artificial Sequence; identical to SEQ ID NO: 138754
  derived and/or modified sequence opt3 from neuraminidase__InfluenzaA__ACU00934

SEQ ID NO: 139160 - RNA, 1410 nt, Artificial Sequence; identical to SEQ ID NO: 138754
  derived and/or modified sequence opt3 from neuraminidase__InfluenzaA__ACU00944

SEQ ID NO: 139161 - RNA, 1410 nt, Artificial Sequence; identical to SEQ ID NO: 139108
  derived and/or modified sequence opt3 from neuraminidase__InfluenzaA__ACU00954

SEQ ID NO: 139162 - RNA, 1410 nt, Artificial Sequence
  derived and/or modified sequence opt3 from neuraminidase__InfluenzaA__ACU12497
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugaugccgugcgaacccacuaucauagagagaaauaucaccgaaauuguauauuugacaaacaccacuaucgagagggaaauuuguccuaaguuaguggaguaccggaauuggucaaaaccacagugccgcgucacaggguucgcacccuuuaguaaggacaacagcauccgacuguccgccggaggugauauaugggugacccgugagccuuauguuucuugugacccaggcaaaugcuaccaauucgcgcuagggcagggaacgacucucaauaacagacauucgaaugauaccgugcacgacaggacacccuaucggacucugcuuaugaacgaacugggcgucccuuuucauuuggguaccaaacagguguguauugcuuggucaagcaguuccugccacgaugggaaggccuggcuccauguauguguuacaggacacgacgagaaugcaaccgccucuuucaucuacgauggccgccugguggacagcauugucuccuggucaaagaacauccugagaacgcaggaaagugagugcguguguaucaauggcacuugcacaguggucaugaccgaugggagcgcuucugagagggcagacacuaagauucucuuuauagaagagggaaaaaucguucacauuuccccauuaucagguagcgcccaacauguggaagagugcaguuguuauccgcgguaccccggcguacgcugcgugugucgagauaacuggaaggggucuaacagaccuaucgucgacauaaaugugaaagauuacuccauuguuagcucguaugugugcucuggacuggucggcgacacaccaaggaagaacgacuccucaaguagcuccuacugucggaaucccaacaaugaaaaggguucucacggggugaaaggaugggcuuucgaugacggcaacgauguauggaugggccguaccaucggggaggagcuucgcagcggauaugaaacguuuaagguuaucgguggcuggucaaccccuaauaguaaauugcagacaaacagacaggugauugucgacagggggaaucgguccggauacagcggcaucuucucuguggaggguaagucaugcauuaaccgauguuuuuaugucgaacugauacgcgggagaaaacaggagacuaaggugugguggaccaguaauagcaucguuguguucugcggcacauccggaacuuacggcaccgggucuuggccagauggagccgacauuaaccuaaugcccaucuga

SEQ ID NO: 139163 - RNA, 1413 nt, Artificial Sequence; identical to SEQ ID NO: 138648
  derived and/or modified sequence opt3 from neuraminidase__InfluenzaA__ACU12508

SEQ ID NO: 139164 - RNA, 1410 nt, Artificial Sequence
  derived and/or modified sequence opt3 from neuraminidase__InfluenzaA__ACU12519
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcaucacaggggaugacgagaacgcaaccgccagcuucaucuacaauggaagacugguggauuccguaguuucauggaguaagaaaauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccggucauugccuugacccuaacaaugaggaagggggacacggcguuaaaggcugggcuuucgaugacgggaacgauguguggaugggacgcaccauuucugagaaguugcgaagcgguuacgagacauuuaaagucaucgaaggcuggucaaauccaaacaguaagcugcagauuaauagacaggugauaguagacagggggaaccgguccggauauagcggcaucuucucuguugaggguaaaucauguauuaaucguugcuuuuacguggaacuaauccgcgggagaaaccaggagacugaaguccucuggaccaguaauagcaucguggucuucuguggcacauccggaacuuauggcaccgggucuuggcccgauggagccgacauuaaccugaugccuauauga

SEQ ID NO: 139165 - RNA, 1410 nt, Artificial Sequence
  derived and/or modified sequence opt3 from neuraminidase__InfluenzaA__ACU12530
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacagggaacgauaagaaugcaaccgccagcuucaucuacaacggaagacugguagacuccaucguuucauggaguaaagagauucugaggacgcaggaaagcgagugugugugcauaaacggcacuuguacagucgugaugaccgauggcucugcuuccgggaaggcagacacuaaaauccucuuuauugaggaaggaaagaucgugcacacaucaaccuuaagcgguagugcccaacacgucgaggaaugcucuugcuauccucgguacccaggcguucgcugugugugcagagauaauuggaagggguccaacaggccgauaguagacauuaauaucaaagauuacagcaucgugucgucuuaugucuguuccggacuggugggcgacacgccccggaagaacgacucaaguagcuccucucauugccuugauccuaauaacgaggaaggugggcacggaguuaaaggcugggcuuucgacgauggcaaugacguguggauggggcgcaccauuagcgagaaguugcgaucaggauacgagacauuuaaagucaucgaagguuggaguaacccaaauuccaagcugcagauuaacagacaggugauaguagauaggggcaaucggagcggguauucuggaaucuucucaguugagggcaaaaguuguauuaaccguugcuuuuacguggaacuaauccgcgguagaaaggaggaaacugagguccucuggaccagcaauuccaucguggucuucugugggacaucuggcacuuauggaaccggcucguggcccgacggggccgauauuaaccugaugccuauauga

SEQ ID NO: 139166 - RNA, 1410 nt, Artificial Sequence
  derived and/or modified sequence opt3 from neuraminidase__InfluenzaA__ACU12541
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgucuuaugucuguuccggacuggugggcgacacgccccggaagaaugauucaaguagcuccucucauugccuugacccuaacaaugaggaaggugggcacggaguuaaaggcugggcuuucgaugacggcaacgauguguggauggggcgcaccauuagcgagaaguugcgaucaggauacgagacauuuaaagucaucgaagguuggaguaauccaaacuccaaguggcagauuaauagacaggugauaguagacaggggcaaccggagcggguauucuggaaucuucucaguugagggcaaaaguuguauuaaucguugcuuuuacguggaacugauccgcgguagaaaggaggaaacugagguccuauggaccagcaacuccaucguggucuucugugggacaucuggcacuuauggaaccggcucguggcccgauggggccgacauuaaucucaugccuauauga

SEQ ID NO: 139167 - RNA, 1410 nt, Artificial Sequence
  derived and/or modified sequence opt3 from neuraminidase__InfluenzaA__ACU12552
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucaguguaacauaacaggguucgcaccauuuagcaaagacaauuccauucggcugucugccggaggugauaucuggguaacccgcgagcccuaugugucgugcgacccugauaaguguuaccaauucgcgcuaggccaggggacgacucucaacaauguccauucaaacgacaccgugcacgaucgaacaccauaucguacucugcuuaugaaugaacugggaguucccuuucauuugggcaccaaacaggugugcauugcuuggagcaguuccucuugucacgacgguaaggccuggcuccaugucugcgugacaggggaugacaagaacgcaaccgccagcuucaucuacaauggaagacugguagauuccaucguuucauggaguaaagagauucugaggacgcaggaaagcgagugugugugcauaaacggcacuuguacagucgugaugaccgacggcucugcuuccgggaaggcagauacuaaaauccucuuuauugaggaaggaaagaucgugcacacaucaaccuuaagcgguagugcccaacacgucgaggaaugcucuugcuauccucgguacccaggcguucgcugugugugcagagacaacuggaagggguccaauaggccgauaguagauauuaacaucaaagacuacagcaucgugucgggauaugucuguucuggccuggugggugacacgccccggaagaaugauuccucaaguagcucccauugcucugacccuaacaaugaggaagggggacacggcguuaaaggcugggcuuucgaugacgggaacgauguguggaugggacgcaccauuagcgagaaacuucgaucagguuacgagacauuuaaggucaucgaaggcuggaguaauccaaacuccaaguugcagauuaauagacaggugauaguagacagggggaaccggagcggauauucuggcaucuucucaguugaggguaaaaguuguauuaaucguugcuuuuacguggaacugauccgcgggagaaaggaggaaacugagguccuauggaccagcaacuccaucguggucuucuguggcacaucuggaacuuauggcaccgggucguggcccgauggagccgacauuaaucucaugccuauauga

SEQ ID NO: 139168 - RNA, 1413 nt, Artificial Sequence
  derived and/or modified sequence opt3 from neuraminidase__InfluenzaA__ACU12574
augaaccccaaucagaagaucauuaccauaggcagcaucuccauugccaucgggauuaucaaccugaugcuccaaauaggaaauaucauuucuaucugggcuucacacaguauucagacagguagccagaacaauacuggcaucugcaaccagagaauaauuacguacgaaaauuccaccugggugaaccauacauaugucaauaucaacaauacuaacguuguggcaggggaggacaaaaccucuguaacacuugccggaaauucgucacuguguagcauuaguggcugggcgaucuacaccaaggauaacuccaucaggauugguucuaaaggggacguguucgucauacgggagccuuuuaucagcugcucccacuuggaaugucgcacuuucuuuuuaacacaaggagcucugcuaaaugauaagcauucaaacggcaccgugaaagaccgaaguccauaucgugcccucaugagcugcccgcugggcgaggcacccucuccuuacaacuccaaguucgaaucaguugccuggagcgcuagugcaugucacgaugggaugggauggcuuacgauugguaucucuggcccagacaauggggccguggcuguccugaaguauaacggaauaauuacuggcaccaucaaauccuggaagaaacagaucuugagaacacaggagagcgagugcguguguaugaaugguucgugcuuuacuauuaugaccgaugggcccucuaacaaggccgcguccuacaaaaucuucaagauugaaaagggaaaaguaacaaagucaauagagcucaaugcaccuaacuuuuauuacgaagaguguaguugcuacccagacaccggcaucguuaugugugugugcagggauaauuggcauggcagcaaccggcccugggucuccuucaaucagaaccuggacuaucaaauuggguacaucugcucuggaguguuuggugauaauccucgcccagaggacggcgaagggagcuguaacccggugacggucgauggagccaauggcguuaaagguuucucauauaaguacgacaacgggguguggaucggcagaacuaaaaguaauaggcugcggaagggauuugagaugauuugggaccccaacggcuggacaaacaccgauuccgacuucagcguaaaacaggauguggucgcuauaacugacuggucuggguauucaggaaguuuugugcagcacccugaacucacagguuuagauugcauccgcccauguuucuggguugagcuggugcgaggccuucccagagaaaauaccacgauuuggaccagcggguccucuaucucguucugcggagucaacagcgacacagccaauugguccuggccugauggcgcagaguugccauuuacuauugacaaguga

SEQ ID NO: 139169 - RNA, 1413 nt, Artificial Sequence; identical to SEQ ID NO: 138648
  derived and/or modified sequence opt3 from neuraminidase__InfluenzaA__ACU12585

SEQ ID NO: 139170 - RNA, 1413 nt, Artificial Sequence
  derived and/or modified sequence opt3 from neuraminidase__InfluenzaA__ACU12596
augaaccccaaucagaagaucauuaccauaggcagcaucuccauugccaucgggauuaucucucugaugcuccaaauaggaucaaucauuaguaucugggcuagccacuccauuagaacagguucucagaacaauacuggcaucugcaaccagaggauaauuacguacgagaauagcaccugggugaaccauacauaugucaauaucaacaauacuaacguuguggcaggggaagacaaaaagucaguaacccuugccggaaauagcagucuguguuccauuucuggcugggcgaucuacacaaaagauaacagcauccggauugguuccaagggggacguguucgucauacgcgagccuuuuaucucaugcagucacuuggaaugucgaaccuucuuuuuaacucagggagcucugcuaaaugauaaacauagcaacggcacagugaaggaccguucuccauauagagcccucauguccugcccgcugggcgaggcacccucaccuuacaauagcaaguucgaaaguguugccuggucugcuuccgcaugucacgaugggaugggauggcuuaccauugguaucagcggcccagacaacggggccguggcuguccugaaauauaacggaauaauuacgggcacuaucaagucguggaaaaagcaaaucuugaggacccaggagucugagugcguguguaugaaugguuccugcuuuacaauuaugacugaugggcccucaaacaaagccgcgaguuacaagaucuucaagauugaaaaaggaaagguaaccaaaagcauagagcucaaugcaccuaacuuuuauuacgaagaguguuccugcuacccagacacaggcaucguuaugugugugugccgggauaauuggcauggcucuaaccgccccugggucagcuucaaucagaaccuggacuaucagauuggguacaucugcucaggaguguuuggugauaauccuagaccagaggacggcgaagggaguuguaacccggugaccgucgauggagccaauggcguuaaggguuucuccuauaaauacgggaacggcguguggaucggaaggacgaagucgaaucggcugcgcaaaggcuuugagaugauuugggaccccaacggguggacuaauacagacucugauuucucaguaaagcaagacguggucgcuauaaccgauuggaguggauauagcgguuccuuugugcagcacccugaacucacuggcuuagacugcauccgaccauguuucuggguugagcuggugagagggcuucccagggaaaacacaaccauuuggacgucuggaucgagcaucuccuucugcggcgucaacucagauaccgccaauuggaguuggccugacggugcagaguugccauuuacaauugauaaguga

SEQ ID NO: 139171 - RNA, 1410 nt, Artificial Sequence; identical to SEQ ID NO: 138754
  derived and/or modified sequence opt3 from neuraminidase__InfluenzaA__ACU13077

SEQ ID NO: 139172 - RNA, 1410 nt, Artificial Sequence; identical to SEQ ID NO: 138754
  derived and/or modified sequence opt3 from neuraminidase__InfluenzaA__ACU13078

SEQ ID NO: 139173 - RNA, 1410 nt, Artificial Sequence; identical to SEQ ID NO: 138754
  derived and/or modified sequence opt3 from neuraminidase__InfluenzaA__ACU13079

SEQ ID NO: 139174 - RNA, 1410 nt, Artificial Sequence; identical to SEQ ID NO: 138754
  derived and/or modified sequence opt3 from neuraminidase__InfluenzaA__ACU13080

SEQ ID NO: 139175 - RNA, 1410 nt, Artificial Sequence; identical to SEQ ID NO: 138744
  derived and/or modified sequence opt3 from neuraminidase__InfluenzaA__ACU13081

SEQ ID NO: 139176 - RNA, 1410 nt, Artificial Sequence; identical to SEQ ID NO: 138754
  derived and/or modified sequence opt3 from neuraminidase__InfluenzaA__ACU13082

SEQ ID NO: 139177 - RNA, 1410 nt, Artificial Sequence; identical to SEQ ID NO: 138754
  derived and/or modified sequence opt3 from neuraminidase__InfluenzaA__ACU13083

SEQ ID NO: 139178 - RNA, 1410 nt, Artificial Sequence
  derived and/or modified sequence opt3 from neuraminidase__InfluenzaA__ACU13084
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucuaugaaacuggccggaaauucgucauugugcccugucgggggcugggcgauauacagcaaggacaacagugugagaauugguuccaaaggggauguuuuugugaucagggagccauucauuucuuguagcccguuagaaugccggaccuuuuuccugacacagggagcucuacucaaugacaagcauuccaacggcaccaucaaagaucgcucacccuaucgaacucugaugaguuguccuaucggcgaggucccaagccccuacaacucucguuuugaauccguggccuggucagcaagcgccugccacgacgggauuaauuggcuuacaauaggaaucagugguccugauaacggcgcuguagcaguucugaaguauaaugggauuaucaccgacacgauaaagucuuggagaaacaauauuuugaggacucaagaguccgagugugccugcgugaacggaagcuguuucaccgucaugacagauggcccaucgaauggucaggcuucuuacaaaaucuuucggaucgaaaaggggaaaauugugaaguccguggagaugaacgcccccaauuaucauuacgaagagugcucauguuacccugacaguagcgagaucacuugcgucugccgcgauaacuggcacggauccaauagaccauggguuucuuucaaccagaaucucgaauaucagauuggcuacauauguagcggcaucuuuggggacaacccgaggcccaaugauaaaaccggaucaugcgguccugugaguuccaacggcgcgaacgggguaaagggauucagcuuuaaguauggcaaugguguguggauugggcggacaaaaucuaucucaagucgcaacggcuucgagaugaucugggacccaaauggauggaccggcacggauaacaauuuuagcauuaagcaagacauagucgggaucaacgaaugguccggauacucugguucguucgugcagcaucccgagcugacuggccuggacuguauucgaccuugcuucuggguugaacucaucagagggaggccaaaagagaauacaauuuggaccagcggauccucaaucaguuuuuguggcgugaacucugauacugucgguuggagcuggcccgacggggcagaguuaccguucacaauagauaaguga

SEQ ID NO: 139179 - RNA, 1410 nt, Artificial Sequence; identical to SEQ ID NO: 138754
  derived and/or modified sequence opt3 from neuraminidase__InfluenzaA__ACU16799

SEQ ID NO: 139180 - RNA, 1410 nt, Artificial Sequence; identical to SEQ ID NO: 138754
  derived and/or modified sequence opt3 from neuraminidase__InfluenzaA__ACU16861

SEQ ID NO: 139181 - RNA, 1410 nt, Artificial Sequence; identical to SEQ ID NO: 138754
  derived and/or modified sequence opt3 from neuraminidase__InfluenzaA__ACU16934

SEQ ID NO: 139182 - RNA, 1410 nt, Artificial Sequence; identical to SEQ ID NO: 138754
  derived and/or modified sequence opt3 from neuraminidase__InfluenzaA__ACU16997

SEQ ID NO: 139183 - RNA, 1410 nt, Artificial Sequence; identical to SEQ ID NO: 138754
  derived and/or modified sequence opt3 from neuraminidase__InfluenzaA__ACU17130

SEQ ID NO: 139184 - RNA, 1410 nt, Artificial Sequence; identical to SEQ ID NO: 138754
  derived and/or modified sequence opt3 from neuraminidase__InfluenzaA__ACU17191

SEQ ID NO: 139185 - RNA, 1410 nt, Artificial Sequence
  derived and/or modified sequence opt3 from neuraminidase__InfluenzaA__ACU17262
augaaccccaaucagaagaucauuaccauaggcagcgugugcaugacaaucgggauggccaaccugauucuccaaaucggaaauauuaucuccauauggaucucucacucaauucagcuugguaaccagagucagaucgagacuuguaaucaaagcgucauuacguacgaaaacaauaccuggguuaaccagacauaugugaauaucuccaacacuaauuucgcugcaggccagucuguagugucggucaaacuggccgggaacagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccgucaugacagauggaccauccgacggccaggcuucauacaaaaucuuucggauugaaaaggguaaaaucgugaagaguguggagaugaacgcccccaauuaucauuacgaagagugcagcuguuacccugauuccucugagauuacuugcgucugccgcgacaacuggcacgggagcaauagaccauggguuucauucaaccagaaucucgaauaucagauaggauacaucuguaguggcauuuuuggcgauaacccgaggcccaaugacaaaaccggguccugcggaccugugagcucuaacggugcgaauggcguaaagggguucucauuuaaguauggaaacggcguguggaucggucggacaaaaaguaucagcucccgcaacggguucgagaugauuugggauccaaauggcuggaccggaacggacaacaauuuuucuauaaagcaagacaucgucggcauuaacgaauggucgggguacagcggauccuucgugcagcaucccgagcugacuggucuggauuguauccgaccuugcuucuggguugaacucauuagaggcaggccaaaagagaauacaaucuggaccucagggaguucuauaucauuuuguggagugaacuccgacacugucggcuggucauggcccgauggugcagaguuaccguucacaaucgacaaguga

SEQ ID NO: 139186 - RNA, 1410 nt, Artificial Sequence; identical to SEQ ID NO: 138754
  derived and/or modified sequence opt3 from neuraminidase__InfluenzaA__ACU17325

SEQ ID NO: 139187 - RNA, 1410 nt, Artificial Sequence; identical to SEQ ID NO: 138754
  derived and/or modified sequence opt3 from neuraminidase__InfluenzaA__ACU17393

SEQ ID NO: 139188 - RNA, 1410 nt, Artificial Sequence; identical to SEQ ID NO: 138754
  derived and/or modified sequence opt3 from neuraminidase__InfluenzaA__ACU17454

SEQ ID NO: 139189 - RNA, 1410 nt, Artificial Sequence; identical to SEQ ID NO: 138754
  derived and/or modified sequence opt3 from neuraminidase__InfluenzaA__ACU17524

SEQ ID NO: 139190 - RNA, 1410 nt, Artificial Sequence; identical to SEQ ID NO: 139108
  derived and/or modified sequence opt3 from neuraminidase__InfluenzaA__ACU27043

SEQ ID NO: 139191 - RNA, 1413 nt, Artificial Sequence
  derived and/or modified sequence opt3 from neuraminidase__InfluenzaA__ACU27415
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacauucgccggaaacucaagccuuuguaguauuuccggcugggcgaucuacaccaaggauaauucuaucaggauugguagcaaaggggacguguuugucauacgggagccuuucaucuccugcucacaccuggaaugucgcacauuuuucuugacucaaggagcuuuacugaacgauaagcauaguaauggcaccgugaaagaccgaagcccauaucgugcccuaaugucuugcccgcucggcgaggcacccuccccuuacaacucaaaguuugaaagcguugccuggagugcuucugcaugucacgaugggaugggauggcugacgauugguaucuccggcccagacaacggggccguggcuguccuuaaguauaauggaauaauuacuggcaccaucaaaagcuggaagaaacagauccugagaacacaggagucggagugcguguguaugaacgguucuugcuucacuauuaugaccgaugggcccuccaauaaggccgcgucauacaaaaucuuuaagauugaaaagggaaaaguaacaaagaguauagaguugaacgcaccuaauuucuauuacgaagaguguagcugcuacccagacaccggcaucguuaugugugugugcagggauaacuggcauggcuccaaucggcccugggucucuuuuaaccagaaucucgacuaucaaauuggguacaucugcagcggaguguucggugauaacccucgcccagaggacggcgaagggucauguaauccggugacggucgauggagccaacggcguuaaagguuuuaguuauaaguacgggaauggcguguggaucggaagaacuaaauccaacaggcugcggaagggcuucgagaugauuugggaccccaauggguggacaaacaccgacagcgauuuuucuguaaaacaggacguggucgcuauaacugauuggucaggauauagugguagcuucgugcagcacccugaacugacaggccucgacugcauccgcccauguuucuggguugaguuagugcgagggcugcccagagaaaacaccacgauuuggaccuccggaucuucgaucagcuuuugcggcgucaauuccgauacagccaacuggucauggccugacggugcagagcuuccauucacuauugauaaguga

SEQ ID NO: 139192 - RNA, 1413 nt, Artificial Sequence; identical to SEQ ID NO: 139191
  derived and/or modified sequence opt3 from neuraminidase__InfluenzaA__ACU27416

SEQ ID NO: 139193 - RNA, 1410 nt, Artificial Sequence; identical to SEQ ID NO: 138744
  derived and/or modified sequence opt3 from neuraminidase__InfluenzaA__ACU29961

SEQ ID NO: 139194 - RNA, 1410 nt, Artificial Sequence
  derived and/or modified sequence opt3 from neuraminidase__InfluenzaA__ACU29971
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuucggaucgaaaaggguaaaauugugaagucagucgagaugaacgcccccaauuaucauuacgaagagugcaguuguuacccugacagcuccgagaucacuugcguuugccgcgauaacuggcacgggucuaauagaccaugggugagcuucaaccagaaucucgaauaucagauuggauacauauguucaggcaucuuuggcgacaacccgaggcccaaugauaaaaccgggaguugcggaccuguauccagcaacggugcgaacggcgugaagggguucucuuuuaaguauggaaauggcgucuggauuggucggacaaaaucaaucaguagccgcaacggguucgagaugaucugggacccaaauggcuggaccggaacggauaacaauuuuuccauuaagcaagacauagugggcaucaacgaauggucuggguacucggggagcuucguucagcaucccgagcugacuggucuggacuguauucgaccuugcuucuggguggaacucaucagaggcaggccaaaagagaauacaauuuggaccuccgggucaaguaucucuuuuuguggagucaacagcgauacugugggcugguccuggucagacggugcagaguuacccuucacaauagauaaguga

SEQ ID NO: 139195 - RNA, 1410 nt, Artificial Sequence; identical to SEQ ID NO: 138754
  derived and/or modified sequence opt3 from neuraminidase__InfluenzaA__ACU29981

SEQ ID NO: 139196 - RNA, 1410 nt, Artificial Sequence; identical to SEQ ID NO: 138754
  derived and/or modified sequence opt3 from neuraminidase__InfluenzaA__ACU29991

SEQ ID NO: 139197 - RNA, 1410 nt, Artificial Sequence; identical to SEQ ID NO: 138754
  derived and/or modified sequence opt3 from neuraminidase__InfluenzaA__ACU30001

SEQ ID NO: 139198 - RNA, 1410 nt, Artificial Sequence; identical to SEQ ID NO: 138754
  derived and/or modified sequence opt3 from neuraminidase__InfluenzaA__ACU30021

SEQ ID NO: 139199 - RNA, 1410 nt, Artificial Sequence
  derived and/or modified sequence opt3 from neuraminidase__InfluenzaA__ACU30085
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacugaugggaaauucgucauugugcccugugagcggaugggccauauacaguaaggacaacuccguuagaauuggcucuaaaggugauguguuugucaucagggagccauucauuagcuguuccccguuagaaugccggaccuuuuuccugacacagggggcgcuacucaaugacaagcauucaaacggaaccaucaaagaucgcagucccuaucgaacucugaugagcuguccuaucggcgaggugccaucucccuacaacucccguuuugaaucaguagcuuggagcgccagugcaugccacgacggcauuaauuggcuuacaauagggaucucuggaccugauaacggugccguugcugugcugaaguauaauggcauuaucaccgacacgauaaaguccuggagaaacaauauuuugaggacucaagagagcgagugugcaugcgucaacgggucguguuucaccgugaugacagauggaccaucuaauggccaggccuccuacaaaaucuuucggaucgaaaaggguaaaauugugaagucagucgagaugaacgcucccaauuaucauuacgaagagugcaguuguuacccugacagcuccgagaucacuugcguuugccgcgauaacuggcacgggucuaauagaccaugggugagcuucaaccagaaucucgaauaucagauuggauacauauguucaggcaucuuuggcgacaacccgaggcccaaugauaaaaccgggaguugcggaccuguauccagcaacggugccaacggcgugaagggguucucuuuuaaguauggaaauggcgucuggauuggucggacaaaaucaaucaguagccgcaacggguucgagaugaucugggacccaaauggcuggaccggaacggauaacaauuuuuccauuaagcaagacauagugggcaucaacgaauggucuggguacucggggagcuucguucagcaucccgagcugacuggucuggacuguauucgaccuugcuucuggguggaacucaucagaggcaggccaaaagagaauacaauuuggaccuccgggucaaguaucucuuuuuguggagucaacagcgauacugugggcugguccuggcccgacggugcggaguuaccguucacaauagauaaguga

SEQ ID NO: 139200 - RNA, 1410 nt, Artificial Sequence; identical to SEQ ID NO: 139178
  derived and/or modified sequence opt3 from neuraminidase__InfluenzaA__ACU30095

SEQ ID NO: 139201 - RNA, 1410 nt, Artificial Sequence; identical to SEQ ID NO: 138754
  derived and/or modified sequence opt3 from neuraminidase__InfluenzaA__ACU30105

SEQ ID NO: 139202 - RNA, 1410 nt, Artificial Sequence; identical to SEQ ID NO: 138754
  derived and/or modified sequence opt3 from neuraminidase__InfluenzaA__ACU30114

SEQ ID NO: 139203 - RNA, 1410 nt, Artificial Sequence; identical to SEQ ID NO: 138754
  derived and/or modified sequence opt3 from neuraminidase__InfluenzaA__ACU30123

SEQ ID NO: 139204 - RNA, 1410 nt, Artificial Sequence
  derived and/or modified sequence opt3 from neuraminidase__InfluenzaA__ACU31177
augaaccccaaucagaagaucauuaccauaggcagcgugugcaugacaaucgggauggccaaccugauucuccaaaucggaaauauuaucuccauauggaucucucaccuuauucagcuggguaaccagaaucagaucgagacuuguaaccaaucagucauuacguacgaaaauaacaccuggguuaaucagacauaugugaacaucaguaauacuaacuucgcugcaggccagagcguaguguccgucaaauuggccggaaauucuucguuaugcccugugucaggaugggcgauauacagcaaggacaacaguauuagaaucggcuccaaaggugauguuuuugugauuagggagccauucaucucuuguagcccgcuggaaugccggaccuuuuuccuaacacagggggcucuccugaaugacaagcauuccaacggaaccaucaaagaucgcucacccuaucgaacucuuaugaguuguccuauuggcgaggucccaagccccuacaacucucguuuugaauccguggccuggucagcaagcgccugccacgacggcauaaguuggcugacaaucgggauuucuggaccugauaauggugcuguagcaguuuugaaguauaacggcaucauaaccgacacgauuaaguccuggagaaauaacauccucaggacucaagagagcgagugugccugcgugaaugggucguguuucaccgucaugacagauggaccaucugacggccaggcuuccuacaaaaucuuucggauugaaaaggguaaaaucgugaagucaguggagaugaacgcccccaauuaucauuacgaagagugcaguuguuacccugauagcuccgagauuacuugcgucugccgcgacaacuggcacgggucuaauagaccauggguuagcuucaaccagaaucuggaauaucagauaggauacaucuguucaggcauuuuuggcgauaacccgaggcccaaugacaaaaccgggaguugcggaccuguguccagcaacggugcgaauggcguaaagggguucucuuuuaaguauggaaacggcguguggaucggucggacaaaaucaaucaguagccgcaacggguucgagaugauuugggauccaaauggcuggaccggaacggacaacaauuuuuccauaaagcaagacaucgucggcauuaacgaauggucuggguacucggggagcuucgugcagcaucccgagcugacuggucucgauuguauccgaccuugcuucuggguugaauuaauuagaggcaggccaaaagagaauacaaucuggaccuccgggucaaguauaucuuuuuguggagugaacagcgacacugucggcugguccuggcccgauggugcagagcugccguucacaaucgacaaguga

SEQ ID NO: 139205 - RNA, 1410 nt, Artificial Sequence; identical to SEQ ID NO: 138754
  derived and/or modified sequence opt3 from neuraminidase__InfluenzaA__ACU31178

SEQ ID NO: 139206 - RNA, 1410 nt, Artificial Sequence; identical to SEQ ID NO: 138744
  derived and/or modified sequence opt3 from neuraminidase__InfluenzaA__ACU31179

SEQ ID NO: 139207 - RNA, 1410 nt, Artificial Sequence; identical to SEQ ID NO: 138744
  derived and/or modified sequence opt3 from neuraminidase__InfluenzaA__ACU31180

SEQ ID NO: 139208 - RNA, 1410 nt, Artificial Sequence; identical to SEQ ID NO: 138744
  derived and/or modified sequence opt3 from neuraminidase__InfluenzaA__ACU31181

SEQ ID NO: 139209 - RNA, 1410 nt, Artificial Sequence; identical to SEQ ID NO: 138754
  derived and/or modified sequence opt3 from neuraminidase__InfluenzaA__ACU31182

SEQ ID NO: 139210 - RNA, 1410 nt, Artificial Sequence; identical to SEQ ID NO: 138784
  derived and/or modified sequence opt3 from neuraminidase__InfluenzaA__ACU31183

SEQ ID NO: 139211 - RNA, 1410 nt, Artificial Sequence; identical to SEQ ID NO: 138754
  derived and/or modified sequence opt3 from neuraminidase__InfluenzaA__ACU31184

SEQ ID NO: 139212 - RNA, 1410 nt, Artificial Sequence; identical to SEQ ID NO: 138744
  derived and/or modified sequence opt3 from neuraminidase__InfluenzaA__ACU31185

SEQ ID NO: 139213 - RNA, 1410 nt, Artificial Sequence; identical to SEQ ID NO: 138744
  derived and/or modified sequence opt3 from neuraminidase__InfluenzaA__ACU31186

SEQ ID NO: 139214 - RNA, 1410 nt, Artificial Sequence; identical to SEQ ID NO: 138744
  derived and/or modified sequence opt3 from neuraminidase__InfluenzaA__ACU31187

SEQ ID NO: 139215 - RNA, 1410 nt, Artificial Sequence; identical to SEQ ID NO: 138744
  derived and/or modified sequence opt3 from neuraminidase__InfluenzaA__ACU31188

SEQ ID NO: 139216 - RNA, 1350 nt, Artificial Sequence
  derived and/or modified sequence opt3 from neuraminidase__InfluenzaA__ACU46645
augaaccccaauaagaaaaucauuaccauaggcagcaucugcauggugacagggauggucucccugaugcuccagauuggaaaccuuaucucuauuuggguuucacacaguauccauacugguaaucaacacaaggccgagccuauaagcaacacgaaucuguugaccgagaaaacaguggcuuccguaaaguuagcaggcaacucuucgcuguguccaaucaaugggugggccguguacucaaaagacaacagcauuagaaucggaaguaagggcgaugucuucgugauuagggaaccguuuaucuccugcucucaucuagaaugucggacuuucuuucucacccagggugcgcugcuuaaugacaagcacagcaacgggacaguuaaagaucgcucaccccaucgaacccugauguccggaccugugggcgaggcuccaagucccuauaauagccguuucgaauacgucgccuggucugcauccgccugccacgacagaacuucaagguugacaauaggcauuagcgggccugauaacggagcuguggcaguacucaaguauaaugguaucauuaccgacacgaucaaaaguuggcggaacaauauccugcgcacucaggagucugagugugccugcguuaacggcuccuguuuuaccgugaugacagaugggccaagcaacggacaggcuucgcacaagauuuucaaaauggaaaagggcaaggucgugaaaucuguggagcuggacgcccccaauuaccauuaugaagagugcuccuguuacccugaugcgggugagauaacuugcgucuguagagacaacuggcacgggucaaauaggccauggguuaguuuuaaccaaaaucucgaauaucagaucggauacauuugcagcggcguguucggcgauaacccgcggcccaaugacggggcaggauccugcgguccuguaucuagcaacggcgccuacggggugaagggauuuucauucaaauauggcaauggugucuggaucgggcgcaccaagaguacaaacucccgaagcggcuuugagaugauaugggauccaaauggauggaccgaaacggacucuucauucagugugaaacaggacauuguugcuaucacugauuggagcggcuacuccgggucuuuugugcagcaucccgaguuaacaggacuggacuguaucagaccuugcuucugggucgaacuuauuaggggucggccaaaggagucgaccaucuggacuagcggcuccucaauuaguuucuguggggugaacucugauacaguaggauggagcuggcccgacggcgccgaguugccguuuaccauagauaaauga

SEQ ID NO: 139217 - RNA, 1410 nt, Artificial Sequence
  derived and/or modified sequence opt3 from neuraminidase__InfluenzaA__ACU56927
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucuaauggccaggcuuccuacaaaaucuuucggauugacaaggguaaaaucgugaagucaguggaaaugaacgcccccaauuaucauuacgaggaaugcaguuguuacccugauagcuccgagauuacuugcgucugccgcgacaacuggcacgggucuaauagaccauggguuagcuucaaccagaaucucgaguaucagauaggauacaucuguucaggcauuuuuggcgauaacccgaggcccaaugacaaaaccgggaguugcggaccuguguccagcaacggugcgaacggcguaaagggguucucuuuuaaguauggaaauggcguguggaucggucggacaaaaucaaucaguagccgcaacggguucgaaaugauuugggauccaaauggcuggaccggaacggacaacaauuuuuccauaaagcaagacaucgucggcauuaacgaguggucuggguacucggggagcuucgugcagcaucccgaacugacuggucuggauuguauccgaccuugcuucuggguugagcucauuagaggcaggccaaaagaaaauacaaucuggaccuccgggucaaguauaucuuuuuguggagugaacagcgacacugucggcugguccuggcccgauggugcagaguuaccguucacaaucgacaaguga

SEQ ID NO: 139218 - RNA, 1410 nt, Artificial Sequence; identical to SEQ ID NO: 138909
  derived and/or modified sequence opt3 from neuraminidase__InfluenzaA__ACU56934

SEQ ID NO: 139219 - RNA, 1410 nt, Artificial Sequence; identical to SEQ ID NO: 138754
  derived and/or modified sequence opt3 from neuraminidase__InfluenzaA__ACU64791

SEQ ID NO: 139220 - RNA, 1410 nt, Artificial Sequence
  derived and/or modified sequence opt3 from neuraminidase__InfluenzaA__ACU64811
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccaugguaucugugaaacuggccggaaauucgucauugugcccugucagcggaugggcgauauacaguaaggacaacuccgugagaauuggcucuaaaggugauguuuuuaucauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggugccaucucccuacaacucccguuuugaaucagucgccuggagcgcaagugccugccacgacggcauaaauuggcuuacaaucgggauuucuggaccugauaacggugcuguggcaguacugaaguauaauggcaucauaaccgacacgauuaaguccuggagaaacaauaucuugaggacucaagagagcgagugugccugcguuaacgggucguguuucaccgugaugacagauggaccaucuaauggccaggcuuccuacaaaaucuuucggauugaaaaggguaaaaucgucaagucaguggagaugaacgcccccaauuaucauuacgaagagugcaguuguuacccugacagcuccgagauuacuugcgugugccgcgauaacuggcacgggucuaauagaccaugggucagcuucaaccagaaucucgaauaucagauaggauacaucuguucaggcauuuuuggcgacaacccgaggcccaaugauaaaaccgggaguugcggaccuguuuccagcaacggugcgaacggcgugaagggguucucuuuuaaguauggaaauggcguauggaucggucggacaaaaucaaucaguagccgcaacggguucgagaugauuugggacccaaauggcuggaccggaacggauaacaauuuuuccauaaagcaagacaucgugggcauuaacgaauggucuggguacucggggagcuucguccagcaucccgagcugacuggucuggacuguauccgaccuugcuucuggguggaacucauuagaggcaggccaaaagagaauacaaucuggaccuccgggucaaguauaucuuuuuguggaguuaacagcgauacugugggcugguccuggcccgacggugcagaguuaccguucacaaucgauaaguga

SEQ ID NO: 139221 - RNA, 1410 nt, Artificial Sequence; identical to SEQ ID NO: 138519
  derived and/or modified sequence opt3 from neuraminidase__InfluenzaA__ACU79885

SEQ ID NO: 139222 - RNA, 1410 nt, Artificial Sequence; identical to SEQ ID NO: 136111
  derived and/or modified sequence opt3 from neuraminidase__InfluenzaA__ACU79896

SEQ ID NO: 139223 - RNA, 1410 nt, Artificial Sequence; identical to SEQ ID NO: 136111
  derived and/or modified sequence opt3 from neuraminidase__InfluenzaA__ACU79918

SEQ ID NO: 139224 - RNA, 1410 nt, Artificial Sequence; identical to SEQ ID NO: 136111
  derived and/or modified sequence opt3 from neuraminidase__InfluenzaA__ACU79929

SEQ ID NO: 139225 - RNA, 1413 nt, Artificial Sequence
  derived and/or modified sequence opt3 from neuraminidase__InfluenzaA__ACU79940
augaaccccaaucagaagaucauuaccauaggcagcaucuccauugugaucgggauuaucucucugaugcuccaaauaggaaacaucauuucaaucugggccagucacagcauucagacagguucccagaaucauacuggcaucugcaaccagagaauaauuacguacgaaaauucuaccugggucaaccacacauauguuaauaucaacaauacuaacgugguagcugggaaagacaagaccucggugacacuugcaggaaauucaagccuguguaguauuuccggcugggccaucuacaccaaagauaacucuaucaggauugguagcaagggggacgucuucgugauacgggagccuuuuaucuccugcucacauuuggagugucgcacuuucuuuuuaacacaaggagcgcugcuaaaugauaaacacaguaacggcaccguuaaggaccgaagcccauaucgugcucucaugucuugcccgcugggcgaagcccccuccccuuacaauucaaaguucgagagcguggcauggagugccucugcuugucaugaugggaugggauggcuuacgauugguaucuccggcccagacaacggggcagucgccgugcugaaauauaacggaauaauuacugaaaccaucaagagcuggaaaaagagaaucuugaggacacaggagucggagugcguauguguuaauggcucuugcuuuacuauuaugaccgauggucccuccaacggggcugccucauacaaaaucuucaagauugaaaagggaaaagugacaaagaguauagagcucaaugcgccuaacagccacuaugaagaguguuccugcuacccagacaccggcacggucaugugugugugccgggauaauuggcacggcucuaaccgccccugggugagcuuuaaucagaaccuggacuaccagaucggguauauuugcucaggagucuucggugauaauccuagaccaaaagacggcgaggggaguuguaacccgguuacuguggauggagcagacggcguaaaggguuuuuccuacagguaugggaauggcguguggaucggacggacaaaaagcaaccgccugcgaaagggcuucgaaaugaucugggaccccaauggguggaccgauacugacucugauuuuucagucaaacaagacgugguugccaugacagauuggaguggauacagcgguuccuucgugcagcauccugagcucaccggcuuagacugcauuagaccauguuuuugggucgaacuggugagggggcggccccgugagaacacgaccauauggacaucuggaucgagcaucuccuucugcggcguaaauucagauacugcuaacuggaguuggccugacggugccgaacuuccauucaccauugauaaguga

SEQ ID NO: 139226 - RNA, 1410 nt, Artificial Sequence
  derived and/or modified sequence opt3 from neuraminidase__InfluenzaA__ACU79951
augaaccccaaucagaagaucauuaccauaggcagcgugucccugacaaucgagacugucugcuuccucaugcaaauugccauccuugcuacgaccguuacacugcacuuuaaacagcaugaaugugacucuccugcaucaaaccaggugaugccaugcgagccgauuaucauagaaagaaauaucacugagauuguauacuugaacaauaccacaaucgaaaaggagauuugucccgagguggucgaauauaggaacuggaguaaaccucagugccaaaucaccggguucgccccauuuagcaaggauaauuccauacgguuaucugcgggaggugacauuugggugacucgcgagcccuacguuucgugugauccuggcaaaugcuaucaguucgcucuggggcagggaacaacccuagacaacaagcacucaaauggcacgauccaugaucguauuccacaccgaacucuccugaugaacgaacuuggugugcccuuucaucuggggaccaagcaggucuguguggccuggagcaguuccucuugccacgacggaaaagcaugguugcacguauguguuacaggcgaugacagaaaugccacugcuagcuucaucuacgauggcaggcucguggacuccaucgggucauggagucaaaacauucugcggacccaggagagcgagugcgucuguauaaauggaacaugcaccguggugaugacggaugguucugcauccggccgcgccgacacuagaauccuguuuauuaaggaagggaaaaucguccauauaucaccucucagcggaagugcucagcacauugaggaaugcucuuguuauccaagguacccggauguucggugcaucugucgcgacaacuggaagggcuccaaucgacccgugaucgacauuaacauggaggauuauagcaucgacucgucuuacguaugcuccgguuuagugggggauacaccuagaaacgacgauucaaguagcaauuccaacuguagggacccaaauaacgaacggggaaaucccggcgucaaaggcugggccuucgauaacggggacgauguguggaugggacguaccauuucuaaggacagccgcucagguuacgagacuuuuaagguuauaggcggguggaguacaccuaauuccaaaagccaggugaacagacaagucaucgugggaaauaacaauuggucuggcuauucagguauuuucaguguagagggcaagagcugcaucaacagguguuuuuacguugaacugauccgggggcgaccacaggagacccgcgugugguggacguccaauucuauugucguguucugcggaaccucgggcacauaugggacuggaagcuggcccgauggugcgaacauaaauuuuaugccgaucuga

SEQ ID NO: 139227 - RNA, 1410 nt, Artificial Sequence; identical to SEQ ID NO: 138619
  derived and/or modified sequence opt3 from neuraminidase__InfluenzaA__ACU79973

SEQ ID NO: 139228 - RNA, 1413 nt, Artificial Sequence; identical to SEQ ID NO: 138648
  derived and/or modified sequence opt3 from neuraminidase__InfluenzaA__ACU79984

SEQ ID NO: 139229 - RNA, 1410 nt, Artificial Sequence; identical to SEQ ID NO: 138615
  derived and/or modified sequence opt3 from neuraminidase__InfluenzaA__ACU80006

SEQ ID NO: 139230 - RNA, 1410 nt, Artificial Sequence
  derived and/or modified sequence opt3 from neuraminidase__InfluenzaA__ACU80017
augaacaccaaucagagaaucauuacaauaggcacuaucugccugauuguggggaucauuagccuccuucugcaaaucggaaacauaaucuuguuauggaugucccacucuauucagacgggugagaagucacaucccaaaguguguaaucagaguguuaucaccuacgaaaacaauacaugggugaaccagacuuauguaaauauuagcaacaccaauaucgccgcuggccaaggggugacaccuauaauucuggcaggaaacuccucucuaugcccaaucucgggcugggccauuuacucaaaggacaauagcaucaggaucgguaguaaaggggauauuuucgucaugcgggagccguuuauauccuguucucaccucgaaugccgcaccuucuuucugacucagggagcgcuucugaacgaccgacauagcaauggcacagugaaggaucguucccccuauagaaccuugaugucauguccuaucggcgaggcuccaagucccuacaacagcagguucgaaucuguugccugguccgcaucagccugccacgacgggaugggauggcucacgauugguaucagcggcccugauaauggggcuguggcaguccugaaauauaacggaauaauuacugacaccaucaagaguuggcggaacaagauccugcgcacacaggagucugagugugugugcauuaauggcuccuguuuuacuaucaugaccgaugguccaagcaacgggcaggccucguacaaacucuucaagauggaaaaaggaaagauuauaagaucuaucgaguuagacgcucccaauuaucauuacgaagagugcuccuguuacccugauacaggcaaaguaguuugcgugugcagggacaacuggcacgccucaaaucggccaugggucaguuuugaucaaaaccuggacuaucagauuggcuacaucuguagcgggguguucggagauaauccgcgcuccaacgacgguaagggcaauugcgggcccgugcuuucuaacggagcgaauggcgucaaggguuuuagcuuccgauaugggaacggcguuuggaucggaagaaccaaaucaauuaguuccaggagcggcuuugagaugauaugggacccuaauggguggacggaaacugauucuucauucaguaugaagcaggacaucauugcauugacagauuggagcggauacuccgguucuuuugugcagcacccagagcugaccggcaugaacuguauccggcccugcuucuggguagaacuaauucgugggcaaccuaaagagucgacuaucuggacaagcggauccucaauaaguuucuguggcgucaauucugguaccgccagcugguccuggccagacggggcugaucuccccuuuacgaucgacaaguga

SEQ ID NO: 139231 - RNA, 1413 nt, Artificial Sequence; identical to SEQ ID NO: 138648
  derived and/or modified sequence opt3 from neuraminidase__InfluenzaA__ACU80028

SEQ ID NO: 139232 - RNA, 1410 nt, Artificial Sequence; identical to SEQ ID NO: 138615
  derived and/or modified sequence opt3 from neuraminidase__InfluenzaA__ACU80039

SEQ ID NO: 139233 - RNA, 1413 nt, Artificial Sequence; identical to SEQ ID NO: 138732
  derived and/or modified sequence opt3 from neuraminidase__InfluenzaA__ACU80050

SEQ ID NO: 139234 - RNA, 1410 nt, Artificial Sequence; identical to SEQ ID NO: 139165
  derived and/or modified sequence opt3 from neuraminidase__InfluenzaA__ACU80061

SEQ ID NO: 139235 - RNA, 1413 nt, Artificial Sequence; identical to SEQ ID NO: 138648
  derived and/or modified sequence opt3 from neuraminidase__InfluenzaA__ACU80072

SEQ ID NO: 139236 - RNA, 1413 nt, Artificial Sequence; identical to SEQ ID NO: 138648
  derived and/or modified sequence opt3 from neuraminidase__InfluenzaA__ACU80094

SEQ ID NO: 139237 - RNA, 1410 nt, Artificial Sequence; identical to SEQ ID NO: 138619
  derived and/or modified sequence opt3 from neuraminidase__InfluenzaA__ACU80105

SEQ ID NO: 139238 - RNA, 1410 nt, Artificial Sequence; identical to SEQ ID NO: 138619
  derived and/or modified sequence opt3 from neuraminidase__InfluenzaA__ACU80127

SEQ ID NO: 139239 - RNA, 1410 nt, Artificial Sequence; identical to SEQ ID NO: 138619
  derived and/or modified sequence opt3 from neuraminidase__InfluenzaA__ACU80138

SEQ ID NO: 139240 - RNA, 1410 nt, Artificial Sequence; identical to SEQ ID NO: 138615
  derived and/or modified sequence opt3 from neuraminidase__InfluenzaA__ACU80160

SEQ ID NO: 139241 - RNA, 1413 nt, Artificial Sequence; identical to SEQ ID NO: 138648
  derived and/or modified sequence opt3 from neuraminidase__InfluenzaA__ACU80171

SEQ ID NO: 139242 - RNA, 1410 nt, Artificial Sequence; identical to SEQ ID NO: 138528
  derived and/or modified sequence opt3 from neuraminidase__InfluenzaA__ACU80182

SEQ ID NO: 139243 - RNA, 1410 nt, Artificial Sequence
  derived and/or modified sequence opt3 from neuraminidase__InfluenzaA__ACU80193
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaaugauacagugcgagaccguacuccauauagaacccugcuuaugaacgaacugggaguucccuuucacuugggcacaaaacaggugugcaucgcuuggagcaguuccucuugucaugaugguaaggccuggcuccacgucugcauuaccggggacgauaagaaugcaacggccagcuucaucuacaacggaaggcugguggacuccaucguaucauggaguaaagagauucugcggacucaggaaagcgaguguguuugcauaaauggcacauguaccguggucaugacugauggcucugcuuccgggaaggcagacacaaaaauccucuuuauugaggaaggaaagaucgugcauaccucaacguuaagcgguagugcccaacacguggaggaaugcucuugcuauccucgcuacccaggcgucagauguguuugcagggauaacuggaagggguccaaccggccgauaguggacauuaauaucaaagaccacagcaucguaucgucuuacguguguuccggacuggucggcgauacaccccgcaagaacgacucaaguagcuccucucauugccuugauccuaauaacgaggaaggugggcacggagugaaaggcugggcuuucgacgauggcaaugacguuuggauggggcgaaccauuagcgagaagucaagauugggauaugagacuuuuaaagugaucgaagguuggaguaacccaaaguccaaacugcagauuaauaggcaggucauaguggaucggggcgaccguagcggguacucuggaaucuucucaguagagggcaagaguuguauuaaccgcugcuuuuauguugaacuaaucagagguaggaaggaggaaaccgaggugcucuggacaagcaauuccaucgucguguucugugggacuucuggcaccuacggaacaggcucguggcccgauggggccgacauuaaccugaugccuauauga

SEQ ID NO: 139244 - RNA, 1410 nt, Artificial Sequence; identical to SEQ ID NO: 138528
  derived and/or modified sequence opt3 from neuraminidase__InfluenzaA__ACU80204

SEQ ID NO: 139245 - RNA, 1413 nt, Artificial Sequence
  derived and/or modified sequence opt3 from neuraminidase__InfluenzaA__ACU80237
augaaccccaaucagaagaucauuaccauaggcagcaucuccauugccaucgggauuaucucucugaugcuccaaauaggaaacaucauuucaaucugggcuagucacagcauucagacagguaaucagaacaauacuggcaucugcaaccagagaauaauuacguacgaaaauuccaccugggugaaccauacauaugucaauaucaacaauacuaacguuguggcaggggaggacaaaaccucuguaacacuugccggaaauucgucacuguguagcauuaguggcugggcgaucuacaccaaggauaacuccaucaggauugguucuaaaggggacguguucgucauacgggagccuuuuaucagcugcucccacuuggaaugucgcacuuucuuuuuaacacaaggagcucugcuaaaugauaagcauucaaacggcaccgugaaagaccgaaguccauaucgugcccucaugagcugcccgcugggcgaggcacccucuccuuacaacuccaaguucgaaucaguugccuggagcgcuagugcaugucacgaugggaugggauggcuuacgauugguaucucuggcccagacaauggggccguggcuguccugaaguauaacggaauaauuacuggcaccaucaaauccuggaagaaacagaucuugagaacacaggagagcgagugcguguguaugaaugguucgugcuuuacuauuaugaccgaugggcccucuaacaaggccgcguccuacaaaaucuucaagauugaaaagggaaaaguaacaaagucaauagagcucaaugcaccuaacuuucauuaugaagaguguaguugcuacccagacaccggcaucguuaugugugugugcagggauaauuggcacggcagcaaccggcccugggucuccuucaaucagaaccuggacuaccaaauuggguauaucugcucuggaguguuuggugauaauccucgcccagaggacggcgaagggagcuguaacccggugacggucgauggagccaauggcguuaaagguuucucauacaaguaugacaacgggguguggaucggcagaacuaaaaguaauaggcugcggaagggauuugagaugauuugggaccccaacggcuggacaaacaccgauuccgacuucagcguaaaacaggauguggucgcuauaacugacuggucuggguacucaggaaguuuugugcagcacccugaacucacagguuuagauugcauccgcccauguuucuggguugagcuggugcgaggccuucccagagaaaauaccacgauuuggaccagcggguccucuaucucguucugcggagucaacagcgacacagccaauugguccuggccugauggcgcagaguugccauuuacuauugacaaguga

SEQ ID NO: 139246 - RNA, 1410 nt, Artificial Sequence; identical to SEQ ID NO: 138619
  derived and/or modified sequence opt3 from neuraminidase__InfluenzaA__ACU80248

SEQ ID NO: 139247 - RNA, 1410 nt, Artificial Sequence; identical to SEQ ID NO: 138619
  derived and/or modified sequence opt3 from neuraminidase__InfluenzaA__ACU80259

SEQ ID NO: 139248 - RNA, 1413 nt, Artificial Sequence
  derived and/or modified sequence opt3 from neuraminidase__InfluenzaA__ACU80270
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuucauuaugaagaguguagcugcuacccagacaccuccaucguuaugugugugugcagggauaacuggcacggcucuaaucggcccugggucagcuucaaccagaaucuggacuaccaaauuggcuauaucugcucagggguguuuggagauaacccucgcccagaggacggugaaggcaguuguaauccggugacggucgauggggccaacggaguuaaaggcuucuccuacaaguaugacaaugguguguggaucgggagaacuaaaagcaacaggcugcggaagggcuuugagaugauuugggaccccaauggauggacaaacaccgauucugacuucucaguaaaacaggauguggucgcuauaacugacuggaguggcuacagcggguccuuugugcagcacccugaacucacaggauuagauugcauccgcccauguuucuggguugagcuggugcgaggucuucccagagaaaacaccacgauuuggaccucuggcucgagcaucuccuucugcggggucaauucagacacagccaacuggaguuggccugauggagcagaguugccauuuacuauugacaaguga

SEQ ID NO: 139249 - RNA, 1413 nt, Artificial Sequence
  derived and/or modified sequence opt3 from neuraminidase__InfluenzaA__ACU80281
augaaccagaaucaaaagaucauuaccauaggcagcaucuccauugccaucgggauuaucucucugaugcuccagauaggaaacaucauuucaaucugggcuagucacagcauucagacagguucccagaauaacacuggcaucugcaaucaaagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagcccuuuaucuccugcucacacuuggaaugucgcacuuucuuuuuaacacagggagcucugcuaaacgauaagcauaguaauggcaccgugaaagaccgaagcccuuaucgugcccucaugucuugcccacugggcgaggcaccgucccccuacaacucaaaguucgaaagcguugccuggagugcuucugcaugucacgaugggaugggauggcuuacgauugguaucuccggcccugacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggccauccaauaaggccgcgucauacaaaaucuucaagauugaaaagggaaaaguaacaaagaguauagagcucaacgcacccaauuuucauuaugaagaguguagcugcuacccugacaccggcaucguuaugugugugugcagggauaacuggcacggcuccaaucggccaugggucucuuucaaccaaaaucuggacuaccagauuggguauaucugcagcggaguguuuggugauaacccccgcccugaggacggcgaagggucauguaauccagugacggucgauggagccaacggcguuaaagguuucaguuacaaguaugacaaugggguguggaucggcagaacuaaauccaacaggcugcggaagggauuugagaugauuugggacccgaauggcuggacaaacaccgauagcgacuucucuguaaaacaggauguggucgcuauaacugacuggucaggguacagugguagcuuugugcagcaccccgaacucacaggauuagauugcauccgcccuuguuucuggguugagcuggugcgaggccuuccaagagaaaacaccacgauuuggaccuccgggucuucgaucagcuucugcggagucaauuccgacacagccaacuggucauggcccgauggcgcagaguugccuuuuacuauugacaaguga

SEQ ID NO: 139250 - RNA, 1410 nt, Artificial Sequence
  derived and/or modified sequence opt3 from neuraminidase__InfluenzaA__ACU80303
augaaccccaaucagaagaucauuaccauaggcagcgugucccugacaaucucuacuauuugcuucuuuaugcaaaucgccauucucaucacgaccgucacacuucacuucaaacaguacgaguuuaacucaaguccuaauaaccagguuaugcugugugaaccaacuauaaucgagagaaauauuaccgaaaucguguauuugacaaacaccacuauugagaaggaaaucugcccgaaauuagcugaguacaggaauuggagcaagccccagugugacauaacaggguucgcaccuuuuuccaaagauaacucuauucggcugucggccggaggugacaucuggguaacccgcgagccauaugugucaugcgaucccgacaaguguuaccaauucgcgcuaggccaggggacgacucucaauaacguccauagcaauaacaccgugcgagaucguacaccuuauagaacucugcuuaugaaugaacugggaguuccauuucacuugggcaccaaacaggugugcauugcuuggaguuccucuagcugucaugacgguaaggccuggcuccacgucugcaucacaggggaugacaagaacgcaaccgccuccuucaucuacaauggaaggcugguggauucaauuguaaguuggagcaaagagauacugcggacgcaggaaucugaguguguuugcaucaacggcacuuguacaguggucaugaccgacggcuccgcuucagggaaggcagauacuaaaauucucuuuaucgaggaaggaaagauagugcauacaagcaccuuaagugguucugcccaacacguggaggaaugcuccugcuauccccgcuacccuggcgucagauguguuugcagggacaacuggaaggggagcaaucggccaauuguggauaucaacaucaaagaccacucgauuguaucuuccuacguguguucaggacuggucggcgacacgccgcgcaagaaugauaguagcuccucuagccauugccuugaccccaacaaugaggaaggugggaacggagugaaaggcugggcuuucgaugacggcaaugauguuuggauggggcgaaccaucucagagaagaguagauugggauaugagacauuuaaagugauugaagguugguccaacccuaagagcaaacugcagauaaauaggcaggucaucguggaccggggcaaccguucuggguacucaggaauuuucaguguagagggcaagagcuguaucaaucgcugcuuuuauguugaacuaaucagagguaggaaggaggaaacugaggugcucuggaccuccaacucuauugucguguucugugggacaucgggcacuuacggaaccggcagcuggccagauggggccgacauaaaucugaugcccaucuga

SEQ ID NO: 139251 - RNA, 1410 nt, Artificial Sequence; identical to SEQ ID NO: 138619
  derived and/or modified sequence opt3 from neuraminidase__InfluenzaA__ACU80314

SEQ ID NO: 139252 - RNA, 1410 nt, Artificial Sequence; identical to SEQ ID NO: 138619
  derived and/or modified sequence opt3 from neuraminidase__InfluenzaA__ACU80325

SEQ ID NO: 139253 - RNA, 1410 nt, Artificial Sequence; identical to SEQ ID NO: 138615
  derived and/or modified sequence opt3 from neuraminidase__InfluenzaA__ACU80336

SEQ ID NO: 139254 - RNA, 1410 nt, Artificial Sequence; identical to SEQ ID NO: 138619
  derived and/or modified sequence opt3 from neuraminidase__InfluenzaA__ACU80347

SEQ ID NO: 139255 - RNA, 1410 nt, Artificial Sequence; identical to SEQ ID NO: 138619
  derived and/or modified sequence opt3 from neuraminidase__InfluenzaA__ACU80358

SEQ ID NO: 139256 - RNA, 1410 nt, Artificial Sequence; identical to SEQ ID NO: 138619
  derived and/or modified sequence opt3 from neuraminidase__InfluenzaA__ACU80369

SEQ ID NO: 139257 - RNA, 1410 nt, Artificial Sequence; identical to SEQ ID NO: 138619
  derived and/or modified sequence opt3 from neuraminidase__InfluenzaA__ACU80380

SEQ ID NO: 139258 - RNA, 1410 nt, Artificial Sequence
  derived and/or modified sequence opt3 from neuraminidase__InfluenzaA__ACU80391
augaaccccaaucagaagaucauuaccauaggcagcgugucccugacaaucucuacuauuugcuucuuuaugcaaaucgccauucucaucacgaccgucacacuucacuucaaacaguacgaguuuaacucaaguccuaauaaccagguuaugcugugugaaccaacuauaaucgagagaaauauuaccgaaaucguguauuugacaaacaccauuaucgagaaggaaauaugcccgaaauuagcugaguacaggaauuggagcaagccccagugugacauuacuggguucgcaccuuuuuccaaagauaacucuauccggcugucggccggaggugacauuuggguaacacgcgagccauaugugucaugcgaucccgacaaguguuaccaauucgcgcuaggccaggggaccacgcucaauaacguccauagcaauaacacugugcgagaucguaccccuuauagaacacugcuuaugaaugaacugggaguuccauuucacuugggcacuaaacaggugugcaucgcuuggaguuccucuagcugucaugacgguaaggccuggcuccacgucugcaucaccggggaugacaagaacgcaacagccuccuucauuuacaauggaaggcugguggauucaauaguaaguuggagcaaagagauccugcggacccaggaaucugaguguguuugcauuaacggcacguguacuguggucaugacagacggcuccgcuucagggaaggcagauaccaaaauccucuuuauagaggaaggaaagauugugcauacuagcacauuaagugguucugcccaacacguggaggaaugcuccugcuauccccgcuacccuggcgucagauguguuugcagggacaacuggaaggggagcaaucggccaaucguggauaucaacauuaaagaccacucgaucguaucuuccuacguguguucaggacuggucggcgacaccccgcgcaagaaugauaguagcuccucuagccauugccuugaccccaacaaugaggaaggugggcacggagugaaaggcugggcuuucgaugacggcaacgauguuuggauggggcgaacgauuucagagaagaguagauugggauaugagaccuuuaaagugauagaagguugguccaauccuaagagcaaacugcagaucaacaggcaggucauuguggaccggggcaaucguucuggguacucaggaaucuucaguguagagggcaagagcuguaucaaccgcugcuuuuauguugaacuaauuagagguaggaaggaggaaacagaggugcucuggacuuccaauucuauagucguguucugugggaccucgggcacauacggaacuggcagcuggccagauggggccgacaucaaccugaugcccauuuga

SEQ ID NO: 139259 - RNA, 1410 nt, Artificial Sequence; identical to SEQ ID NO: 138615
  derived and/or modified sequence opt3 from neuraminidase__InfluenzaA__ACU80402

SEQ ID NO: 139260 - RNA, 1413 nt, Artificial Sequence; identical to SEQ ID NO: 138648
  derived and/or modified sequence opt3 from neuraminidase__InfluenzaA__ACU80413

SEQ ID NO: 139261 - RNA, 1410 nt, Artificial Sequence; identical to SEQ ID NO: 138619
  derived and/or modified sequence opt3 from neuraminidase__InfluenzaA__ACU80427

SEQ ID NO: 139262 - RNA, 1410 nt, Artificial Sequence; identical to SEQ ID NO: 138619
  derived and/or modified sequence opt3 from neuraminidase__InfluenzaA__ACU80438

SEQ ID NO: 139263 - RNA, 1410 nt, Artificial Sequence; identical to SEQ ID NO: 138615
  derived and/or modified sequence opt3 from neuraminidase__InfluenzaA__ACU80461

SEQ ID NO: 139264 - RNA, 1410 nt, Artificial Sequence; identical to SEQ ID NO: 138619
  derived and/or modified sequence opt3 from neuraminidase__InfluenzaA__ACU80603

SEQ ID NO: 139265 - RNA, 1410 nt, Artificial Sequence; identical to SEQ ID NO: 138619
  derived and/or modified sequence opt3 from neuraminidase__InfluenzaA__ACU80614

SEQ ID NO: 139266 - RNA, 1410 nt, Artificial Sequence; identical to SEQ ID NO: 138619
  derived and/or modified sequence opt3 from neuraminidase__InfluenzaA__ACU80625

SEQ ID NO: 139267 - RNA, 1410 nt, Artificial Sequence; identical to SEQ ID NO: 138615
  derived and/or modified sequence opt3 from neuraminidase__InfluenzaA__ACU80636

SEQ ID NO: 139268 - RNA, 1410 nt, Artificial Sequence
  derived and/or modified sequence opt3 from neuraminidase__InfluenzaA__ACU80647
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaaugauacagugcgagaccguacuccauauagaacccugcuuaugaacgaacugggaguucccuuucacuugggcacaaaacaggugugcaucgcuuggagcaguuccucuugucaugaugguaaggccuggcuccacgucugcauuaccggggacgauaagaaugcaacggccagcuucaucuacaacggaaggcugguggacuccguaguuucauggaguaaagagauccugcggacucaggaaagcgagugugugugcauuaauggcacauguaccgucgugaugacugauggcucugcuuccgggaaggcagacacaaaaauacucuuuaucgaggaaggaaagauugugcauaccucaacguuaagcgguagugcccaacacgucgaggaaugcucuugcuauccucgcuacccaggcguuagaugugugugcagggauaacuggaagggguccaaccggccgaucguagacauaaauauuaaagaccacagcaucgugucgucuuacgucuguuccggacuggugggcgauacccccaggaagaacgacucaaguagcuccucucauugccuugauccuaauaacgaggaaggugggcacggaguuaaaggcugggcuuucgacgauggcaaugacguguggauggggcgaacaaucagcgagaagucaagauugggauaugagacuuuuaaagucauugaagguuggaguaacccaaaguccaaacugcagaucaaucgccaggugauuguagaucggggcgaccguagcggguacucuggaauauucucaguugagggcaagaguuguaucaaccgcugcuuuuauguggaacuaauuagagguaggaaggaggaaaccgagguccucuggacaagcaauuccaucguggucuucugugggacuucuggcaccuacggaacaggcucguggcccgauggggccgacaucaaccugaugccuauuuga

SEQ ID NO: 139269 - RNA, 1410 nt, Artificial Sequence
  derived and/or modified sequence opt3 from neuraminidase__InfluenzaA__ACU80658
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgaagauaaucgagagaaauauuacugaaaucguguauuugaccaacacaaccauugagaaagaaaucugccccaaguuagcugaguacaggaauuggaguaaaccucagugugacauaacuggguucgcaccauuuagcaaggauaacuccauucggcugucugccggaggugacaucuggguaacacgcgagcccuaugugucgugcgauccugacaaguguuaccaauucgcgcuaggccaggggaccacgcucaauaacguccauucaaaugauacugugcgagaccguaccccauauagaacacugcuuaugaacgaacugggaguucccuuucacuugggcacuaaacaggugugcauugcuuggagcaguuccucuugucaugaugguaaggccuggcuccacgucugcaucaccggggacgauaaaaaugcaacagccagcuucaucuacaacggaaggcugguggacuccguaguuucauggaguaaggagauucugcggacccaggaaagcgagugugugugcauaaauggcacguguacugucgugaugacagauggcucugcuuccgggaaagcagacaccaagauccucuuuauugaggaaggaaagaucgugcauacuucaacauuaagcgguagugcccaacacgucgaggaaugcucuugcuauccucgcuacccaggcguuagaugugugugcagggauaacuggaaaggguccaaccggccgauaguagacauuaauaucaaggaccacagcaucgugucgucuuacgucuguuccggacuggugggcgauacccccaggaaaaacgacucaaguagcuccucucauugccuugauccuaauaacgaggaaggugggcacggaguuaagggcugggcuuucgacgauggcaaugacguguggauggggcgaacgauuagcgagaaaucaagauugggauaugagaccuuuaaggucaucgaagguuggaguaacccaaaauccaagcugcagauuaaucgccaggugauaguagaucggggcaaccguagcggguacucuggaaucuucucaguugagggcaagaguuguauuaaucgcugcuuuuauguggaacuaaucagagguaggaaagaggaaacagagguccucuggacuagcaacuccaucguggucuucugugggaccucuggcacauacggaacuggcucguggcccgacggggccgauauuaaucugaugccuauauga

SEQ ID NO: 139270 - RNA, 1410 nt, Artificial Sequence; identical to SEQ ID NO: 138528
  derived and/or modified sequence opt3 from neuraminidase__InfluenzaA__ACU80669

SEQ ID NO: 139271 - RNA, 1410 nt, Artificial Sequence; identical to SEQ ID NO: 138615
  derived and/or modified sequence opt3 from neuraminidase__InfluenzaA__ACU80691

SEQ ID NO: 139272 - RNA, 1410 nt, Artificial Sequence; identical to SEQ ID NO: 138619
  derived and/or modified sequence opt3 from neuraminidase__InfluenzaA__ACU80702

SEQ ID NO: 139273 - RNA, 1410 nt, Artificial Sequence; identical to SEQ ID NO: 138619
  derived and/or modified sequence opt3 from neuraminidase__InfluenzaA__ACU80713

SEQ ID NO: 139274 - RNA, 1410 nt, Artificial Sequence; identical to SEQ ID NO: 138615
  derived and/or modified sequence opt3 from neuraminidase__InfluenzaA__ACU80724

SEQ ID NO: 139275 - RNA, 1410 nt, Artificial Sequence; identical to SEQ ID NO: 138528
  derived and/or modified sequence opt3 from neuraminidase__InfluenzaA__ACU80735

SEQ ID NO: 139276 - RNA, 1410 nt, Artificial Sequence; identical to SEQ ID NO: 138615
  derived and/or modified sequence opt3 from neuraminidase__InfluenzaA__ACU80746

SEQ ID NO: 139277 - RNA, 1410 nt, Artificial Sequence
  derived and/or modified sequence opt3 from neuraminidase__InfluenzaA__ACU80757
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaagugguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaaugauaccguucgagaccguacaccauauagaacucugcuuaugaacgaacugggagugcccuuucacuugggcaccaagcaggucugcaucgcuuggagcaguuccucuugucaugaugguaaagccuggcuccacgugugcauuacaggggacgauaagaaugcaaccgccagcuucaucuacaacggaaggcugguagacuccguugugucauggaguaaagagauccugcggacgcaggaaagcgagugugucugcauuaauggcacuuguacaguggugaugaccgauggcucugcuuccgggaaggcagacacuaaaauacucuuuaucgaggaaggaaagauuguccauacaucaaccuuaagcgguagugcccaacacguugaggaaugcucuugcuauccucgcuacccaggcgugagauguguaugcagggauaacuggaagggguccaaccggccgaucguggacauaaauauuaaagaccacagcaucgucucgucuuacguguguuccggacugguuggcgauacgccccgcaagaacgacucaaguagcuccucucauugccuugauccuaauaacgaggaaggugggcacggagugaaaggcugggcuuucgacgauggcaaugacgucuggauggggcgaaccaucagcgagaagucaagauugggauaugagacauuuaaagugauugaagguuggaguaacccaaaguccaaacugcagaucaauaggcagguaauuguugaucggggcaaccguagcggguacucuggaauauucucaguggagggcaagaguuguaucaaucgcugcuuuuaugucgaacuaauuagagguaggaaggaggaaacugaggugcucuggaccagcaacuccaucgucguguucugugggacaucuggcacuuacggaaccggcucguggcccgacggggccgauaucaaucugaugccuauuuga

SEQ ID NO: 139278 - RNA, 1410 nt, Artificial Sequence; identical to SEQ ID NO: 139243
  derived and/or modified sequence opt3 from neuraminidase__InfluenzaA__ACU80768

SEQ ID NO: 139279 - RNA, 1410 nt, Artificial Sequence; identical to SEQ ID NO: 138615
  derived and/or modified sequence opt3 from neuraminidase__InfluenzaA__ACU80779

SEQ ID NO: 139280 - RNA, 1410 nt, Artificial Sequence; identical to SEQ ID NO: 138528
  derived and/or modified sequence opt3 from neuraminidase__InfluenzaA__ACU80790

SEQ ID NO: 139281 - RNA, 1410 nt, Artificial Sequence; identical to SEQ ID NO: 138615
  derived and/or modified sequence opt3 from neuraminidase__InfluenzaA__ACU80801

SEQ ID NO: 139282 - RNA, 1410 nt, Artificial Sequence
  derived and/or modified sequence opt3 from neuraminidase__InfluenzaA__ACU81106
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaauccaaaguccaaacugcagauuaacaggcaagugauaguagaccggggcaauagcucuggguacucaggaaucuucaguguugagggcaagagcuguauuaaccguugcuuuuauguggaacuaauccgcgguagaaaggaggaaacugagguccucuggaccuccaauucuaucguggucuucugugggacaucgggcacuuacggaaccggcagcuggcccgauggggccgacauuaaccugaugccuauauga

SEQ ID NO: 139283 - RNA, 1410 nt, Artificial Sequence; identical to SEQ ID NO: 138909
  derived and/or modified sequence opt3 from neuraminidase__InfluenzaA__ACU87265

SEQ ID NO: 139284 - RNA, 1410 nt, Artificial Sequence; identical to SEQ ID NO: 138754
  derived and/or modified sequence opt3 from neuraminidase__InfluenzaA__ACU87273

SEQ ID NO: 139285 - RNA, 1410 nt, Artificial Sequence; identical to SEQ ID NO: 138754
  derived and/or modified sequence opt3 from neuraminidase__InfluenzaA__ACV04231

SEQ ID NO: 139286 - RNA, 1410 nt, Artificial Sequence; identical to SEQ ID NO: 138754
  derived and/or modified sequence opt3 from neuraminidase__InfluenzaA__ACV04241

SEQ ID NO: 139287 - RNA, 1410 nt, Artificial Sequence; identical to SEQ ID NO: 138754
  derived and/or modified sequence opt3 from neuraminidase__InfluenzaA__ACV04251

SEQ ID NO: 139288 - RNA, 1410 nt, Artificial Sequence; identical to SEQ ID NO: 138754
  derived and/or modified sequence opt3 from neuraminidase__InfluenzaA__ACV04261

SEQ ID NO: 139289 - RNA, 1410 nt, Artificial Sequence; identical to SEQ ID NO: 138754
  derived and/or modified sequence opt3 from neuraminidase__InfluenzaA__ACV04271

SEQ ID NO: 139290 - RNA, 1410 nt, Artificial Sequence
  derived and/or modified sequence opt3 from neuraminidase__InfluenzaA__ACV04281
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucggcaauacuaacuucgcugcagggcagagcguaguguccgucaaacuggccggaaauucuucguugugcccugugucaggcugggcgauauacagcaaggacaacaguauuagaaucgguuccaaaggggauguuuuugugauuagggagccauucaucucuuguagcccguuagaaugccggaccuuuuuccugacacagggagcucuacucaaugacaagcauuccaacggcaccaucaaagaucgcucacccuaucgaacucugaugaguuguccuauuggcgaggucccaagccccuacaacucucguuuugaauccguggccuggucagcaagcgccugccacgacgggauaaauuggcuuacaaucggaauuagugguccugauaacggcgcuguagcaguucugaaguauaaugggaucauaaccgacacgauuaagucuuggagaaacaauaucuugaggacucaagaguccgagugugccugcgugaacggaagcuguuucaccgucaugacagauggcccaucggacggucaggcuucuuacaaaaucuuucggauugaaaaggggaaaaucgugaaguccguggagaugaaugcccccaacuaucauuacgaagagugcucauguuacccugauaguagcgagauuacuugcgucugccgcgacaauuggcacggauccaacagaccauggguuucuuucaaucagaaccucgaauaucagauaggcuacaucuguagcggcauuuuuggggauaauccgaggcccaacgacaaaaccggaucaugcgguccugugaguuccaauggcgcgaacgggguaaagggauucagcuuuaaguauggcaacgguguguggaucgggcggacaaaaucuaucucaagucgcaauggcuucgagaugauuugggauccaaacggauggaccggcacggacaauaacuuuagcauaaagcaagacaucgucgggauuaaugaaugguccggauacucugguucguucgugcagcaucccgagcugacuggccuggauuguauccgaccuugcuucuggguugaacucauuagagggaggccaaaagagaacacaaucuggaccagcggauccucaauaaguuuuuguggcgucaauucugacacuguggguuggagcuggcccgauggggcagaguuaccguucacaaucgacaaguga

SEQ ID NO: 139291 - RNA, 1410 nt, Artificial Sequence; identical to SEQ ID NO: 138754
  derived and/or modified sequence opt3 from neuraminidase__InfluenzaA__ACV04291

SEQ ID NO: 139292 - RNA, 1410 nt, Artificial Sequence; identical to SEQ ID NO: 138754
  derived and/or modified sequence opt3 from neuraminidase__InfluenzaA__ACV04301

SEQ ID NO: 139293 - RNA, 1410 nt, Artificial Sequence; identical to SEQ ID NO: 138754
  derived and/or modified sequence opt3 from neuraminidase__InfluenzaA__ACV04321

SEQ ID NO: 139294 - RNA, 1410 nt, Artificial Sequence; identical to SEQ ID NO: 138754
  derived and/or modified sequence opt3 from neuraminidase__InfluenzaA__ACV04331

SEQ ID NO: 139295 - RNA, 1410 nt, Artificial Sequence; identical to SEQ ID NO: 138754
  derived and/or modified sequence opt3 from neuraminidase__InfluenzaA__ACV04341

SEQ ID NO: 139296 - RNA, 1410 nt, Artificial Sequence; identical to SEQ ID NO: 138754
  derived and/or modified sequence opt3 from neuraminidase__InfluenzaA__ACV04351

SEQ ID NO: 139297 - RNA, 1410 nt, Artificial Sequence; identical to SEQ ID NO: 138754
  derived and/or modified sequence opt3 from neuraminidase__InfluenzaA__ACV04361

SEQ ID NO: 139298 - RNA, 1410 nt, Artificial Sequence; identical to SEQ ID NO: 138754
  derived and/or modified sequence opt3 from neuraminidase__InfluenzaA__ACV04371

SEQ ID NO: 139299 - RNA, 1410 nt, Artificial Sequence; identical to SEQ ID NO: 138754
  derived and/or modified sequence opt3 from neuraminidase__InfluenzaA__ACV04381

SEQ ID NO: 139300 - RNA, 1410 nt, Artificial Sequence; identical to SEQ ID NO: 138754
  derived and/or modified sequence opt3 from neuraminidase__InfluenzaA__ACV04391

SEQ ID NO: 139301 - RNA, 1410 nt, Artificial Sequence; identical to SEQ ID NO: 138754
  derived and/or modified sequence opt3 from neuraminidase__InfluenzaA__ACV04401

SEQ ID NO: 139302 - RNA, 1410 nt, Artificial Sequence; identical to SEQ ID NO: 138744
  derived and/or modified sequence opt3 from neuraminidase__InfluenzaA__ACV04411

SEQ ID NO: 139303 - RNA, 1410 nt, Artificial Sequence; identical to SEQ ID NO: 138754
  derived and/or modified sequence opt3 from neuraminidase__InfluenzaA__ACV04492

SEQ ID NO: 139304 - RNA, 1410 nt, Artificial Sequence; identical to SEQ ID NO: 138754
  derived and/or modified sequence opt3 from neuraminidase__InfluenzaA__ACV04502

SEQ ID NO: 139305 - RNA, 1410 nt, Artificial Sequence; identical to SEQ ID NO: 138744
  derived and/or modified sequence opt3 from neuraminidase__InfluenzaA__ACV04512

SEQ ID NO: 139306 - RNA, 1410 nt, Artificial Sequence
  derived and/or modified sequence opt3 from neuraminidase__InfluenzaA__ACV04522
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggcaaauccguagugucugucaagcuggccggaaauucgucauugugcccugugagcggaugggcgauauacaguaaagacaacuccauuagaaucggcucuaagggugauguuuuugugauuagggagccauucaucagcuguuccccguuagaaugccggaccuuuuuccugacacagggggcucuacucaaugacaaacauucaaacggaaccaucaaggaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaauccuggagaaacaauaucuugaggacucaggagagcgagugugccugcgugaacgggucguguuucaccgucaugacagauggaccaucugacggccaggcuuccuacaagaucuuucggauugaaaaagguaagaucgugaaaucaguggagaugaaugcccccaacuaucauuacgaagagugcaguuguuacccugauagcuccgagauuacuugcgucugccgcgacaauuggcacgggucuaacagaccauggguuagcuucaaucaaaaccucgaauaucagauaggauacaucuguucaggcauuuuuggcgauaauccgaggcccaacgacaagaccgggaguugcggaccuguguccagcaauggugcgaacggcguaaagggguucucuuuuaaauauggaaacggcguguggaucggucggacaaagucaaucaguagccgcaauggguucgagaugauuugggauccaaacggcuggaccggaacggacaauaacuuuuccauaaaacaggacaucgucggcauuaaugaauggucuggguacucggggagcuucgugcaacaucccgagcugacuggucuggauuguauccgaccuugcuucuggguugaacucauuagaggcaggccaaaggagaacacaaucuggaccuccgggucaaguauaucuuuuuguggagugaauagcgacacugucggcugguccuggcccgauggugcagaguuaccguucacaaucgacaaauga

SEQ ID NO: 139307 - RNA, 1410 nt, Artificial Sequence; identical to SEQ ID NO: 138754
  derived and/or modified sequence opt3 from neuraminidase__InfluenzaA__ACV04532

SEQ ID NO: 139308 - RNA, 1410 nt, Artificial Sequence; identical to SEQ ID NO: 138754
  derived and/or modified sequence opt3 from neuraminidase__InfluenzaA__ACV04542

SEQ ID NO: 139309 - RNA, 1410 nt, Artificial Sequence; identical to SEQ ID NO: 138754
  derived and/or modified sequence opt3 from neuraminidase__InfluenzaA__ACV04552

SEQ ID NO: 139310 - RNA, 1410 nt, Artificial Sequence; identical to SEQ ID NO: 138754
  derived and/or modified sequence opt3 from neuraminidase__InfluenzaA__ACV04562

SEQ ID NO: 139311 - RNA, 1410 nt, Artificial Sequence; identical to SEQ ID NO: 138744
  derived and/or modified sequence opt3 from neuraminidase__InfluenzaA__ACV04572

SEQ ID NO: 139312 - RNA, 1410 nt, Artificial Sequence; identical to SEQ ID NO: 138754
  derived and/or modified sequence opt3 from neuraminidase__InfluenzaA__ACV04582

SEQ ID NO: 139313 - RNA, 1410 nt, Artificial Sequence
  derived and/or modified sequence opt3 from neuraminidase__InfluenzaA__ACV04758
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccgucagaaugccggaccuuuuucuuaacacagggggcucugcuaaaugacaagcauaguaacggaaccaucaaagaucgcagccccuaucgaacucucaugucuuguccuauuggcgaggucccaucccccuacaacucacguuuugaaagcguggccuggagugcaucugccugccacgacggcauaaauuggcugacaaucgggauuuccggaccugauaacggugcuguagcaguucuuaaguauaauggcaucauaaccgacacgauuaagagcuggagaaacaauauccugaggacucaagagucggagugugccugcgugaacgggucuuguuucaccgucaugacagauggaccauccaauggccaggcuucauacaaaaucuuucggauugaaaaggguaaaaucgugaagaguguggagaugaacgcccccaauuaucauuacgaagagugcagcuguuacccugacuccucugagauuacuugcgucugccgcgauaacuggcacgggagcaauagaccauggguuucauucaaccagaauuuggaauaucagauaggauacaucuguaguggcauuuuuggcgacaacccgaggcccaaugauaaaaccggguccugcggaccugugagcucuaacggugcgaacggcguaaagggguucucauuuaaguauggaaauggcguguggaucggucggacaaaaaguaucagcucccgcaacggguucgagaugauuugggacccaaauggcuggaccggaacggauaacaauuuuucuauaaagcaagacaucgucggcauuaacgaauggucgggguacagcggauccuucgugcagcaucccgagcucacuggucuggacuguauccgaccuugcuucuggguugaacugauuagaggcaggccaaaagagaauacaaucuggaccucagggaguucuauaucguuuuguggagugaacuccgauacugucggcuggucauggcccgacggugcagagcucccguucacaaucgauaaguga

SEQ ID NO: 139314 - RNA, 1410 nt, Artificial Sequence; identical to SEQ ID NO: 138744
  derived and/or modified sequence opt3 from neuraminidase__InfluenzaA__ACV33087

SEQ ID NO: 139315 - RNA, 1410 nt, Artificial Sequence; identical to SEQ ID NO: 138754
  derived and/or modified sequence opt3 from neuraminidase__InfluenzaA__ACV33107

SEQ ID NO: 139316 - RNA, 1410 nt, Artificial Sequence; identical to SEQ ID NO: 138754
  derived and/or modified sequence opt3 from neuraminidase__InfluenzaA__ACV33117

SEQ ID NO: 139317 - RNA, 1410 nt, Artificial Sequence; identical to SEQ ID NO: 138754
  derived and/or modified sequence opt3 from neuraminidase__InfluenzaA__ACV33127

SEQ ID NO: 139318 - RNA, 1410 nt, Artificial Sequence; identical to SEQ ID NO: 138754
  derived and/or modified sequence opt3 from neuraminidase__InfluenzaA__ACV33137

SEQ ID NO: 139319 - RNA, 1410 nt, Artificial Sequence; identical to SEQ ID NO: 138754
  derived and/or modified sequence opt3 from neuraminidase__InfluenzaA__ACV33147

SEQ ID NO: 139320 - RNA, 1410 nt, Artificial Sequence
  derived and/or modified sequence opt3 from neuraminidase__InfluenzaA__ACV33157
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccugucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 139321 - RNA, 1410 nt, Artificial Sequence
  derived and/or modified sequence opt3 from neuraminidase__InfluenzaA__ACV33167
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucgauugguccuggcccgacggcgcagaguuaccguucacaaucgauaaguga

SEQ ID NO: 139322 - RNA, 1410 nt, Artificial Sequence; identical to SEQ ID NO: 138754
  derived and/or modified sequence opt3 from neuraminidase__InfluenzaA__ACV33177

SEQ ID NO: 139323 - RNA, 1410 nt, Artificial Sequence
  derived and/or modified sequence opt3 from neuraminidase__InfluenzaA__ACV41993
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagauuuguaaccaaagugucaucacuuacgaaaauaacacguggguuaaucagaccuaugugaacauaagcaauacaaacuucgcugcaggccaguccguagugucugucaaacuggccgggaacucgucauugugcccugugggaggcugggcgauuuacagcaaggacaauaguguuagaaucgguuccaaaggggauguguuugucauuagggagccauucaucucuuguagcccguuagaaugccggaccuuuuuccugacucagggagcucuacucaaugacaagcauuccaacggcacaaucaaagaucgcucacccuaucgaacccugaugaguuguccuauuggcgaggugccaagccccuacaacucucguuuugaauccguagccuggucagcaagcgccugccacgacgggauaaauuggcuuacuaucggaauuagugguccugauaacggcgcuguugcagugcugaaguauaaugggaucauaacagacaccauuaagucuuggagaaacaauaucuugaggacgcaagaguccgagugugccugcgucaacggaagcuguuucacugugaugaccgauggcccaucgaauggucaggcuucuuacaaaaucuuucggauugaaaaggggaaaaucgugaaguccgucgagaugaacgcccccaauuaucauuacgaagagugcucauguuacccugacaguagcgagauuacaugcguuugccgcgauaacuggcacggauccaauagaccaugggugucuuucaaccagaaucucgaauaucagauaggcuacaucuguagcggcauuuuuggggacaacccgaggcccaaugauaaaacuggaucaugcgguccuguaaguuccaacggcgcgaacggggugaagggauucagcuuuaaguauggcaauggugucuggaucgggcggaccaaaucuaucucaagucgcaacggcuucgagaugauuugggacccaaauggauggacaggcaccgauaacaauuuuagcauaaagcaagacaucguggggauuaacgaaugguccggauacucugguucguucguucagcaucccgagcugacgggccuggacuguauccgaccuugcuucuggguggaacucauuagagggaggccaaaagagaauacuaucuggacaagcggauccucaauaaguuuuuguggcgucaacucugauaccguggguuggagcuggcccgacggggcagaguuaccguucacuaucgauaaguga

SEQ ID NO: 139324 - RNA, 1410 nt, Artificial Sequence; identical to SEQ ID NO: 138754
  derived and/or modified sequence opt3 from neuraminidase__InfluenzaA__ACV42010

SEQ ID NO: 139325 - RNA, 1410 nt, Artificial Sequence; identical to SEQ ID NO: 138754
  derived and/or modified sequence opt3 from neuraminidase__InfluenzaA__ACV42020

SEQ ID NO: 139326 - RNA, 1410 nt, Artificial Sequence; identical to SEQ ID NO: 138519
  derived and/or modified sequence opt3 from neuraminidase__InfluenzaA__ACV49504

SEQ ID NO: 139327 - RNA, 1362 nt, Artificial Sequence
  derived and/or modified sequence opt3 from neuraminidase__InfluenzaA__ACV49537
augaaccccaaucagaagaucauuaccauaggcagcaucugcaugguggucgggauuaucucccugauucuccaaaucggaaacauaaucucuauuuggaucucacacaguauucagacagguaaucagaaccauacuggcaucuguaaucaggggauaauuacguacaacguuguggccggacaagacagcaccuccguaauccuuacaggcaauucuucgcugugcccuauuagagguugggcuauccacucaaaagauaacgggaucaggauuggaagcaagggcgacguguucgucauacgggagccauuuaucaguuguucccauuuggaaugccgcacuuucuuuuuaacccagggcgcacugcuaaaugauaaacacucuaacggggccgugaaggaccgaagcccguaucgugcgcucauguccugucccguuggagaggcuccuucaccauacaauaguagauucgaaagcguggccuggucugcauccgccugccaugaugguaugggcuggcugacaauugggaucucaggacccgacaacggcgcugucgcagugcuuaaauauaaugguauaauuaccgagacuaucaagagcuggaggaagaaaauccugcggacacaggaaagugaguguaccugcguaaacgggucuuguuuuacgauuaugacugauggaccuuccgacggcuuggccagcuacaagaucuucaaaauugagaagggcaaaguuaccaagucgauagaacucaaugcuccaaacucucacuaugaggaaugcuccuguuaccccgauacagggaaggugaugugcgucugccgcgacaacuggcacggaucaaauagaccuugggugaguuuugaucagaaccuggacuaucaaaucgguuacauuuguagcggcguguucggggauaauccaaggccgaaagacggaacuggcuccugcggucccgucucugccgacggggcgaacggcguuaagggauuuagcuaccgguauggcaaugggguguggaucggacgcaccaaaucagauaguucccgacaugguuucgagaugaucugggacccuaacggcuggacagagaccgauagcagauuuucuguaaggcaggacguggucgcaaugacggaucggucaggguacaguggcagcuucgugcagcacccagaacugacuggacucgacuguaugcgucccugcuuuuggguugaguuaauucgcgguagaccugaagagaagacaauauggaccuccgggucuaucauuucguucuguggcgugaauagcgauacugucgacugguccuggccagauggagccgaacugcccuucacaaucgacaaauga

SEQ ID NO: 139328 - RNA, 1362 nt, Artificial Sequence
  derived and/or modified sequence opt3 from neuraminidase__InfluenzaA__ACV49559
augaaccccaaucagaagaucauuaccauaggcagcaucugcaugguggucgggauuaucucccugauucuccaaaucggaaacauaaucucuauuuggaucucacacaguauucaggccgguagcuccacauggguuaaucagacuuacgugaacaucucuaauacgaacguaguggcuggccaggacgcaaccucggucauacuuacaggaaauucaagccuguguccuauuagagggugggccaucuauaguaaagauaacggcauuaggaucgguuccaagggggacaucuucgugauucgggagccauuuauaucuugcagccauuuggaaugucgcgcguucuuuuuaacucaaggagcucugcuaaaugauaaacacuccaacggcaccguuaaggaccgaucaccguaccgugcccucaugaguugccccgugggcgaggcaccuagcccauauaauucuagauucgaauccgucgccuggucagcuagcgcaugucaugaugggaugggauggcugacaaucgguauuaguggccccgacaacggggccguggcuguacuuaaauacaauggaaucauaaccgagacuauuaagucuuggaggaagaaaauccugcggacacaggaauccgagugcgccuguguuaacggcagcugcuuuaccaucaugacggaugguccuucggacgggccagcgucuuauaagauuuucaaaaucgagaagggaaaagugacuaaguccauugaauuggaugcacccaauucacacuacgaggaauguaguugcuauccugacaccggcaaggucaugugugugugccgcgauaacuggcauggcagcaacagaccauggguguccuuugaccagaaucucgauuaccagauaggguacaucugcucuggagucuucggugacacaccgaggcccaaagacggcacugggagcuguggaccuguuucaguggauggcgccaacgguguaaagggguuuaguuaucgguacggcgacggaguguggauuggccgcaccaaaucccaaagcucucgacacggguucgagaugaucugggauccaaauggauggacagagaccgacucaagauuuagugucaggcaggaugugguugcuaucacggacuggagcgguuauuccggcucuuucgugcagcaccccgaacugacugggcuggauugcaugcggccuuguuuuugggucgagcucauucguggacagccaaaggagaaaacaauauggaccucgggcagcuccaucucauucugcggugugaacagugacacuguagauuggucuuggcccgacggggccgaauuaccguucacaauugauaaguga

SEQ ID NO: 139329 - RNA, 1395 nt, Artificial Sequence
  derived and/or modified sequence opt3 from neuraminidase__InfluenzaA__ACV49570
augaaccccaaucagaagaucauuaccauaggcagcaucugcaugguggucgggauuaucucccugauucuccaaaucggaaacauaguuucuaucuggauuucacacaguauccagacagguaaucagaaccauacuggcacgugugaccagagcauuaucaccuacaaaaauuccacaugggugaaccaaacuuauguaaauguggucgccgggaaggauaccacaucugugauacuugcuggaaacucgucacugugcccuauuagaggcugggcaaucuacagcaaagacaaugguguuaggauugggaguaagggagauguguucgucauccgggagccauuuaucuccuguucucacuuggaaugccgcaccuucuuuuuaacucagggcgcccugcuaaacgacaaacauagcaauggcacagugaaggaucgauccccguaucgugcgcucaugucaugucccguaggggaggcuccuaguccauacaacagcagauucgaaucuguugccugguccgcaucagccugccacgacggaauggguuggcugaccauuggcauaagcgggcccgaugacggagcuguggcaguccuuaaguauaauggcaucauuacggagacuaucaaaaguuggaggaaggaaauacugcggacccaggagucugagugugugugcgugaacgguuccuguuuuacaauuaugacugaugggccuagcggaggcccagccucguacaaaaucuucaagaucgaaaaaggcaaggucaccaagucuauugaguuggacgcucccaauucccauuaugaagagugcucauguuacccugauacaaguaaaguuaugugcgugugccgcgacaacuggcacgggagcaacagaccauggguauccuuugaucagaaucucgacuaccaaaugggauauaucuguucugguguguucggcgacaacccgaggcccaaggaugggaaaggaagcugcggcccugucuacguggacggugccaaugggguuaagggcuuuucauauaaauacggaaacggcguguggauugggcggaccaagaguaauuccagccgccagggauucgagaugauaugggauccaaacgguuggacggaaacugacucuaacuuuuucacaaaacaggaugucguggcgguaaccgacuggucaggcuauagugggagcuuuguucagcaccccgagcugacuggacuggauuguaugcgaccuugcuucuggguggaacucaucagaggcaggccaaaggagaauacaauuuggaccuccgguucuucgaucagcuucuguggggucaauuccgacacgguggauuggucauggcccgacggcgcagaauuaccguuuaccaucgauaaguga

SEQ ID NO: 139330 - RNA, 1410 nt, Artificial Sequence; identical to SEQ ID NO: 138420
  derived and/or modified sequence opt3 from neuraminidase__InfluenzaA__ACV49581

SEQ ID NO: 139331 - RNA, 1410 nt, Artificial Sequence; identical to SEQ ID NO: 138420
  derived and/or modified sequence opt3 from neuraminidase__InfluenzaA__ACV49592

SEQ ID NO: 139332 - RNA, 1410 nt, Artificial Sequence
  derived and/or modified sequence opt3 from neuraminidase__InfluenzaA__ACV49603
augaaccccaaucagaagaucauuaccauaggcagcgugucccugacaaucgagacugucugcuuccucaugcaaauugccauccuugcuacgaccguuacacugcacuuuaaacagcaugaaugugacucuccugcaucaaaccaggugaugccaugcgagccgauuaucauagaaagaaauaucacugagauuguauacuugaacaauaccacaaucgaaaaggagauuugucccgagguggucgaauauaggaacuggaguaaaccucagugccaaaucaccggguucgccccauuuagcaaggauaauuccauacgguuaucugcgggaggugacauuugggugacucgcgagcccuacguuucgugugauccuggcaaaugcuaucaguucgcucuggggcagggaacaacccuagacaacaagcacucaaauggcacgauccaugaucguauuccacaccgaacucuccugaugaacgaacuuggugugcccuuucaucuggggaccaagcaggucuguguggccuggagcaguuccucuugccacgacggaaaagcaugguugcacguauguguuacaggcgaugacagaaaugccacugcuagcuucaucuacgauggcaggcucguggacuccaucgggucauggagucaaaacauucugcggacccaggagagcgagugcgucuguauaaauggaacaugcaccguggugaugacggaugguucugcauccggccgcgccgacacuagaauccuguuuauuaaggaagggaaaaucguccauauaucaccucucagcggaagugcucagcacauugaggaaugcucuuguuauccaagguacccggauguucggugcaucugucgcgacaacuggaagggcuccaaucgacccgugaucgacauuaacauggaggauuauagcaucgacucgucuuacguaugcuccgguuuagugggggauacaccuagaaacgacgauucaaguagcaauuccaacuguagggacccaaauaacgaacggggaaaucccggcgucaaaggcugggccuucgauaacggggacgauguguggaugggacguaccauuucuaaggacagccgcucagguuacgagacuuuuaagguuauaggcggguggaguacaccuaauuccaaaagccaggugaacagacaagucaucguggauaauaacaauuggucuggauauucaggcauuuucaguguagaggguaagagcugcaucaacagguguuuuuacguugaacugauccgggggcgaccacaggagacccgcgugugguggacguccaauucuauugucguguucugcggcaccucgggaacauauggcacugggagcuggcccgacggagcgaacauaaauuuuaugccgaucuga

SEQ ID NO: 139333 - RNA, 1410 nt, Artificial Sequence
  derived and/or modified sequence opt3 from neuraminidase__InfluenzaA__ACV49625
augaaccccaaucagaagaccaucacaauuggcagcgugucccugacuauagagacggucugcuuccucaugcaaaucgccauucuugcuaccacaguuacucugcacuuuaaacagcaugaaugugacucuccugcaucaaaccaggugaugccaugcgagccgaucauuaucgaaagaaauauaaccgagaucguauacuugaacaauacaaccauugaaaaggagaucugucccgagguggucgaauauaggaacuggaguaaaccucagugccaaauuacuggguucgccccauuuagcaaggauaauuccauccgguuaucugcgggaggugacauaugggugacacgcggccccuacguuucgugugauccugggaaaugcuaucaguucgcucugggacagggcaccacgcuagacaacaagcacucaaaugguacuauucaugaucgaaucccacaccguacccuccugaugaacgagcuuggggugcccuuucaucugggaacaaagcaggucuguguggccuggagcaguuccucuugccacgacggcaaagcaugguugcacguauguguuacuggcgaugacagaaaugccaccgcuagcuucauuuacgaugggaggcucguggacuccaucggaucauggagucaaaacauccugcggacacaggaaagcgagugcgucuguauuaaugguaccugcacgguggugaugacugauggcucugcauccgggcgcgccgacacaagaauacuguuuaucaaggagggaaaaauuguccauaucucaccucucagcggcagugcucagcacauagaagagugcucuuguuauccaagguacccggauguucggugcauuugucgcgacaacuggaaggguuccaaucgacccgugaucgacaucaacauggaagauuauagcauugacucgucuuacguaugcuccggguuagugggagauaccccuagaaacgacgauucaaguagcaauuccaacuguagggacccaaauaacgagcggggcaaucccggcgucaaagggugggccuucgauaacggagacgauguguggaugggucguacuaucucuaaggacagccgcucaggcuacgaaacauuuaagguuauugggggauggaguaccccuaauuccaaaagccaggugaacagacaagucauaguggauaauaacaauuggucuggcuauucagguaucuucaguguagagggcaagagcugcauuaacagguguuuuuacguugagcugauccgggggcgaccacaggaaacgcgcgugugguggaccuccaauucuaucgucguguucugcggaacaucgggcacuuaugggaccggaagcuggcccgacggugcgaacauuaauuuuaugccgauauga

SEQ ID NO: 139334 - RNA, 1410 nt, Artificial Sequence; identical to SEQ ID NO: 138472
  derived and/or modified sequence opt3 from neuraminidase__InfluenzaA__ACV49647

SEQ ID NO: 139335 - RNA, 1413 nt, Artificial Sequence
  derived and/or modified sequence opt3 from neuraminidase__InfluenzaA__ACV49669
augaaccccaaucagaagaucauuaccauaggcagcaucugcauggccauugggaucauuucccugauccuccaaauaggaaacaucgugucuauuuggaucucacacaguauucagacagguagccagaauuacacuggcaucuguaaccagagaauaauuacguaugaaaauuccaccugggucaaccaaacauacguuaauaucaacaauacuaacgugguagcugggcaggacaccacaucugugacccuugcaggaaauucgucacugugcccuauuagcggcugggccaucuauaguaaagauaacuccaucaggauugguucuaagggggacgucuucgugauacgggagccauuuaucagcuguucccauuuggagugccgcacuuucuuuuuaacacagggagcgcugcuaaaugauaaacacucaaacggcaccguuaaggaccgaaguccguaccgugcucucaugagcugucccauuggcgaagccccuucuccauauaauuccagauucgagucaguggcauggagcgccagugcuugccaugaugggaugggauggcugacgaucgguauaucuggccccgacgauggggcagucgccgugcuuaaauacaacggaauuaucacugaaaccaucaaguccuggaggaagcggauucugcgcacacaggagagcgaguguguaugcguuaacggcucguguuuuacuaucaugaccgacgguccuaauaacgggccagcuucuuauaaaauuuucaagauagaaaaaggaaagaucacaaaauccauugaguuggaugcccccaauucacacuacgaagagugcaguuguuacccugacgcgggcaccgugaugugcgucugcagagauaacuggcauggcagcaauaggccauggguguccuuuaaccaaaaucucgacuaucagaucggguacaucuguucuggaguguucggugauaacccgcggcccaaggacggcaaggggagcugcggaccugucacgguugacggcgcagauggugugaaaggguuuucauaucgcuacggcaauggaguauggauuggccgaacuaagaguaacuccagcagaaggggguucgagaugauaugggacccaaauggauggacagauaccgacucuaaauuucuggugaagcaggaugucguggccaugacugacuggucagguuauaguggcagcuucguucagcaccccgaacugacagggcucgauuguaugcggccuugcuuuuggguggaguuaauccguggacgcccaagagaaaacaccacgauuuggaccuccgguucuucgaucagcuucuguggcgucaauggggacacagcuaacugguccuggcccgauggcgccgagcugccguucacuauugacaaauga

SEQ ID NO: 139336 - RNA, 1413 nt, Artificial Sequence
  derived and/or modified sequence opt3 from neuraminidase__InfluenzaA__ACV49679
augaaccccaaucagaagaucauuaccauaggcagcaucuccauugccaucgggauuaucucucugaugcuccaaauaggaucaaucauuaguaucugggcuagccacuccauuagaacagguucucagaacaauacuggcaucugcaaccagaggauaauuacguacgaaaauucgaccugggugaaccauacauaugucaauaucaacaauacuaacguuguggcaggggaggacaaaaccucaguaacacuugccggaaauagcagucuguguuccauuucuggcugggcgaucuacaccaaggauaacagcauccggauugguuccaaaggggacguguucgucauacgcgagccuuuuaucucaugcagucacuuggaaugucgaacuuucuuuuuaacacagggagcucugcuaaaugauaagcauagcaacggcaccgugaaagaccguucuccauauagagcccucauguccugcccgcugggcgaggcacccucaccuuacaauagcaaguucgaaaguguugccuggucugcuuccgcaugucacgaugggaugggauggcuuacgauugguaucagcggcccagacaacggggccguggcuguccugaaguauaacggaauaauuacuggcaccaucaaaucguggaagaaacaaaucuugaggacacaggagucugagugcguguguaugaaugguuccugcuuuacuauuaugaccgaugggcccucaaacaaggccgcgaguuacaaaaucuucaagauugaaaagggaaaaguaacaaagagcauagagcucaaugcaccuaacuuuuauuacgaagaguguuccugcuacccagacaccggcaucguuaugugugugugccgggauaauuggcauggcucuaaccgccccugggucagcuucaaucagaaccuggacuaucagauuggguacaucugcucaggaguguuuggugauaauccuagaccagaggacggcgaagggaguuguaacccggugacggucgauggagccaauggcguuaaagguuucuccuauaaguacgggaacggcguguggaucggaaggacuaaaagcaaucggcugcgcaagggcuuugagaugauuugggaccccaacggguggacaaauaccgacucugauuucucaguaaaacaagacguggucgcuauaacugauuggaguggauauagcgguuccuuugugcagcacccugaacucacaggcuuagacugcauccgaccauguuucuggguugagcuggugagagggcuucccagggaaaacaccacgauuuggaccucuggaucgagcaucuccuucugcggcgucaacucagauacagccaauuggaguuggccugacggugcagaguugccauuuacuauugauaaguga

SEQ ID NO: 139337 - RNA, 1410 nt, Artificial Sequence
  derived and/or modified sequence opt3 from neuraminidase__InfluenzaA__ACV53442
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 139338 - RNA, 1410 nt, Artificial Sequence; identical to SEQ ID NO: 139121
  derived and/or modified sequence opt3 from neuraminidase__InfluenzaA__ACV53452

SEQ ID NO: 139339 - RNA, 1410 nt, Artificial Sequence; identical to SEQ ID NO: 138744
  derived and/or modified sequence opt3 from neuraminidase__InfluenzaA__ACV53462

SEQ ID NO: 139340 - RNA, 1410 nt, Artificial Sequence; identical to SEQ ID NO: 138754
  derived and/or modified sequence opt3 from neuraminidase__InfluenzaA__ACV53472

SEQ ID NO: 139341 - RNA, 1410 nt, Artificial Sequence
  derived and/or modified sequence opt3 from neuraminidase__InfluenzaA__ACV53482
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuucggaucgaaaaggguaaaauugugaagucagucgagaugaacgcccccaauuaucauuacgaagagugcaguuguuacccugacagcggggagaucacuugcguuugccgcgauaacuggcacggauccaauagaccaugggugucuuucaaccagaaucucgaauaucagauuggcuacauauguagcggcaucuuuggggacaacccgaggcccaaugauaaaaccggaucaugcgguccuguaaguuccaacggcgcgaacggggugaagggauucagcuuuaaguauggcaauggugucuggauugggcggacaaaaucuaucucaagucgcaacggcuucgagaugaucugggacccaaauggauggaccgcaacggauaacaauuuuagcauuaagcaagacauagugggcaucaacgaaugguccggguacucuggaucguucguucagcaucccgagcugacuggucuggacuguauucgaccuugcuucuggguggaacucaucagaggcaggccaaaagagaauacaauuuggaccagcggguccucaaucaguuuuuguggagucaacucugauacugugggcuggagcuggcccgacggugccgaguuaccguucacaauagauaaguga

SEQ ID NO: 139342 - RNA, 1410 nt, Artificial Sequence
  derived and/or modified sequence opt3 from neuraminidase__InfluenzaA__ACV53492
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaagcggggaguugcggaccuguguccagcaauggugcaaacggcguaaagggguucucuuuuaaguauggaaacggcguguggaucggucggaccaaaucaaucaguagccgcaauggguucgagaugauuugggauccaaacggcuggacagaaaccgacaauaacuuucugauaaagcaagacaucgucggaauuaaugagugguccggcuacucugggucguucgugcagcaucccgaacugacgggacucgauuguauccgaccuugcuucuggguugaguuaauuagagguaggccaaaagagaacacuaucuggacaagcggcuccucaauaaguuuuuguggggucaauucugacaccgugggauggagcuggcccgauggcgccgaacugccguucacuaucgacaaguga

SEQ ID NO: 139343 - RNA, 1410 nt, Artificial Sequence
  derived and/or modified sequence opt3 from neuraminidase__InfluenzaA__ACV53502
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaagcggggaguugcggaccuguguccagcaauggugcaaacggcguaaagggguucucuuuuaaguauggaaacggcguguggaucggucggaccaaaucaaucaguagccgcaauggguucgagaugauuugggauccaaacggcuggacaggaaccgacaauaacuuucugauaaagcaagacaucgucggcauuaaugaaugguccggguacucuggaucguucgugcagcaucccgagcugacgggucucgauuguauccgaccuugcuucuggguugaauuaauuagaggcaggccaaaagagaacacuaucuggacaagcggguccucaauaaguuuuuguggagucaauucugacaccgugggcuggagcuggcccgauggugccgagcugccguucacuaucgacaaguga

SEQ ID NO: 139344 - RNA, 1410 nt, Artificial Sequence
  derived and/or modified sequence opt3 from neuraminidase__InfluenzaA__ACV53891
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaaaaucuugaggacucaagagagcgagugugccugcgugaaugggucguguuucaccgucaugacagauggaccaucugacggccaggcuuccuacaagaucuuucggauugaaaaagguaagaucgugaaaucaguggagaugaacgcccccaauuaucauuacgaagagugcaguuguuacccugauagcuccgagauuacuugcgucugccgcgacaacuggcacgggucuaauagaccauggguuagcuucaaccagaaucucgaauaucagauaggauacaucuguucaggcauuuuuggcgauaacccgaggcccaaugacaagaccgggaguugcggaccuguguccagcaacggugcgaauggcguaaagggguucucuuuuaaauauggaaacggcguguggaucggucggacaaagucaaucaguagccgcaacggguucgagaugauuugugauccaaauggcuggaccggaacggacaacaauuuuuccauaaaacaagacaucgucggcauuaacgaauggucuggguacucggggagcuucgugcagcaucccgagcugacuggucuggauugcauccgaccuuguuucuggguugaacucauuagaggcaggccaaaggagaauacaaucuggaccuccgggucaaguauaucuuuuugcggagugaacagcgacacugucggcugguccuggcccgauggugcagaguuaccguucacaaucgacaaauga

SEQ ID NO: 139345 - RNA, 1410 nt, Artificial Sequence
  derived and/or modified sequence opt3 from neuraminidase__InfluenzaA__ACV53901
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucgcgaucguucgugcagcaucccgagcugacuggacuggauuguaucagaccuugcuucuggguugaacucauuaggggucggccaaaagagaacacaaucuggaccuccggcucaaguauaucuuuuuguggggugaauagcgacacugucggaugguccuggcccgauggcgcagaguuaccguucacaaucgacaaguga

SEQ ID NO: 139346 - RNA, 1410 nt, Artificial Sequence; identical to SEQ ID NO: 138754
  derived and/or modified sequence opt3 from neuraminidase__InfluenzaA__ACV53911

SEQ ID NO: 139347 - RNA, 1410 nt, Artificial Sequence; identical to SEQ ID NO: 138744
  derived and/or modified sequence opt3 from neuraminidase__InfluenzaA__ACV67088

SEQ ID NO: 139348 - RNA, 1410 nt, Artificial Sequence; identical to SEQ ID NO: 138754
  derived and/or modified sequence opt3 from neuraminidase__InfluenzaA__ACV67168

SEQ ID NO: 139349 - RNA, 1410 nt, Artificial Sequence; identical to SEQ ID NO: 138744
  derived and/or modified sequence opt3 from neuraminidase__InfluenzaA__ACV67169

SEQ ID NO: 139350 - RNA, 1410 nt, Artificial Sequence; identical to SEQ ID NO: 138754
  derived and/or modified sequence opt3 from neuraminidase__InfluenzaA__ACV67171

SEQ ID NO: 139351 - RNA, 1410 nt, Artificial Sequence; identical to SEQ ID NO: 138754
  derived and/or modified sequence opt3 from neuraminidase__InfluenzaA__ACV67172

SEQ ID NO: 139352 - RNA, 1410 nt, Artificial Sequence; identical to SEQ ID NO: 138784
  derived and/or modified sequence opt3 from neuraminidase__InfluenzaA__ACV67173

SEQ ID NO: 139353 - RNA, 1410 nt, Artificial Sequence; identical to SEQ ID NO: 138744
  derived and/or modified sequence opt3 from neuraminidase__InfluenzaA__ACV67174

SEQ ID NO: 139354 - RNA, 1410 nt, Artificial Sequence
  derived and/or modified sequence opt3 from neuraminidase__InfluenzaA__ACV67175
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaaugguucuaacggcguaaagggguucucauuuaaguauggaaacggcguguggaucggucggacaaaaaguaucagcucccgcaauggguucgagaugauuugggauccaaacggcuggaccggaacggacaauaacuuuucuauaaagcaagacaucgucggcauuaaugaauggucgggguacagcggauccuucgugcagcaucccgagcugacuggucuggauuguauccgaccuugcuucuggguugaacucauuagaggcaggccaaaagagaacacaaucuggaccucagggaguucuauaucguuuuguggagucaauuccgacacugugggcuggucauggcccgauggugcggaguuaccguucacaaucgacaaguga

SEQ ID NO: 139355 - RNA, 1410 nt, Artificial Sequence; identical to SEQ ID NO: 138754
  derived and/or modified sequence opt3 from neuraminidase__InfluenzaA__ACV67176

SEQ ID NO: 139356 - RNA, 1410 nt, Artificial Sequence; identical to SEQ ID NO: 138744
  derived and/or modified sequence opt3 from neuraminidase__InfluenzaA__ACV67177

SEQ ID NO: 139357 - RNA, 1410 nt, Artificial Sequence; identical to SEQ ID NO: 138754
  derived and/or modified sequence opt3 from neuraminidase__InfluenzaA__ACV67178

SEQ ID NO: 139358 - RNA, 1410 nt, Artificial Sequence; identical to SEQ ID NO: 138754
  derived and/or modified sequence opt3 from neuraminidase__InfluenzaA__ACV67179

SEQ ID NO: 139359 - RNA, 1410 nt, Artificial Sequence
  derived and/or modified sequence opt3 from neuraminidase__InfluenzaA__ACV67180
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccagccuguaguguccgucaaacuggccggaaauucuucguugugcccagugucagggugggcgauauacagcaaggacaacaguauuagaaucggcuccaaaggugauguuuuugugauuagggagccguucaucucuuguagccccuuagaaugccggaccuuuuuccugacacagggggcucuacucaaugacaagcauuccaacggaaccaucaaagaucgcucaccuuaucgaacucugaugaguuguccaauuggcgagguccccagcccuuacaacucucguuuugaauccguggccuggucagcaagcgccugccacgacggcauaaauuggcuuacaaucgggauuaguggaccagauaacggugcuguagcaguucugaaguauaauggcaucauaaccgacacgauuaagucuuggagaaacaauaucuugaggacucaagaguccgagugugccugcgugaacgggagcuguuucaccgucaugacagauggacccucggacggccaggcuucuuacaaaaucuuucggauugaaaaggguaaaaucgugaaguccguggagaugaaugccccuaacuaucauuacgaagagugcucauguuacccagauaguagcgagauuacuugcgucugccgcgacaauuggcacggguccaacagaccguggguuucuuucaaucagaaccucgaauaucagauaggauacaucuguagcggcauuuuuggcgauaaucccaggccuaacgacaaaaccgggucaugcggaccagugaguuccaauggugcgaacggcguaaagggguucagcuuuaaguauggaaacggcguguggaucggucggacaaaaucuaucucaagucgcaauggguucgagaugauuugggaucccaacggcuggaccggaacggacaauaacuuuagcauaaagcaagacaucgucggcauuaaugaaugguccggguacucuggaucguucgugcagcauccugagcugacuggucuggauuguauccgaccaugcuucuggguugaacucauuagaggcaggcccaaagagaacacaaucuggaccagcggguccucaauaaguuuuuguggagucaauucugacacugugggcuggagcuggccggauggugcagaguuaccuuucacaaucgacaaguga

SEQ ID NO: 139360 - RNA, 1410 nt, Artificial Sequence
  derived and/or modified sequence opt3 from neuraminidase__InfluenzaA__ACV67181
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuuauuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccgugaugacagauggaccaucugacggccaggcuuccuacaaaauuuuucggaucgaaaaggguaaaauuauaaagucagucgagaugaaugcccccaacuaucauuacgaagagugcaguuguuacccugauagcuccgagaucacuugcgugugccgcgacaauuggcacgggucuaacagaccaugggugagcuucaaucagaaccucgaauaucagauuggauacaucuguucaggcaucuuuggcgauaauccgaggcccaacgacaaaaccgggaguugcggaccugucuccagcaauggugcgaacggcguuaagggguucucuuuuaaguauggaaacggcguguggauuggucggacaaaaucaauaaguagccgcaauggguucgagaugaucugggauccaaacggcuggaccggaacggacaauaacuuuuccauuaagcaagacaucguaggcauuaaugaauggucuggguacucggggagcuucgugcagcaucccgagcugacuggucuggauuguauccgaccuugcuucugggucgaacucauaagaggcaggccaaaagagaacacaaucuggaccuccgggucaaguauuucuuuuuguggagugaauagcgacacuguuggcugguccuggcccgauggugcagaguuaccguucacaaucgacaaguga

SEQ ID NO: 139361 - RNA, 1410 nt, Artificial Sequence; identical to SEQ ID NO: 139178
  derived and/or modified sequence opt3 from neuraminidase__InfluenzaA__ACV67182

SEQ ID NO: 139362 - RNA, 1410 nt, Artificial Sequence
  derived and/or modified sequence opt3 from neuraminidase__InfluenzaA__ACV67183
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuucggaucgaaaaggguaaaauugugaagucagucgagaugaacgcccccaauuaucauuacgaagagugcaguuguuacccugacagcaacgagaucacuugcguuugccgcgauaauuggcacggguccaacagaccaugggugucuuucaaucagaaccucgaauaucagauuggauacauauguagcggcaucuuuggcgacaauccgaggcccaacgauaaaaccgggucaugcggaccuguaaguuccaacggugcgaauggcgugaagggguucagcuuuaaguauggaaacggcgucuggauuggucggacaaaaucuaucaauucacgcaacggguucgagaugaucugggacccaaauggcuggaccggaacggauaacaauuuuaguauuaagcaagacauagugggcaucaacgaauggagcggguacuccggaucuuucguucagcaucccgagcugacuggucuggacuguauucgaccuugcuucuggguggaacucaucagaggcaggccaaaagagaauacaauuuggaccucggggagcuccaucucauuuuguggagucaacagugauacugugggcuggucuuggcccgacggugcagaguuaccguucacaauagauaaguga

SEQ ID NO: 139363 - RNA, 1410 nt, Artificial Sequence; identical to SEQ ID NO: 138754
  derived and/or modified sequence opt3 from neuraminidase__InfluenzaA__ACV67184

SEQ ID NO: 139364 - RNA, 1410 nt, Artificial Sequence; identical to SEQ ID NO: 138744
  derived and/or modified sequence opt3 from neuraminidase__InfluenzaA__ACV67186

SEQ ID NO: 139365 - RNA, 1410 nt, Artificial Sequence; identical to SEQ ID NO: 138754
  derived and/or modified sequence opt3 from neuraminidase__InfluenzaA__ACV67187

SEQ ID NO: 139366 - RNA, 1410 nt, Artificial Sequence; identical to SEQ ID NO: 138754
  derived and/or modified sequence opt3 from neuraminidase__InfluenzaA__ACV67188

SEQ ID NO: 139367 - RNA, 1410 nt, Artificial Sequence; identical to SEQ ID NO: 138784
  derived and/or modified sequence opt3 from neuraminidase__InfluenzaA__ACV67189

SEQ ID NO: 139368 - RNA, 1410 nt, Artificial Sequence; identical to SEQ ID NO: 138784
  derived and/or modified sequence opt3 from neuraminidase__InfluenzaA__ACV67190

SEQ ID NO: 139369 - RNA, 1410 nt, Artificial Sequence; identical to SEQ ID NO: 138744
  derived and/or modified sequence opt3 from neuraminidase__InfluenzaA__ACV67191

SEQ ID NO: 139370 - RNA, 1410 nt, Artificial Sequence; identical to SEQ ID NO: 138784
  derived and/or modified sequence opt3 from neuraminidase__InfluenzaA__ACV67192

SEQ ID NO: 139371 - RNA, 1410 nt, Artificial Sequence; identical to SEQ ID NO: 138784
  derived and/or modified sequence opt3 from neuraminidase__InfluenzaA__ACV67193

SEQ ID NO: 139372 - RNA, 1410 nt, Artificial Sequence; identical to SEQ ID NO: 138754
  derived and/or modified sequence opt3 from neuraminidase__InfluenzaA__ACV67194

SEQ ID NO: 139373 - RNA, 1410 nt, Artificial Sequence; identical to SEQ ID NO: 138754
  derived and/or modified sequence opt3 from neuraminidase__InfluenzaA__ACV67195

SEQ ID NO: 139374 - RNA, 1410 nt, Artificial Sequence; identical to SEQ ID NO: 138754
  derived and/or modified sequence opt3 from neuraminidase__InfluenzaA__ACV67196

SEQ ID NO: 139375 - RNA, 1410 nt, Artificial Sequence; identical to SEQ ID NO: 138744
  derived and/or modified sequence opt3 from neuraminidase__InfluenzaA__ACV67197

SEQ ID NO: 139376 - RNA, 1410 nt, Artificial Sequence; identical to SEQ ID NO: 138744
  derived and/or modified sequence opt3 from neuraminidase__InfluenzaA__ACV67199

SEQ ID NO: 139377 - RNA, 1410 nt, Artificial Sequence; identical to SEQ ID NO: 138744
  derived and/or modified sequence opt3 from neuraminidase__InfluenzaA__ACV67200

SEQ ID NO: 139378 - RNA, 1410 nt, Artificial Sequence; identical to SEQ ID NO: 138744
  derived and/or modified sequence opt3 from neuraminidase__InfluenzaA__ACV67201

SEQ ID NO: 139379 - RNA, 1410 nt, Artificial Sequence; identical to SEQ ID NO: 138744
  derived and/or modified sequence opt3 from neuraminidase__InfluenzaA__ACV67202

SEQ ID NO: 139380 - RNA, 1410 nt, Artificial Sequence; identical to SEQ ID NO: 138754
  derived and/or modified sequence opt3 from neuraminidase__InfluenzaA__ACV67203

SEQ ID NO: 139381 - RNA, 1410 nt, Artificial Sequence; identical to SEQ ID NO: 138754
  derived and/or modified sequence opt3 from neuraminidase__InfluenzaA__ACV67204

SEQ ID NO: 139382 - RNA, 1410 nt, Artificial Sequence; identical to SEQ ID NO: 138754
  derived and/or modified sequence opt3 from neuraminidase__InfluenzaA__ACV67205

SEQ ID NO: 139383 - RNA, 1410 nt, Artificial Sequence
  derived and/or modified sequence opt3 from neuraminidase__InfluenzaA__ACV67206
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccaugguaucugugaaacuggccggaaauucgucauugugcccugucagcggaugggcgauauacaguaaggacaacuccgugagaauuggcucuaaaggugauguuuuugugaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggucccaucucccuacaacucccguuuugaaucaguggccuggagcgcaagugccugccacgacggcauuaauuggcuuacaauagggaucucuggaccugauaacggugcuguagcaguucugaaguauaauggcauuaucaccgacacgauaaaguccuggagaaacaauauuuugaggacucaagagagcgagugugccugcgugaacgggucguguuucaccgucaugacagauggaccaucuaauggccaggcuuccuacaaaaucuuucggaucgaaaaggguaaaauugugaagucaguggagaugaacgcccccaauuauuacuacgaagagugcaguuguuauccugacagcuccgagaucacuugcgucugccgcgauaacuggcaugggucuaauagaccauggguuagcuucaaccagaaucucgaauaccagauuggauauauauguucaggcaucuuuggcgacaacccgaggcccaaugauaaaaccgggaguugcggaccuguguccagcaacggugcgaacggcguaaagggguucucuuuuaaguacggaaauggcguguggauuggucggacaaaaucaaucaguagccgcaacggguucgagaugaucugggacccaaauggcuggaccggaacggauaacaauuuuuccauuaagcaagacauagucggcaucaacgaauggucuggguauucggggagcuucgugcagcaccccgagcugacuggucuggacuguauucgaccuugcuucuggguugaacucaucagaggcaggccaaaagagaauacaauuuggaccuccgggucaaguaucucuuuuuguggagugaacagcgauacugucggcugguccuggcccgacggugcagaguuaccguucacaauagauaaguga

SEQ ID NO: 139384 - RNA, 1410 nt, Artificial Sequence; identical to SEQ ID NO: 138744
  derived and/or modified sequence opt3 from neuraminidase__InfluenzaA__ACV67207

SEQ ID NO: 139385 - RNA, 1410 nt, Artificial Sequence; identical to SEQ ID NO: 138754
  derived and/or modified sequence opt3 from neuraminidase__InfluenzaA__ACV67208

SEQ ID NO: 139386 - RNA, 1410 nt, Artificial Sequence; identical to SEQ ID NO: 138744
  derived and/or modified sequence opt3 from neuraminidase__InfluenzaA__ACV67210

SEQ ID NO: 139387 - RNA, 1410 nt, Artificial Sequence; identical to SEQ ID NO: 138754
  derived and/or modified sequence opt3 from neuraminidase__InfluenzaA__ACV67211

SEQ ID NO: 139388 - RNA, 1410 nt, Artificial Sequence; identical to SEQ ID NO: 138754
  derived and/or modified sequence opt3 from neuraminidase__InfluenzaA__ACV70076

SEQ ID NO: 139389 - RNA, 1410 nt, Artificial Sequence
  derived and/or modified sequence opt3 from neuraminidase__InfluenzaA__ACV70086
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaaguauuaucacguacgaaaauaacaccugggucaaucagacauauguuaacauaagcaauacuaacuucgcugcaggccaguccgugguaucugugaaacuggccggaaauucgucauugugcccugucagcggaugggcgauuuacaguaaggacaacuccgugagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucuaauggccaggcuuccuacaaaaucuuucggauugaaaaggguaaaaucgugaagucaguggagaugaacgcccccaauuaucauuacgaagagugcaguuguuacccugacagcuccgagauuacuugcgucugccgcgauaacuggcacgggucuaauagaccauggguuagcuucaaccagaaucucgaauaucagauaggauacaucuguucaggcauuuuuggcgacaacccgaggcccaaugauaaaaccgggaguugcggaccuguguccagcaacggugcgaacggcguaaagggguucucuuuuaaguauggaaauggcguguggaucggucggacaaaaucaaucaguagccgcaacggguucgagaugauuugggacccaaauggcuggaccggaacggauaacaauuuuuccauaaagcaagacaucgucggcauuaacgaauggucuggguacucggggagcuucgugcagcaucccgagcugacuggucuggacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 139390 - RNA, 1410 nt, Artificial Sequence
  derived and/or modified sequence opt3 from neuraminidase__InfluenzaA__ACV70096
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucaccgcuggccaguccguagugucugucaaacuggcaggaaauucgucauugugcccugugagcggaugggccauauacaguaaggacaacuccauuagaaucggcucuaaaggugauguuuuugugauuagggagccauucaucagcuguuccccguuagaaugccggacauuuuuccugacccagggggcgcuacucaaugacaagcauucaaacggaacuaucaaagaucgcagucccuaucgaacacugaugagcuguccuauuggcgaggucccaucucccuacaacucccguuuugaaucaguggcuuggagcgccagugcaugccacgacggcauaaauuggcuuaccaucgggauuucuggaccugauaacggugccguagcuguucugaaguauaauggcaucauaacggacacuauuaaguccuggagaaacaauaucuugaggacccaagagagcgagugugcaugcgugaacgggucguguuucacagucaugacugauggaccaucugacggccaggccuccuacaaaaucuuucggauugaaaaggguaaaaucgugaagucaguggagaugaaugcucccaacuaucauuacgaagagugcaguuguuacccugauagcuccgagauuaccugcgucugccgcgacaauuggcacgggucuaacagaccauggguuagcuucaaucagaaccucgaauaucagauaggauacaucuguucaggcauuuuuggcgauaauccgaggcccaacgacaaaacagggaguugcggaccuguguccagcaauggugccaacggcguaaagggguucucuuuuaaguauggaaacggcguguggaucggucggaccaaaucaaucaguagccgcaauggguucgagaugauuugggauccaaacggcuggacgggaacugacaauaacuuuuccauaaagcaagacaucgucggcauuaaugaauggucuggguacucggggagcuucgugcagcaucccgagcugacaggucuggauuguauccgaccuugcuucuggguugaacucauuagaggcaggccaaaagagaacaccaucuggacuuccgggucaaguauaucuuuuuguggagugaauagcgacacagucggcugguccuggcccgauggugcggaguuaccguucaccaucgacaaguga

SEQ ID NO: 139391 - RNA, 1410 nt, Artificial Sequence; identical to SEQ ID NO: 138754
  derived and/or modified sequence opt3 from neuraminidase__InfluenzaA__ACV70106

SEQ ID NO: 139392 - RNA, 1410 nt, Artificial Sequence; identical to SEQ ID NO: 138754
  derived and/or modified sequence opt3 from neuraminidase__InfluenzaA__ACV70116

SEQ ID NO: 139393 - RNA, 1410 nt, Artificial Sequence; identical to SEQ ID NO: 138754
  derived and/or modified sequence opt3 from neuraminidase__InfluenzaA__ACV70126

SEQ ID NO: 139394 - RNA, 1410 nt, Artificial Sequence; identical to SEQ ID NO: 138754
  derived and/or modified sequence opt3 from neuraminidase__InfluenzaA__ACV70157

SEQ ID NO: 139395 - RNA, 1410 nt, Artificial Sequence; identical to SEQ ID NO: 138744
  derived and/or modified sequence opt3 from neuraminidase__InfluenzaA__ACV70167

SEQ ID NO: 139396 - RNA, 1410 nt, Artificial Sequence; identical to SEQ ID NO: 138754
  derived and/or modified sequence opt3 from neuraminidase__InfluenzaA__ACV70177

SEQ ID NO: 139397 - RNA, 1410 nt, Artificial Sequence; identical to SEQ ID NO: 138754
  derived and/or modified sequence opt3 from neuraminidase__InfluenzaA__ACV70187

SEQ ID NO: 139398 - RNA, 1410 nt, Artificial Sequence; identical to SEQ ID NO: 138754
  derived and/or modified sequence opt3 from neuraminidase__InfluenzaA__ACV70197

SEQ ID NO: 139399 - RNA, 1410 nt, Artificial Sequence; identical to SEQ ID NO: 138754
  derived and/or modified sequence opt3 from neuraminidase__InfluenzaA__ACV70207

SEQ ID NO: 139400 - RNA, 1410 nt, Artificial Sequence
  derived and/or modified sequence opt3 from neuraminidase__InfluenzaA__ACV70217
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguucccauuuagaaugccggaccuuuuuccugacacagggggcucuacucaaugacaagcacucaaacggaaccaucaaagaucgcaguccguaucgaacucugaugagcugucccaucggcgaggugccuucuccauacaacucccguuuugaaucaguagccuggagcgcaagugccugccaugacggcauuaauuggcuuacaauagggaucucuggacccgauaacggugcuguugcagugcugaaguauaauggcauuaucaccgacacgauaaaguccuggagaaacaauauuuugaggacucaagagagcgagugugccugcgucaacgggucguguuucaccgugaugacagauggaccuucuaauggccaggcuuccuacaaaaucuuucggaucgaaaaggguaaaauugugaagucagucgagaugaacgccccaaauuaucacuacgaagagugcaguuguuaccccgacagcuccgagaucacuugcguuugccgcgauaacuggcaugggucuaauagaccuugggugagcuucaaccagaaucucgaauaucagauuggauacauauguucaggcaucuuuggcgacaacccaaggccgaaugauaaaaccgggaguugcggacccguauccagcaacggugcgaacggcgugaagggguucucuuuuaaguauggaaauggcgucuggauuggucggacaaaaucaaucaguagccgcaacggguucgagaugaucugggacccuaauggcuggaccggaacggauaacaauuuuuccauuaagcaagacauagugggcaucaacgaauggucuggguacucggggagcuucguucagcacccagagcugacuggucuggacuguauucgacccugcuucuggguggaacucaucagaggcaggccuaaagagaauacaauuuggaccuccgggucaaguaucucuuuuuguggagucaacagcgauacugugggcugguccuggccagacggugcagaguuacccuucacaauagauaaguga

SEQ ID NO: 139401 - RNA, 1410 nt, Artificial Sequence; identical to SEQ ID NO: 138754
  derived and/or modified sequence opt3 from neuraminidase__InfluenzaA__ACV70227

SEQ ID NO: 139402 - RNA, 1410 nt, Artificial Sequence; identical to SEQ ID NO: 138754
  derived and/or modified sequence opt3 from neuraminidase__InfluenzaA__ACV70237

SEQ ID NO: 139403 - RNA, 1410 nt, Artificial Sequence; identical to SEQ ID NO: 138754
  derived and/or modified sequence opt3 from neuraminidase__InfluenzaA__ACV70247

SEQ ID NO: 139404 - RNA, 1410 nt, Artificial Sequence; identical to SEQ ID NO: 138754
  derived and/or modified sequence opt3 from neuraminidase__InfluenzaA__ACV70257

SEQ ID NO: 139405 - RNA, 1410 nt, Artificial Sequence; identical to SEQ ID NO: 138754
  derived and/or modified sequence opt3 from neuraminidase__InfluenzaA__ACV70267

SEQ ID NO: 139406 - RNA, 1410 nt, Artificial Sequence; identical to SEQ ID NO: 138754
  derived and/or modified sequence opt3 from neuraminidase__InfluenzaA__ACV70277

SEQ ID NO: 139407 - RNA, 1410 nt, Artificial Sequence; identical to SEQ ID NO: 138754
  derived and/or modified sequence opt3 from neuraminidase__InfluenzaA__ACV70287

SEQ ID NO: 139408 - RNA, 1410 nt, Artificial Sequence; identical to SEQ ID NO: 138754
  derived and/or modified sequence opt3 from neuraminidase__InfluenzaA__ACV70297

SEQ ID NO: 139409 - RNA, 1410 nt, Artificial Sequence; identical to SEQ ID NO: 138754
  derived and/or modified sequence opt3 from neuraminidase__InfluenzaA__ACV70307

SEQ ID NO: 139410 - RNA, 1410 nt, Artificial Sequence; identical to SEQ ID NO: 138744
  derived and/or modified sequence opt3 from neuraminidase__InfluenzaA__ACV70317

SEQ ID NO: 139411 - RNA, 1410 nt, Artificial Sequence; identical to SEQ ID NO: 138754
  derived and/or modified sequence opt3 from neuraminidase__InfluenzaA__ACV70327

SEQ ID NO: 139412 - RNA, 1410 nt, Artificial Sequence; identical to SEQ ID NO: 138754
  derived and/or modified sequence opt3 from neuraminidase__InfluenzaA__ACV70337

SEQ ID NO: 139413 - RNA, 1410 nt, Artificial Sequence; identical to SEQ ID NO: 138754
  derived and/or modified sequence opt3 from neuraminidase__InfluenzaA__ACV70347

SEQ ID NO: 139414 - RNA, 1410 nt, Artificial Sequence; identical to SEQ ID NO: 138754
  derived and/or modified sequence opt3 from neuraminidase__InfluenzaA__ACV70357

SEQ ID NO: 139415 - RNA, 1410 nt, Artificial Sequence; identical to SEQ ID NO: 138754
  derived and/or modified sequence opt3 from neuraminidase__InfluenzaA__ACV70367

SEQ ID NO: 139416 - RNA, 1410 nt, Artificial Sequence; identical to SEQ ID NO: 138754
  derived and/or modified sequence opt3 from neuraminidase__InfluenzaA__ACV70377

SEQ ID NO: 139417 - RNA, 1410 nt, Artificial Sequence; identical to SEQ ID NO: 138754
  derived and/or modified sequence opt3 from neuraminidase__InfluenzaA__ACV70387

SEQ ID NO: 139418 - RNA, 1410 nt, Artificial Sequence; identical to SEQ ID NO: 138754
  derived and/or modified sequence opt3 from neuraminidase__InfluenzaA__ACV70397

SEQ ID NO: 139419 - RNA, 1410 nt, Artificial Sequence; identical to SEQ ID NO: 138754
  derived and/or modified sequence opt3 from neuraminidase__InfluenzaA__ACV70407

SEQ ID NO: 139420 - RNA, 1410 nt, Artificial Sequence; identical to SEQ ID NO: 138744
  derived and/or modified sequence opt3 from neuraminidase__InfluenzaA__ACV70417

SEQ ID NO: 139421 - RNA, 1410 nt, Artificial Sequence; identical to SEQ ID NO: 138754
  derived and/or modified sequence opt3 from neuraminidase__InfluenzaA__ACV70427

SEQ ID NO: 139422 - RNA, 1410 nt, Artificial Sequence; identical to SEQ ID NO: 138754
  derived and/or modified sequence opt3 from neuraminidase__InfluenzaA__ACV70437

SEQ ID NO: 139423 - RNA, 1410 nt, Artificial Sequence; identical to SEQ ID NO: 138754
  derived and/or modified sequence opt3 from neuraminidase__InfluenzaA__ACV70447

SEQ ID NO: 139424 - RNA, 1410 nt, Artificial Sequence; identical to SEQ ID NO: 138754
  derived and/or modified sequence opt3 from neuraminidase__InfluenzaA__ACV70457

SEQ ID NO: 139425 - RNA, 1410 nt, Artificial Sequence; identical to SEQ ID NO: 138754
  derived and/or modified sequence opt3 from neuraminidase__InfluenzaA__ACV70467

SEQ ID NO: 139426 - RNA, 1410 nt, Artificial Sequence; identical to SEQ ID NO: 138754
  derived and/or modified sequence opt3 from neuraminidase__InfluenzaA__ACV70477

SEQ ID NO: 139427 - RNA, 1410 nt, Artificial Sequence; identical to SEQ ID NO: 138754
  derived and/or modified sequence opt3 from neuraminidase__InfluenzaA__ACV70487

SEQ ID NO: 139428 - RNA, 1410 nt, Artificial Sequence; identical to SEQ ID NO: 138754
  derived and/or modified sequence opt3 from neuraminidase__InfluenzaA__ACV70497

SEQ ID NO: 139429 - RNA, 1410 nt, Artificial Sequence; identical to SEQ ID NO: 138754
  derived and/or modified sequence opt3 from neuraminidase__InfluenzaA__ACV70507

SEQ ID NO: 139430 - RNA, 1410 nt, Artificial Sequence; identical to SEQ ID NO: 138754
  derived and/or modified sequence opt3 from neuraminidase__InfluenzaA__ACV70517

SEQ ID NO: 139431 - RNA, 1410 nt, Artificial Sequence; identical to SEQ ID NO: 138754
  derived and/or modified sequence opt3 from neuraminidase__InfluenzaA__ACV70527

SEQ ID NO: 139432 - RNA, 1410 nt, Artificial Sequence; identical to SEQ ID NO: 138754
  derived and/or modified sequence opt3 from neuraminidase__InfluenzaA__ACV70547

SEQ ID NO: 139433 - RNA, 1410 nt, Artificial Sequence; identical to SEQ ID NO: 138754
  derived and/or modified sequence opt3 from neuraminidase__InfluenzaA__ACV70557

SEQ ID NO: 139434 - RNA, 1410 nt, Artificial Sequence; identical to SEQ ID NO: 138754
  derived and/or modified sequence opt3 from neuraminidase__InfluenzaA__ACV70567

SEQ ID NO: 139435 - RNA, 1410 nt, Artificial Sequence; identical to SEQ ID NO: 138754
  derived and/or modified sequence opt3 from neuraminidase__InfluenzaA__ACV70577

SEQ ID NO: 139436 - RNA, 1410 nt, Artificial Sequence; identical to SEQ ID NO: 138754
  derived and/or modified sequence opt3 from neuraminidase__InfluenzaA__ACV70587

SEQ ID NO: 139437 - RNA, 1410 nt, Artificial Sequence; identical to SEQ ID NO: 138744
  derived and/or modified sequence opt3 from neuraminidase__InfluenzaA__ACV70597

SEQ ID NO: 139438 - RNA, 1410 nt, Artificial Sequence; identical to SEQ ID NO: 138754
  derived and/or modified sequence opt3 from neuraminidase__InfluenzaA__ACV70607

SEQ ID NO: 139439 - RNA, 1410 nt, Artificial Sequence; identical to SEQ ID NO: 139337
  derived and/or modified sequence opt3 from neuraminidase__InfluenzaA__ACV70617

SEQ ID NO: 139440 - RNA, 1410 nt, Artificial Sequence; identical to SEQ ID NO: 138754
  derived and/or modified sequence opt3 from neuraminidase__InfluenzaA__ACV70647

SEQ ID NO: 139441 - RNA, 1410 nt, Artificial Sequence; identical to SEQ ID NO: 138754
  derived and/or modified sequence opt3 from neuraminidase__InfluenzaA__ACV70657

SEQ ID NO: 139442 - RNA, 1410 nt, Artificial Sequence; identical to SEQ ID NO: 138754
  derived and/or modified sequence opt3 from neuraminidase__InfluenzaA__ACV70667

SEQ ID NO: 139443 - RNA, 1410 nt, Artificial Sequence; identical to SEQ ID NO: 138754
  derived and/or modified sequence opt3 from neuraminidase__InfluenzaA__ACV70677

SEQ ID NO: 139444 - RNA, 1410 nt, Artificial Sequence; identical to SEQ ID NO: 138754
  derived and/or modified sequence opt3 from neuraminidase__InfluenzaA__ACV70687

SEQ ID NO: 139445 - RNA, 1410 nt, Artificial Sequence; identical to SEQ ID NO: 138754
  derived and/or modified sequence opt3 from neuraminidase__InfluenzaA__ACV70697

SEQ ID NO: 139446 - RNA, 1410 nt, Artificial Sequence; identical to SEQ ID NO: 138754
  derived and/or modified sequence opt3 from neuraminidase__InfluenzaA__ACV70707

SEQ ID NO: 139447 - RNA, 1410 nt, Artificial Sequence; identical to SEQ ID NO: 138754
  derived and/or modified sequence opt3 from neuraminidase__InfluenzaA__ACV70717

SEQ ID NO: 139448 - RNA, 1410 nt, Artificial Sequence; identical to SEQ ID NO: 138754
  derived and/or modified sequence opt3 from neuraminidase__InfluenzaA__ACV70727

SEQ ID NO: 139449 - RNA, 1410 nt, Artificial Sequence; identical to SEQ ID NO: 138754
  derived and/or modified sequence opt3 from neuraminidase__InfluenzaA__ACV70737

SEQ ID NO: 139450 - RNA, 1410 nt, Artificial Sequence; identical to SEQ ID NO: 138754
  derived and/or modified sequence opt3 from neuraminidase__InfluenzaA__ACV70757

SEQ ID NO: 139451 - RNA, 1410 nt, Artificial Sequence; identical to SEQ ID NO: 138754
  derived and/or modified sequence opt3 from neuraminidase__InfluenzaA__ACV70767

SEQ ID NO: 139452 - RNA, 1410 nt, Artificial Sequence; identical to SEQ ID NO: 138754
  derived and/or modified sequence opt3 from neuraminidase__InfluenzaA__ACV70777

SEQ ID NO: 139453 - RNA, 1410 nt, Artificial Sequence; identical to SEQ ID NO: 138754
  derived and/or modified sequence opt3 from neuraminidase__InfluenzaA__ACV70787

SEQ ID NO: 139454 - RNA, 1410 nt, Artificial Sequence; identical to SEQ ID NO: 138754
  derived and/or modified sequence opt3 from neuraminidase__InfluenzaA__ACV70797

SEQ ID NO: 139455 - RNA, 1410 nt, Artificial Sequence; identical to SEQ ID NO: 138754
  derived and/or modified sequence opt3 from neuraminidase__InfluenzaA__ACV70807

SEQ ID NO: 139456 - RNA, 1410 nt, Artificial Sequence; identical to SEQ ID NO: 138754
  derived and/or modified sequence opt3 from neuraminidase__InfluenzaA__ACV70817

SEQ ID NO: 139457 - RNA, 1410 nt, Artificial Sequence; identical to SEQ ID NO: 138744
  derived and/or modified sequence opt3 from neuraminidase__InfluenzaA__ACV70827

SEQ ID NO: 139458 - RNA, 1410 nt, Artificial Sequence; identical to SEQ ID NO: 138754
  derived and/or modified sequence opt3 from neuraminidase__InfluenzaA__ACV70837

SEQ ID NO: 139459 - RNA, 1410 nt, Artificial Sequence
  derived and/or modified sequence opt3 from neuraminidase__InfluenzaA__ACV70847
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaugagcuguuccccguuagaaugccggaccuuuuuccugacacagggggcucuacucaaugacaagcauucaaacggaaccaucaaagaucgcagucccuaucgaacucugaugagcuguccuaucggcgaggucccaucucccuacaacucccguuuugaaucaguggccuggagcgcaagugccugccacgacggcauuaauuggcuuacaauagggaucucuggaccugauaacggugcuguagcaguucugaaguauaauggcauuaucaccgacacgauaaaguccuggagaaacaauauuuugaggacucaagagagcgagugugccugcgugaacgggucguguuucaccgucaugacagauggaccaucugacggccaggcuuccuacaaaaucuuucggaucgaaaaggguaaaauugugaagucaguggagaugaaugcccccaacuaucauuacgaagagugcaguuguuacccugauagcuccgagaucacuugcgucugccgcgacaauuggcacgggucuaacagaccauggguuagcuucaaucagaaccucgaauaucagauuggauacauauguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucuggauuguauucgaccuugcuucuggguugaacucaucagaggcaggccaaaagagaacacaauuuggaccuccgggucaaguaucucuuuuuguggagugaauagcgacacugucggcugguccuggcccgauggugcagaguuaccguucacaauagacaaguga

SEQ ID NO: 139460 - RNA, 1410 nt, Artificial Sequence; identical to SEQ ID NO: 138754
  derived and/or modified sequence opt3 from neuraminidase__InfluenzaA__ACV70867

SEQ ID NO: 139461 - RNA, 1410 nt, Artificial Sequence; identical to SEQ ID NO: 138754
  derived and/or modified sequence opt3 from neuraminidase__InfluenzaA__ACV70877

SEQ ID NO: 139462 - RNA, 1410 nt, Artificial Sequence
  derived and/or modified sequence opt3 from neuraminidase__InfluenzaA__ACV70887
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccaugguaucugugaaacuggccggaaauucgucauugugcccugucagcggaugggcgauauacaguaaggacaacuccgugagaauuggcucuaaaggugauguuuuugugaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggucccaucucccuacaacucccguuuugaaucaguggccuggagcgcaagugccugccacgacggcauuaauuggcuuacaauagggaucucuggaccugauaacggugcuguagcaguucugaaguauaauggcauuaucaccgacacgauaaaguccuggagaaacaauauuuugaggacucaagagagcgagugugccugcgugaacgggucguguuucaccgucaugacagauggaccaucuaauggccaggcuuccuacaaaaucuuucggaucgaaaaggguaaaauugugaagucaguggagaugaacgcccccaauuaucauuacgaagagugcaguuguuacccugacagcuccgagaucacuugcgucugccgcgauaacuggcacgggucuaauagaccauggguuagcuucaaccagaaucucgaauaucagauuggauacauauguucaggcaucuuuggcgacaacccgaggcccaaugauaaaaccgggaguugcggaccuguguccagcaacggugcgaacggcguaaagggguucucuuuuaaguauggaaauggcguguggauuggucggacaaaaucaaucaguagccgcaacggguucgagaugaucugggacccaaauggcuggaccggaacggauaacaauuuuuccauuaagcaagacauagucggcaucaacgaauggucuggguacucggggagcuucgugcagcaucccgagcugacuggucuggacuguauucgaccuugcuucuggguugaacucaucagaggcaggccaaaagagaauacaauuuggaccuccgggucaaguaucucuuuuuguggagugaacagcgauacugucggcugguccuggcccgacggugcagaguuaccguucacaauagauaaguga

SEQ ID NO: 139463 - RNA, 1410 nt, Artificial Sequence; identical to SEQ ID NO: 138754
  derived and/or modified sequence opt3 from neuraminidase__InfluenzaA__ACV70897

SEQ ID NO: 139464 - RNA, 1410 nt, Artificial Sequence; identical to SEQ ID NO: 138754
  derived and/or modified sequence opt3 from neuraminidase__InfluenzaA__ACV70907

SEQ ID NO: 139465 - RNA, 1410 nt, Artificial Sequence; identical to SEQ ID NO: 138754
  derived and/or modified sequence opt3 from neuraminidase__InfluenzaA__ACV70917

SEQ ID NO: 139466 - RNA, 1410 nt, Artificial Sequence; identical to SEQ ID NO: 138744
  derived and/or modified sequence opt3 from neuraminidase__InfluenzaA__ACV70927

SEQ ID NO: 139467 - RNA, 1410 nt, Artificial Sequence; identical to SEQ ID NO: 138754
  derived and/or modified sequence opt3 from neuraminidase__InfluenzaA__ACV70937

SEQ ID NO: 139468 - RNA, 1410 nt, Artificial Sequence; identical to SEQ ID NO: 138754
  derived and/or modified sequence opt3 from neuraminidase__InfluenzaA__ACV70947

SEQ ID NO: 139469 - RNA, 1410 nt, Artificial Sequence; identical to SEQ ID NO: 138754
  derived and/or modified sequence opt3 from neuraminidase__InfluenzaA__ACV70957

SEQ ID NO: 139470 - RNA, 1410 nt, Artificial Sequence; identical to SEQ ID NO: 138754
  derived and/or modified sequence opt3 from neuraminidase__InfluenzaA__ACV70967

SEQ ID NO: 139471 - RNA, 1410 nt, Artificial Sequence; identical to SEQ ID NO: 138754
  derived and/or modified sequence opt3 from neuraminidase__InfluenzaA__ACV70977

SEQ ID NO: 139472 - RNA, 1410 nt, Artificial Sequence; identical to SEQ ID NO: 138754
  derived and/or modified sequence opt3 from neuraminidase__InfluenzaA__ACV70987

SEQ ID NO: 139473 - RNA, 1410 nt, Artificial Sequence; identical to SEQ ID NO: 138754
  derived and/or modified sequence opt3 from neuraminidase__InfluenzaA__ACV71007

SEQ ID NO: 139474 - RNA, 1410 nt, Artificial Sequence; identical to SEQ ID NO: 138615
  derived and/or modified sequence opt3 from neuraminidase__InfluenzaA__ACV82218

SEQ ID NO: 139475 - RNA, 1410 nt, Artificial Sequence; identical to SEQ ID NO: 138615
  derived and/or modified sequence opt3 from neuraminidase__InfluenzaA__ACV82219

SEQ ID NO: 139476 - RNA, 1410 nt, Artificial Sequence
  derived and/or modified sequence opt3 from neuraminidase__InfluenzaA__ACV82220
augaaccccaaucagaagaucauuaccauaggcagcgugucccugacaaucucuacuauuugcuucuuuaugcagcucgccauccuuauuacgaccgucacacugcacuucaaacaguacgaguuuaacucaccuccaaauaaccagguuauguugugugaaccgacuaucauagagagaaauaucaccgaaauuguguauuuaacaaacaccacuaucgagaaggaaauuugccccaaacuggcugaguacaggaauuggaguaagccucagugugacaucacaggguucgcaccauuuagcaaagauaacuccauacggcuaucugccggaggugacauuuggguaacccgcgagcccuaugugucgugcgauccugacaaguguuaccaauucgcgcucggccaggggacgacucugaauaacguccauucaaauaacaccgugcgagaucguacaccauauagaacucuucugaugaaugaauugggaguucccuuucaccucggcaccaaacaggugugcaucgcuuggagcaguuacuccugucaugacgguaaggccuggcugcacgucugcauuacaggggaugacaagaacgcaaccgccucuuucaucuauaauggaaggcugguggauagcguaguuuccuggucaaaagagauccuccggacgcaggaaagugagugugugugcauuaacggcacuuguacagucgugaugaccgacggcagcgcuucugggaaggcagauacuaaaauauuauuuaucgaggaaggaaagauugugcauacauccacccugucagguagcgcccaacacgucgaggaaugcaguugcuacccucgcuacccaggcguuagaugugugugcagggacaacuggaaggggucuaaucggccgaucguagauauaaacauuaaagaccacuccaucgugagcucguaugucuguucuggacuugugggcgacacgccccgcaagaaugauuccucaaguagcucccauugcuuggacccuaacaaugaggaaggugggcacggaguuaaaggcugggcuuucgaugacggcaacgauguguggauggggcgaaccaucucugaaaagagcagacugggauacgagacauuuaaagucauugaggguuggucaaauccaaagaguaaacuacagaucaacaggcaagugauuguagaccggggcaaucguuccggguauagcggaauauucucuguugagggcaagucauguaucaaccgcugcuuuuacguggaacucauuagagguaggaaggagaaaacugaaguccuguggaccaguaauagcaucguggucuucugugggacauccggcacuuauggaaccggcucuuggcccgauggggccgacaucaaccuuaugccuauuuga

SEQ ID NO: 139477 - RNA, 1413 nt, Artificial Sequence
  derived and/or modified sequence opt3 from neuraminidase__InfluenzaA__ACV82221
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgggaauggcguguggaucggaagaacuaaauccaacaggcugcggaagggcuuugagaugauuugggaccccaauggguggacaaacaccgacagcgauuucucuguaaaacaggacguggucgcuauaacugauuggucaggauauagugguagcuuugugcagcacccugaacucacaggcuuagacugcauccgcccauguuucuggguugagcuggugcgagggcuucccagagaaaacaccacgauuuggaccuccggaucuucgaucagcuucugcggcgucaauuccgauacagccaacuggucauggccugacggugcagaguugccauuuacuauugauaaguga

SEQ ID NO: 139478 - RNA, 1410 nt, Artificial Sequence; identical to SEQ ID NO: 138754
  derived and/or modified sequence opt3 from neuraminidase__InfluenzaA__ACV88402

SEQ ID NO: 139479 - RNA, 1410 nt, Artificial Sequence; identical to SEQ ID NO: 138754
  derived and/or modified sequence opt3 from neuraminidase__InfluenzaA__ACV88412

SEQ ID NO: 139480 - RNA, 1410 nt, Artificial Sequence; identical to SEQ ID NO: 138744
  derived and/or modified sequence opt3 from neuraminidase__InfluenzaA__ACV88422

SEQ ID NO: 139481 - RNA, 1365 nt, Artificial Sequence
  derived and/or modified sequence opt3 from neuraminidase__InfluenzaA__ACV89505
augaaccccaaucagaagaucauuaccauaggcagcaucugccugguggucgggcucauuucccuuauccugcaaauuggaaacaucauaucuaucuggauuucacacaguauccagacagguagccagaaucauacuggcauuuguaaccagaauaucauaacguacaaaaacuccaccuggguuaaggacacaacuucugugauuuugaccggaaauucgucauuaugcccuaucagagggugggccauuuauagcaaagauaacaguaucaggaucggcuccaagggugacguauucgugauucgggagccauuuauaucuuguagccaccuggaaugccgcacauucuuucuaacccaaggggcucuccugaaugauaaacauuccucaggaacugucaaggaccgaaguccguaccgugcacuuaugagcugucccgugggcgaggccccuucuccauauaacuccagauucgaaucaguugcguggagcgcuagugccugccacgauggcaugggguggcugacaaucggaauuucuggucccgacaauggcgcaguggccgucuugaaguacaacgggaucauaaccgagacgauuaaauccuggaggaagaaaauccuccggacucaggaaagcgagugugcuugcgugaauggaucguguuuuaccaucaugacagauggcccuucugacggucuggcauccuauaagauuuucaaaaucgagaaggggaagguaacuaaaucaauugaacugaacgccccaaauagucauuacgaggaaugcagcuguuaucccgauaccggaaagguuaugugcgugugccgcgacaacuggcacggcuccaacagaccuugggucucuuuugaucagaaucucgacuaccagauaggcuacaucuguagcgggguguucggagauaacccaaggccggaggacgguacaggcucaugcgggcccguguaugucgacggagcuaauggcguuaaagguuuuaguuaccgguaugggaacggcguguggauuggacgcaccaagucccacagcucucgacauggcuucgagaugaucugggauccuaauggguggacggaaacugacucaaaauuuaguguaagacaagauguggucgccaugacagacuggagcggauacuccgguucuuucgugcagcacccagaguuaaccggccuggauuguaugaggcccugcuuuuggguugaacuuauccgggggcguccuaaggagggaacuauuuggacaucggcgagcuccauaucauucuguggcgugaacagugacaccgucgauuggucuuggccagacggugcagaauugcccuucagcaucgauaaauga

SEQ ID NO: 139482 - RNA, 1410 nt, Artificial Sequence; identical to SEQ ID NO: 138754
  derived and/or modified sequence opt3 from neuraminidase__InfluenzaA__ACV91673

SEQ ID NO: 139483 - RNA, 1410 nt, Artificial Sequence; identical to SEQ ID NO: 138754
  derived and/or modified sequence opt3 from neuraminidase__InfluenzaA__ACV91681

SEQ ID NO: 139484 - RNA, 1410 nt, Artificial Sequence
  derived and/or modified sequence opt3 from neuraminidase__InfluenzaA__ACX31593
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguucuguugugugaaccggcuauaaucgagagaaauauuacugaaaucguguauuuaaccaacacaaccauugagaaggaaaucugccccaaacuggcagaguacaggaauuggaguaagccucagugugacauaacuggguucgccccauuuagcaaagauaacuccauucggcuaucugcgggaggugacaucuggguaacacgcgagcccuaugugucgugcgauccugacaaguguuaccaauucgcucucggccaggggaccacgcugaauaacguccauucaaauaacacugugcgagaucguaccccauauagaacacuucugaugaaugaauugggaguucccuuucaccucggcacuaaacaggugugcauugccuggagcaguuccucuugucaugacgguaaggcauggcugcacgucugcaucaccggggaugacaagaacgccacagcuagcuucaucuacaauggaaggcugguggauuccguaguuucauggaguaaagagauucuccggacccaggaaagcgagugugugugcauaaacggcacguguacugucgugaugacagacggcucugcauccgggaaggccgauaccaaaaucuuauuuauugaggaaggaaagaucgugcauacuucaacacugagcgguagugcucaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuugugggcgacacccccaggaagaaugauucaaguagcuccucucauugcuuggacccuaacaaugaggaaggugggcacggaguuaaaggcugggccuucgaugacggcaacgauguguggauggggcgaacgauuagcgagaagucaagacugggauaugagaccuuuaaagucaucgaagguuggaguaauccaaaguccaaacuacagauuaaccgccaggugauaguagaccggggcaaucguagcggguacucuggaaucuucucaguugagggcaagaguuguauuaaccgcugcuuuuauguggaacucaucagagguaggaaggaggaaacagagguccuguggacuagcaauuccaucguggucuucugugggaccucuggcacauacggaacuggcucguggcccgauggggcggacauuaaccuuaugccuauauga

SEQ ID NO: 139485 - RNA, 1410 nt, Artificial Sequence; identical to SEQ ID NO: 138754
  derived and/or modified sequence opt3 from neuraminidase__InfluenzaA__ACX31901

SEQ ID NO: 139486 - RNA, 1410 nt, Artificial Sequence; identical to SEQ ID NO: 138754
  derived and/or modified sequence opt3 from neuraminidase__InfluenzaA__ACX31902

SEQ ID NO: 139487 - RNA, 1410 nt, Artificial Sequence; identical to SEQ ID NO: 138754
  derived and/or modified sequence opt3 from neuraminidase__InfluenzaA__ACX31905

SEQ ID NO: 139488 - RNA, 1410 nt, Artificial Sequence; identical to SEQ ID NO: 138754
  derived and/or modified sequence opt3 from neuraminidase__InfluenzaA__ACX31906

SEQ ID NO: 139489 - RNA, 1410 nt, Artificial Sequence; identical to SEQ ID NO: 138754
  derived and/or modified sequence opt3 from neuraminidase__InfluenzaA__ACX31907

SEQ ID NO: 139490 - RNA, 1410 nt, Artificial Sequence; identical to SEQ ID NO: 138754
  derived and/or modified sequence opt3 from neuraminidase__InfluenzaA__ACX31908

SEQ ID NO: 139491 - RNA, 1410 nt, Artificial Sequence; identical to SEQ ID NO: 138909
  derived and/or modified sequence opt3 from neuraminidase__InfluenzaA__ACX31909

SEQ ID NO: 139492 - RNA, 1410 nt, Artificial Sequence; identical to SEQ ID NO: 138754
  derived and/or modified sequence opt3 from neuraminidase__InfluenzaA__ACX31911

SEQ ID NO: 139493 - RNA, 1410 nt, Artificial Sequence; identical to SEQ ID NO: 138754
  derived and/or modified sequence opt3 from neuraminidase__InfluenzaA__ACX31912

SEQ ID NO: 139494 - RNA, 1410 nt, Artificial Sequence; identical to SEQ ID NO: 138754
  derived and/or modified sequence opt3 from neuraminidase__InfluenzaA__ACX31913

SEQ ID NO: 139495 - RNA, 1410 nt, Artificial Sequence; identical to SEQ ID NO: 138754
  derived and/or modified sequence opt3 from neuraminidase__InfluenzaA__ACX31914

SEQ ID NO: 139496 - RNA, 1410 nt, Artificial Sequence; identical to SEQ ID NO: 138754
  derived and/or modified sequence opt3 from neuraminidase__InfluenzaA__ACX31915

SEQ ID NO: 139497 - RNA, 1410 nt, Artificial Sequence; identical to SEQ ID NO: 138754
  derived and/or modified sequence opt3 from neuraminidase__InfluenzaA__ACX31916

SEQ ID NO: 139498 - RNA, 1410 nt, Artificial Sequence
  derived and/or modified sequence opt3 from neuraminidase__InfluenzaA__ACX31917
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucacugaucgcagucccuaucgaacacugaugagcuguccuauuggcgaggucccaucucccuacaacucccguuuugaaucaguggccuggagcgcaagugccugccacgacggcauaaauuggcuuaccaucgggauuucuggaccugauaacggugcuguagcaguucugaaauauaauggcaucauaacggacacuauuaaguccuggagaaacaauaucuugaggacccaagagagcgagugugccugcgugaacgggucguguuucacagucaugacugauggaccaucugacggccaggcuuccuacaagaucuuucggauugaaaaagguaagaucgugaaaucaguggagaugaaugcccccaacuaucauuacgaagagugcaguuguuacccugauagcuccgagauuaccugcgucugccgcgacaauuggcacgggucuaacagaccauggguuagcuucaaucagaaccucgaauaucagauaggauacaucuguucaggcauuuuuggcgauaauccgaggcccaacgacaagacagggaguugcggaccuguguccagcaauggugcgaacggcguaaaaggguucucuuuuaaguauggaaacggcguguggaucggucggaccaagucaaucaguagccgcaauggguucgagaugauuugggauccaaacggcuggacgggaacugacaauaacuuuuccauaaaacaagacaucgucggcauuaaugaauggucuggguacucggggagcuucgugcagcaucccgagcugacaggucuggauuguauccgaccuugcuucuggguugaacucauuagaggcaggccaaaggagaacaccaucuggacuuccgggucaaguauaucuuuuuguggagugaauagcgacacagucggcugguccuggcccgauggugcagaguuaccguucaccaucgacaaauga

SEQ ID NO: 139499 - RNA, 1410 nt, Artificial Sequence; identical to SEQ ID NO: 138754
  derived and/or modified sequence opt3 from neuraminidase__InfluenzaA__ACX31918

SEQ ID NO: 139500 - RNA, 1410 nt, Artificial Sequence; identical to SEQ ID NO: 138754
  derived and/or modified sequence opt3 from neuraminidase__InfluenzaA__ACX31919

SEQ ID NO: 139501 - RNA, 1410 nt, Artificial Sequence; identical to SEQ ID NO: 138754
  derived and/or modified sequence opt3 from neuraminidase__InfluenzaA__ACX31920

SEQ ID NO: 139502 - RNA, 1410 nt, Artificial Sequence; identical to SEQ ID NO: 139108
  derived and/or modified sequence opt3 from neuraminidase__InfluenzaA__ACX31922

SEQ ID NO: 139503 - RNA, 1410 nt, Artificial Sequence; identical to SEQ ID NO: 138754
  derived and/or modified sequence opt3 from neuraminidase__InfluenzaA__ACX31923

SEQ ID NO: 139504 - RNA, 1410 nt, Artificial Sequence; identical to SEQ ID NO: 138744
  derived and/or modified sequence opt3 from neuraminidase__InfluenzaA__ACX31924

SEQ ID NO: 139505 - RNA, 1410 nt, Artificial Sequence
  derived and/or modified sequence opt3 from neuraminidase__InfluenzaA__ACX31925
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucacccucaugacagauggaccaucugacggccaggcuuccuacaaaaucuuucggauugaaaaggguaaaaucgucaagucaguggagaugaaugcccccaacuaucauuacgaagagugcaguuguuacccugauagcuccgagauuacuugcgugugccgcgacaauuggcacgggucuaacagaccaugggucagcuucaaucagaaccuggaauaucagauaggauacaucuguucaggcauuuuuggcgauaauccgaggcccaacgacaaaaccgggaguugcggaccuguuuccagcaauggugcgaacggcgugaagggguucucuuuuaaguauggaaacggcguauggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguccagcaucccgagcugacuggucucgauuguauccgaccuugcuucuggguggaauuaauuagaggcaggccaaaagagaacacaaucuggaccuccgggucaaguauaucuuuuuguggaguuaauagcgacacugugggcugguccuggcccgauggugcagagcugccguucaucauugacaaguga

SEQ ID NO: 139506 - RNA, 1410 nt, Artificial Sequence; identical to SEQ ID NO: 138754
  derived and/or modified sequence opt3 from neuraminidase__InfluenzaA__ACX31926

SEQ ID NO: 139507 - RNA, 1410 nt, Artificial Sequence; identical to SEQ ID NO: 138754
  derived and/or modified sequence opt3 from neuraminidase__InfluenzaA__ACX31927

SEQ ID NO: 139508 - RNA, 1410 nt, Artificial Sequence
  derived and/or modified sequence opt3 from neuraminidase__InfluenzaA__ACX31928
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugagaacggcguaaagggguucucuuuuaaguauggaaacggcguguggaucggucggacaaaaucaaucaguagccgcaauggguucgaaaugauuugggauccaaacggcuggaccggaacggacaauaacuuuuccauaaagcaagacaucgucggcauuaaugaguggucuggguacucggggagcuucgugcagcaucccgaacugacuggucuggauuguauccgaccuugcuucuggguugagcucauuagaggcaggccaaaagagaacacaaucuggaccuccgggucaaguauaucuuuuuguggagugaauggcgacacugucgguuggagcuggcccgauggggcggaauuaccguucacaaucgacaaguga

SEQ ID NO: 139509 - RNA, 1410 nt, Artificial Sequence; identical to SEQ ID NO: 138784
  derived and/or modified sequence opt3 from neuraminidase__InfluenzaA__ACX31929

SEQ ID NO: 139510 - RNA, 1410 nt, Artificial Sequence; identical to SEQ ID NO: 139108
  derived and/or modified sequence opt3 from neuraminidase__InfluenzaA__ACX31930

SEQ ID NO: 139511 - RNA, 1410 nt, Artificial Sequence; identical to SEQ ID NO: 138754
  derived and/or modified sequence opt3 from neuraminidase__InfluenzaA__ACX31931

SEQ ID NO: 139512 - RNA, 1410 nt, Artificial Sequence; identical to SEQ ID NO: 138754
  derived and/or modified sequence opt3 from neuraminidase__InfluenzaA__ACX31932

SEQ ID NO: 139513 - RNA, 1410 nt, Artificial Sequence; identical to SEQ ID NO: 138754
  derived and/or modified sequence opt3 from neuraminidase__InfluenzaA__ACX35250

SEQ ID NO: 139514 - RNA, 1410 nt, Artificial Sequence; identical to SEQ ID NO: 138754
  derived and/or modified sequence opt3 from neuraminidase__InfluenzaA__ACX35260

SEQ ID NO: 139515 - RNA, 1410 nt, Artificial Sequence; identical to SEQ ID NO: 138754
  derived and/or modified sequence opt3 from neuraminidase__InfluenzaA__ACX35270

SEQ ID NO: 139516 - RNA, 1410 nt, Artificial Sequence
  derived and/or modified sequence opt3 from neuraminidase__InfluenzaA__ACX35280
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggauaugaaugcccccaacuaucauuacgaggaaugcaguuguuacccugacagcuccgagauuacuugcgucugccgcgauaauuggcacgggucuaacagaccauggguuagcuucaaucagaaccucgaguaucagauaggauacaucuguucaggcauuuuuggcgacaauccgaggcccaacgauaaaaccgggaguugcggaccuguguccagcaauggugcgaacggcguaaagggguucucuuuuaaguauggaaacggcguguggaucggucggacaaaaucaaucaguagccgcaauggguucgaaaugauuugggacccaaacggcuggaccggaacggacaauaacuuuuccauaaagcaagauaucgucggcauuaaugaguggucuggguacucggggagcuucgugcagcaucccgaacugacuggucuggacuguauccgaccuugcuucuggguugagcucauuagaggcaggccaaaagaaaacacaaucuggaccuccgggucaaguauaucuuuuuguggagugaauagcgauacugucggcugguccuggcccgacggugcagaguuaccguucacaaucgauaaguga

SEQ ID NO: 139517 - RNA, 1410 nt, Artificial Sequence; identical to SEQ ID NO: 138754
  derived and/or modified sequence opt3 from neuraminidase__InfluenzaA__ACX35290

SEQ ID NO: 139518 - RNA, 1410 nt, Artificial Sequence; identical to SEQ ID NO: 138754
  derived and/or modified sequence opt3 from neuraminidase__InfluenzaA__ACX35300

SEQ ID NO: 139519 - RNA, 1410 nt, Artificial Sequence
  derived and/or modified sequence opt3 from neuraminidase__InfluenzaA__ACX35310
augaaccccaaucagaagaucauuaccauaggcagcgugugcaugacaaucgggauggccaaccugauucuccaaaucggaaauauuaucuccauauggaucucucacucaauucagcuugguaaccagaaucagaucggcacuuguaaccaaagugucauuacguacgagaauaacaccuggguuaaucagacauaugugaacaucagcaauacuaacuucgcugcagggcaguccguagugucugucaaacuggccggaaauucgucauugugcccugugagcggcugggcgauauacaguaaggacaacuccauuagaaucgguucuaaaggggauguuuuugugauuagggaaccauucaucagcuguuccccguuagagugccggaccuuuuuccugacacagggagcucuacucaaugacaagcauucaaacggcaccaucaaagaucgcagucccuaucgaacucugaugagcuguccuauuggcgaagucccaucucccuacaacucccguuuugagucaguggccuggagcgcaagugccugccacgacgggauaaauuggcuuacaaucggaauuucugguccugauaacggcgcuguagcaguucugaaguauaaugggaucauaaccgacacgauuaaguccuggagaaacaauaucuugaggacucaagaaagcgagugugccugcgugaacggaucguguuucaccgucaugacagauggcccaucugacggucaggcuuccuacaaaaucuuucggauugagaaggggaaaaucgugaagucaguggaaaugaaugcccccaacuaucauuacgaggaaugcaguuguuacccugauagcuccgagauuacuugcgucugccgcgacaauuggcacggaucuaacagaccauggguuagcuucaaucagaaccucgaguaucagauaggcuacaucuguucaggcauuuuuggggauaauccgaggcccaacgacaaaaccggaaguugcgguccuguguccagcaauggcgcgaacgggguaaagggauucucuuuuaaguauggcaacgguguguggaucgggcggacaaaaucaaucaguagccgcaauggcuucgaaaugauuugggauccaaacggauggaccggcacggacaauaacuuuuccauaaagcaagacaucgucgggauuaaugaguggucuggauacucggguagcuucgugcagcaucccgaacugacuggccuggauuguauccgaccuugcuucuggguugagcucauuagagggaggccaaaagaaaacacaaucuggaccuccggaucaaguauaucuuuuuguggcgugaauagcgacacugucgguugguccuggcccgauggggcagaguuaccguucacaaucgacaaguga

SEQ ID NO: 139520 - RNA, 1410 nt, Artificial Sequence; identical to SEQ ID NO: 138754
  derived and/or modified sequence opt3 from neuraminidase__InfluenzaA__ACX35320

SEQ ID NO: 139521 - RNA, 1410 nt, Artificial Sequence
  derived and/or modified sequence opt3 from neuraminidase__InfluenzaA__ACX35330
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggucccaucucccuacaacucccguuuugaaucaguggccuggagcgcaagugccugccacgacggcaucaauuggcuuacaauugggaucucuggaccugauaacggugcuguagcaguucugaaguauaauggcauaauuaccgacacgaucaaguccuggagaaacaauaucuugaggacucaagagagcgagugugccugcgugaacgggucguguuucaccgucaugacagauggaccaucugacggccaggcuuccuacaaaauuuuucggaucgaaaaggguaaaauugugaagucaguggagaugaaugcccccaacuaucauuacgaagagugcaguuguuacccugauagcuccgagauaacuugcgucugccgcgacaauuggcacgggucuaacagaccauggguuagcuucaaucagaaccucgaauaucagaucggauacauuuguucaggcaucuuuggcgauaauccgaggcccaacgacaaaaccgggaguugcggaccuguguccagcaauggugcgaacggcguaaagggguucucuuuuaaguauggaaacggcguguggaucggucggacaaaaucaauuaguagccgcaauggguucgagaugauaugggauccaaacggcuggaccggaacggacaauaacuuuuccaucaagcaagacauugucggcaucaaugaauggucuggguacucggggagcuucgugcagcaucccgagcugacuggucuggauuguauucgaccuugcuucuggguugaacucaucagaggcaggccaaaagagaacacaauauggaccuccgggucaaguaucucuuuuuguggagugaauagcgacacugucggcugguccuggcccgauggugcagaguuaccguucacaauugacaaguga

SEQ ID NO: 139522 - RNA, 1410 nt, Artificial Sequence; identical to SEQ ID NO: 138754
  derived and/or modified sequence opt3 from neuraminidase__InfluenzaA__ACX48479

SEQ ID NO: 139523 - RNA, 1410 nt, Artificial Sequence; identical to SEQ ID NO: 138754
  derived and/or modified sequence opt3 from neuraminidase__InfluenzaA__ACX48481

SEQ ID NO: 139524 - RNA, 1410 nt, Artificial Sequence; identical to SEQ ID NO: 138754
  derived and/or modified sequence opt3 from neuraminidase__InfluenzaA__ACX55836

SEQ ID NO: 139525 - RNA, 1410 nt, Artificial Sequence
  derived and/or modified sequence opt3 from neuraminidase__InfluenzaA__ACX56269
augaaccccaagcagaaaaucauuaccauaggcagcgugugcaugacaaucgggauggccaaucugauucuccaaaucggaaacauuaucuccauauggaucucucacucaauucagcuugguaaucagaaccagaucgagacuuguaaucaaagugucauuacguacgaaaacaauaccuggguuaaccagacauaugugaauaucagcaacacuaauuucgcugcaggccaguccguagugucugucaagcuggccgggaacucgucauugugcccugugagcggaugggcgauauacaguaaagacaauuccauuagaaucggcucuaagggugauguuuuugugauuagggagccauucaucagcuguuccccguuagaaugccggaccuuuuuccugacacagggggcucuacucaacgacaaacauucaaauggaaccaucaaggaucgcagucccuaucgaacucugaugagcuguccuauuggcgaggucccaucucccuacaacucccguuuugaaucaguggccuggagcgcaagugccugccacgacggcauaaacuggcuuacaaucgggauuucuggaccugauaauggugcuguagcaguucugaaguauaacggcaucauaaccgacacgauuaaauccuggagaaauaacaucuugaggacucaagagagcgagugugccugcgugaaugggucguguuucaccgucaugacagauggaccaucugacggccaggcuuccuacaagaucuuucggauugaaaaagguaagaucgugaaaucaguggagaugaacgcccccaauuaucauuacgaagagugcaguuguuacccugauagcuccgagauuacuugcgucugccgcgacaacuggcacgggucuaauagaccauggguuagcuucaaccagaaucucgaauaucagauaggauacaucuguucaggcauuuuuggcgauaacccgaggcccaaugacaagaccgggaguugcggaccuguguccagcaacggugcgaauggcguaaagggguucucuuuuaaauauggaaacggcguguggaucggucggacaaagucaaucaguagccgcaacggguucgagaugauuugggauccaaauggcuggaccggaacggacaacaauuuuuccauaaaacaagacaucgucggcauuaacgaauggucuggguacucggguagcuucgugcagcaucccgagcugacuggacuggauuguauccgaccuugcuucuggguugaacucauuagaggcaggccaaaggagaauacaaucuggaccuccgggucaaguauaucuuuuuguggagugaacagcgacacugucggcugguccuggcccgauggugcagaguuaccguucacaaucgacaaauga

SEQ ID NO: 139526 - RNA, 1410 nt, Artificial Sequence
  derived and/or modified sequence opt3 from neuraminidase__InfluenzaA__ACX56270
augaaccccaagcagaaaaucauuaccauaggcagcgugugcaugacaaucgggauggccaaucugauucuccaaaucggaaacauuaucuccauauggaucucucacucaauucagcuugguaaucagaaccagaucgagacuuguaaucaaagugucauuacguacgaaaacaauaccuggguuaaccagacauaugugaauaucagcaacacuaauuucgcugcaggccaguccguagugucugucaagcuggccgggaacucgucauugugcccugugagcggaugggcgauauacaguaaagacaauuccauuagaaucggcucuaagggugauguuuuugugauuagggagccauucaucagcuguuccccguuagaaugccggaccuuuuuccugacacagggggcucuacucaacgacaaacauucaaauggaaccaucaaggaucgcagucccuaucgaacucugaugagcuguccuauuggcgaggucccaucucccuacaacucccguuuugaaucaguggccuggagcgcaagugccugccacgacggcauaaacuggcuuacaaucgggauuucuggaccugauaauggugcuguagcaguucugaaguauaacggcaucauaaccgacacgauuaaauccuggagaaauaacaucuugaggacucaagagagcgagugugccugcgugaaugggucguguuucaccgucaugacagauggaccaucugacggccaggcuuccuacaagaucuuucggauugaaaaagguaagaucgugaaaucaguggagaugaacgcccccaauuaucauuacgaagagugcaguuguuacccugauagcuccgagauuacuugcgucugccgcgacaacuggcacgggucuaauagaccauggguuagcuucaaccagaaucucgaauaucagauaggauacaucuguucaggcauuuuuggcgauaacccgaggcccaaugacaagaccgggaguugcggaccuguguccagcaacggugcgaauggcguaaagggguucucuuuuaaauauggaaacggcguguggaucggucggacaaagucaaucaguagccgcaacggguucgagaugauuugggauccaaauggcuggaccggaacggacaacaauuuuuccauaaaacaagacaucgucggcauuaacgaauggucuggguacucggguagcuucgugcagcaucccgagcugacuggacuggauuguauccgaccuugcuucuggguugaacucauuagaggcaggccaaaggagaauacaaucuggaccuccgggucaaguauaucuuuuuguggagugaacagcgacuccgucucauggagcuggcccgauggcgcagaguuaccguucacuaucgacaaauga

SEQ ID NO: 139527 - RNA, 1410 nt, Artificial Sequence
  derived and/or modified sequence opt3 from neuraminidase__InfluenzaA__ACX56271
augaaccccaagcagaaaaucauuaccauaggcagcgugugcaugacaaucgggauggccaaucugauucuccaaaucggaaacauuaucuccauauggaucucucacucaauucagcuugguaaucagaaccagaucgagacuuguaaucaaagugucauuacguacgaaaacaauaccuggguuaaccagacauaugugaauaucagcaacacuaaucuggcugcaggccaguccguagggucugugaaguuggccggaaacucgucauuaugcccugucagcggcugggcgauauacaguaaagacaauuccauuagaaucgguucuaagggggauguguucguuauuagggagccauuuaucagcuguuccccgcuggaaugccggaccuucuuucuaacacagggagcucuccugaacgacaaacauucaaauggcaccaucaaggaucgcagucccuaucgaacucuuaugagcuguccuauuggcgaggugccaucucccuacaacucccguuucgaaucagucgccuggagcgcaagugccugccacgacgggauaaacuggcugacaaucggaauuucugguccugauaauggcgcuguggcaguauugaaguauaacgggaucauaaccgacacgauuaaauccuggagaaauaacauccucaggacucaagagagcgagugugccugcguuaauggaucguguuuuaccgugaugacagauggcccaucugacggucaggcuuccuacaagaucuuccggauugaaaaagggaagaucgucaaaucaguggagaugaacgcccccaauuaucauuacgaagagugcaguuguuacccugauagcuccgagauuacuugcgugugccgcgacaacuggcacggaucuaauagaccaugggucagcuuuaaccagaaucuggaauaucagauaggcuacaucuguucaggcauuuucggggauaacccgaggcccaaugacaagaccggaaguugcgguccuguuuccagcaacggcgcgaauggggugaagggauuuucuuucaaauauggcaacgguguauggaucgggcggacaaagucaaucaguagccgcaacggcuuugagaugauuugggauccaaauggauggaccggcacggacaacaauuucuccauaaaacaagacaucguggggauuaacgaauggucuggauacucggguagcuuuguccagcaucccgagcugacuggccucgauuguauccgaccuugcuucuggguggaauuaauuagagggaggccaaaggagaauacaaucuggaccuccggaucaaguauaucuuucuguggcguuaacagcgacacuguggguugguccuggcccgauggggcagagcugccguuuacaaucgacaaauga

SEQ ID NO: 139528 - RNA, 1410 nt, Artificial Sequence; identical to SEQ ID NO: 138754
  derived and/or modified sequence opt3 from neuraminidase__InfluenzaA__ACX83579

SEQ ID NO: 139529 - RNA, 1410 nt, Artificial Sequence; identical to SEQ ID NO: 138754
  derived and/or modified sequence opt3 from neuraminidase__InfluenzaA__ACX85425

SEQ ID NO: 139530 - RNA, 1410 nt, Artificial Sequence; identical to SEQ ID NO: 138754
  derived and/or modified sequence opt3 from neuraminidase__InfluenzaA__ACX85426

SEQ ID NO: 139531 - RNA, 1410 nt, Artificial Sequence
  derived and/or modified sequence opt3 from neuraminidase__InfluenzaA__ACY02998
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucuaauggccaggcuuccuacaaaaucuuucggauugaaaaggguaaaaucgugaagucaguggagaugaacgcccccaauuaucauuacgaagagugcaguuguuacccugacagcggggagauuacuugcgucugccgcgauaacuggcacggauccaauagaccauggguuucuuucaaccagaaucucgaauaucagauaggcuacaucuguagcggcauuuuuggggacaacccgaggcccaaugauaaaaccggaucaugcgguccugugaguuccaacggcgcgaacgggguaaagggauucagcuuuaaguauggcaaugguguguggaucgggcggacaaaaucuaucucaagucgcaacggcuucgagaugauuugggacccaaauggauggaccggcacggauaacaauuuuagcauaaagcaagacaucgucgggauuaacgaaugguccggauacucugguucguucgugcagcaucccgagcugacuggccuggacuguauccgaccuugcuucuggguugaacucauuagagggaggccaaaagagaauacaaucuggaccagcggauccucaauaaguuuuuguggcgugaacucugauacugucgguuggagcuggcccgacggggcagaguuaccguucacaaucgauaaguga

SEQ ID NO: 139532 - RNA, 1410 nt, Artificial Sequence; identical to SEQ ID NO: 138754
  derived and/or modified sequence opt3 from neuraminidase__InfluenzaA__ACY03005

SEQ ID NO: 139533 - RNA, 1410 nt, Artificial Sequence; identical to SEQ ID NO: 138754
  derived and/or modified sequence opt3 from neuraminidase__InfluenzaA__ACY03008

SEQ ID NO: 139534 - RNA, 1410 nt, Artificial Sequence; identical to SEQ ID NO: 138754
  derived and/or modified sequence opt3 from neuraminidase__InfluenzaA__ACY03011

SEQ ID NO: 139535 - RNA, 1410 nt, Artificial Sequence; identical to SEQ ID NO: 138754
  derived and/or modified sequence opt3 from neuraminidase__InfluenzaA__ACY03012

SEQ ID NO: 139536 - RNA, 1410 nt, Artificial Sequence; identical to SEQ ID NO: 138754
  derived and/or modified sequence opt3 from neuraminidase__InfluenzaA__ACY03016

SEQ ID NO: 139537 - RNA, 1410 nt, Artificial Sequence; identical to SEQ ID NO: 138754
  derived and/or modified sequence opt3 from neuraminidase__InfluenzaA__ACY26194

SEQ ID NO: 139538 - RNA, 1410 nt, Artificial Sequence; identical to SEQ ID NO: 138754
  derived and/or modified sequence opt3 from neuraminidase__InfluenzaA__ACY26204

SEQ ID NO: 139539 - RNA, 1410 nt, Artificial Sequence; identical to SEQ ID NO: 138754
  derived and/or modified sequence opt3 from neuraminidase__InfluenzaA__ACY30123

SEQ ID NO: 139540 - RNA, 1410 nt, Artificial Sequence; identical to SEQ ID NO: 138754
  derived and/or modified sequence opt3 from neuraminidase__InfluenzaA__ACY30124

SEQ ID NO: 139541 - RNA, 1410 nt, Artificial Sequence; identical to SEQ ID NO: 138754
  derived and/or modified sequence opt3 from neuraminidase__InfluenzaA__ACY30125

SEQ ID NO: 139542 - RNA, 1410 nt, Artificial Sequence; identical to SEQ ID NO: 138754
  derived and/or modified sequence opt3 from neuraminidase__InfluenzaA__ACY30127

SEQ ID NO: 139543 - RNA, 1410 nt, Artificial Sequence; identical to SEQ ID NO: 138754
  derived and/or modified sequence opt3 from neuraminidase__InfluenzaA__ACY30128

SEQ ID NO: 139544 - RNA, 1410 nt, Artificial Sequence; identical to SEQ ID NO: 138754
  derived and/or modified sequence opt3 from neuraminidase__InfluenzaA__ACY46105

SEQ ID NO: 139545 - RNA, 1410 nt, Artificial Sequence; identical to SEQ ID NO: 138754
  derived and/or modified sequence opt3 from neuraminidase__InfluenzaA__ACY46165

SEQ ID NO: 139546 - RNA, 1410 nt, Artificial Sequence; identical to SEQ ID NO: 138754
  derived and/or modified sequence opt3 from neuraminidase__InfluenzaA__ACY46175

SEQ ID NO: 139547 - RNA, 1410 nt, Artificial Sequence; identical to SEQ ID NO: 138754
  derived and/or modified sequence opt3 from neuraminidase__InfluenzaA__ACY46345

SEQ ID NO: 139548 - RNA, 1410 nt, Artificial Sequence; identical to SEQ ID NO: 138754
  derived and/or modified sequence opt3 from neuraminidase__InfluenzaA__ACY46385

SEQ ID NO: 139549 - RNA, 1410 nt, Artificial Sequence; identical to SEQ ID NO: 138754
  derived and/or modified sequence opt3 from neuraminidase__InfluenzaA__ACY46485

SEQ ID NO: 139550 - RNA, 1410 nt, Artificial Sequence; identical to SEQ ID NO: 138784
  derived and/or modified sequence opt3 from neuraminidase__InfluenzaA__ACY77536

SEQ ID NO: 139551 - RNA, 1410 nt, Artificial Sequence; identical to SEQ ID NO: 138744
  derived and/or modified sequence opt3 from neuraminidase__InfluenzaA__ACY77546

SEQ ID NO: 139552 - RNA, 1410 nt, Artificial Sequence; identical to SEQ ID NO: 138784
  derived and/or modified sequence opt3 from neuraminidase__InfluenzaA__ACY77565

SEQ ID NO: 139553 - RNA, 1410 nt, Artificial Sequence
  derived and/or modified sequence opt3 from neuraminidase__InfluenzaA__ACY77575
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccagugacaaaaccggguccugcggaccugugagcucuaacggugcgaauggcguaaagggguucucauuuaaguauggaaacggcguguggaucggucggacaaaaaguaucagcucccgcaacggguucgagaugauuugggauccaaauggcuggaccggaacggacaacaauuuuucuauaaagcaagacaucgucggcauuaacgaauggucgggguacagcggauccuucgugcagcaucccgagcugacuggucuggauuguauccgaccuugcuucuggguugaacucauuagaggcaggccaaaagagaauacaaucuggaccucagggaguucuauaucguuuuguggagugaacuccgacacugucggcuggucauggcccgauggugcagaguuaccguucacaaucgacaaguga

SEQ ID NO: 139554 - RNA, 1410 nt, Artificial Sequence; identical to SEQ ID NO: 138754
  derived and/or modified sequence opt3 from neuraminidase__InfluenzaA__ACY77585

SEQ ID NO: 139555 - RNA, 1410 nt, Artificial Sequence; identical to SEQ ID NO: 138784
  derived and/or modified sequence opt3 from neuraminidase__InfluenzaA__ACY77595

SEQ ID NO: 139556 - RNA, 1410 nt, Artificial Sequence; identical to SEQ ID NO: 138784
  derived and/or modified sequence opt3 from neuraminidase__InfluenzaA__ACY77605

SEQ ID NO: 139557 - RNA, 1410 nt, Artificial Sequence; identical to SEQ ID NO: 138754
  derived and/or modified sequence opt3 from neuraminidase__InfluenzaA__ACY77625

SEQ ID NO: 139558 - RNA, 1410 nt, Artificial Sequence
  derived and/or modified sequence opt3 from neuraminidase__InfluenzaA__ACY77655
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuucggaucgaaaaggguaaaauugugaagucagucgagaugaacgcccccaauuaucauuacgaagagugcaguuguuacccugacagcuccgagaucacuugcguuugccgcgauaacuggcacgggucuaauagaccaugggugagcuucaaccagaaucucgaauaucagauuggauacauauguucaggcaucuuuggcgacaacccgaggcccaaugauaaaaccgggaguugcggaccuguauccuucaacggugcgaacggcgugaagggguuuagcuucaaguauggaaauggcgucuggauuggucggacaaaaucuaucucaagucgcaacggguuugagaugaucugggacccaaauggcuggaccggaacggauaacaauuucagcauuaagcaagacauagugggcaucaacgaaugguccggguacucuggaucguucguucagcaucccgagcugacuggucuggacuguauucgaccuugcuuuuggguggaacucaucagaggcaggccaaaagagaauacaauuuggaccagcggguccucaaucaguuucuguggagucaacucugauacugugggcuggagcuggcccgacggugcagaguuaccguuuacaauagauaaguga

SEQ ID NO: 139559 - RNA, 1410 nt, Artificial Sequence; identical to SEQ ID NO: 138754
  derived and/or modified sequence opt3 from neuraminidase__InfluenzaA__ACY77665

SEQ ID NO: 139560 - RNA, 1410 nt, Artificial Sequence; identical to SEQ ID NO: 138754
  derived and/or modified sequence opt3 from neuraminidase__InfluenzaA__ACY77675

SEQ ID NO: 139561 - RNA, 1410 nt, Artificial Sequence; identical to SEQ ID NO: 138744
  derived and/or modified sequence opt3 from neuraminidase__InfluenzaA__ACY77685

SEQ ID NO: 139562 - RNA, 1410 nt, Artificial Sequence; identical to SEQ ID NO: 138744
  derived and/or modified sequence opt3 from neuraminidase__InfluenzaA__ACY77695

SEQ ID NO: 139563 - RNA, 1410 nt, Artificial Sequence; identical to SEQ ID NO: 138744
  derived and/or modified sequence opt3 from neuraminidase__InfluenzaA__ACY77705

SEQ ID NO: 139564 - RNA, 1410 nt, Artificial Sequence; identical to SEQ ID NO: 138744
  derived and/or modified sequence opt3 from neuraminidase__InfluenzaA__ACY77725

SEQ ID NO: 139565 - RNA, 1410 nt, Artificial Sequence; identical to SEQ ID NO: 138744
  derived and/or modified sequence opt3 from neuraminidase__InfluenzaA__ACY77735

SEQ ID NO: 139566 - RNA, 1410 nt, Artificial Sequence; identical to SEQ ID NO: 138754
  derived and/or modified sequence opt3 from neuraminidase__InfluenzaA__ACY77745

SEQ ID NO: 139567 - RNA, 1410 nt, Artificial Sequence; identical to SEQ ID NO: 138754
  derived and/or modified sequence opt3 from neuraminidase__InfluenzaA__ACY77755

SEQ ID NO: 139568 - RNA, 1410 nt, Artificial Sequence; identical to SEQ ID NO: 138754
  derived and/or modified sequence opt3 from neuraminidase__InfluenzaA__ACY77775

SEQ ID NO: 139569 - RNA, 1410 nt, Artificial Sequence; identical to SEQ ID NO: 138754
  derived and/or modified sequence opt3 from neuraminidase__InfluenzaA__ACY77785

SEQ ID NO: 139570 - RNA, 1410 nt, Artificial Sequence; identical to SEQ ID NO: 138754
  derived and/or modified sequence opt3 from neuraminidase__InfluenzaA__ACY77795

SEQ ID NO: 139571 - RNA, 1410 nt, Artificial Sequence
  derived and/or modified sequence opt3 from neuraminidase__InfluenzaA__ACY77825
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugccaaacuggcgggaaauucgucauugugcccugucagcgggugggcuauauacaguaaggacaacuccauuagaaucggcucuaaaggugauguguuuguuauuagggagccauucaucagcuguuccccguuagaaugccggaccuuuuuccugacacagggggcccuacucaaugacaagcauucaaacggaaccaucaaagaucgcagucccuaucgaacucugaugagcuguccuauuggcgaggugccaucucccuacaacucccguuuugaaucagucgcauggagcgccagugcuugccacgacggcauaaauuggcuuacaaucgggauuucuggaccugauaacggugcaguggccguacugaaguauaauggcaucauaaccgacacgauuaaguccuggagaaacaauaucuugaggacucaagagagcgagugugcuugcguuaacgggucguguuucaccgugaugacagauggaccaucugacggccaggccuccuacaaaaucuuucggauugaaaaggguaaaaucgucaagucaguggagaugaaugcgcccaacuaucauuacgaagagugcaguuguuacccugauagcuccgagauuacuugcgugugccgcgacaauuggcacgggucuaacagaccaugggucagcuucaaucagaaccucgaauaucagauaggauacaucuguucaggcauuuuuggcgauaauccgaggcccaacgacaaaaccgggaguugcggaccuguuuccagcaauggugcaaacggcgugaagggguucucuuuuaaguauggaaacggcguauggaucggucggacaaaaucaaucaauagucgcaacggguucgagaugauuugggauccaaauggcuggaccggaacggacaacaauuuuagcauaaagcaagacaucgugggcauuaacgaaugguccggguacucuggaucguucguccagcaucccgagcugacuggucuggauuguauccgaccuugcuucuggguggaacucauuagaggcaggccaaaagagaauacaaucuggaccagcggguccucaauaaguuuuuguggaguuaacucugacacugugggcuggagcuggcccgauggugccgaguuaccguucacaaucgacaaguga

SEQ ID NO: 139572 - RNA, 1410 nt, Artificial Sequence; identical to SEQ ID NO: 139571
  derived and/or modified sequence opt3 from neuraminidase__InfluenzaA__ACY77835

SEQ ID NO: 139573 - RNA, 1410 nt, Artificial Sequence; identical to SEQ ID NO: 138784
  derived and/or modified sequence opt3 from neuraminidase__InfluenzaA__ACY77845

SEQ ID NO: 139574 - RNA, 1410 nt, Artificial Sequence; identical to SEQ ID NO: 138754
  derived and/or modified sequence opt3 from neuraminidase__InfluenzaA__ACY77865

SEQ ID NO: 139575 - RNA, 1410 nt, Artificial Sequence
  derived and/or modified sequence opt3 from neuraminidase__InfluenzaA__ACY77870
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaaccuggcugcaggccaguccguagugucugucaaauuggccggaaauucgucauuaugcccugugagcggaugggcgauauacaguaaggacaacuccauuagaaucggcucuaaaggugauguuuucgugauuagggagccauuuaucagcuguuccccgcuggaaugccggaccuucuuucuaacacagggggcucuccugaaugacaagcauucaaacggaaccaucaaagaucgcagucccuaucgaacucuuaugagcuguccuauuggcgaggucccaucucccuacaacucccguuucgaaucaguggccuggagcgcaagugccugccacgacggcauaaauuggcugacaaucgggauuucuggaccugauaacggugcuguagcaguuuugaaguauaauggcaucauaaccgacacgauuaaguccuggagaaacaauauccucaggacucaagagagcgagugugccugcgugaacgggucguguuuuaccgucaugacagauggaccaucugacggccaggcuuccuacaaaaucuuccggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuuuaaucagaaccuggaauaucagauaggauacaucuguucaggcauuuucggcgauaauccgaggcccaacgacaaaaccgggaguugcggaccuguguccagcaauggugcgaacggcguaaagggguuuucuuucaaguauggaaacggcguguggaucggucggacaaaaucaaucaguagccgcaauggguuugagaugauuugggauccaaacggcuggaccggaacggacaauaacuucuccauaaagcaagacaucgucggcauuaaugaauggucuggguacucggggagcuuugugcagcaucccgagcugacuggucucgauuguauccgaccuugcuucuggguugaauuaauuagaggcaggccaaaagagaacacaaucuggaccuccgggucaaguauaucuuucuguggagugaauagcgacacugucggcugguccuggcccgauggugcagagcugccguuuacaaucgacaaguga

SEQ ID NO: 139576 - RNA, 1410 nt, Artificial Sequence; identical to SEQ ID NO: 138754
  derived and/or modified sequence opt3 from neuraminidase__InfluenzaA__ACY77877

SEQ ID NO: 139577 - RNA, 1410 nt, Artificial Sequence; identical to SEQ ID NO: 138754
  derived and/or modified sequence opt3 from neuraminidase__InfluenzaA__ACY77887

SEQ ID NO: 139578 - RNA, 1410 nt, Artificial Sequence; identical to SEQ ID NO: 138754
  derived and/or modified sequence opt3 from neuraminidase__InfluenzaA__ACY77907

SEQ ID NO: 139579 - RNA, 1410 nt, Artificial Sequence; identical to SEQ ID NO: 138784
  derived and/or modified sequence opt3 from neuraminidase__InfluenzaA__ACY77917

SEQ ID NO: 139580 - RNA, 1410 nt, Artificial Sequence
  derived and/or modified sequence opt3 from neuraminidase__InfluenzaA__ACY77927
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccuaacaauggugcuguagcaguucugaaguauaacggcaucauaaccgauacgauuaaguccuggagaaauaacaucuugaggacucaagagagcgagugugccugcgugaaugggucguguuucaccgucaugacagacggaccaucugauggccaggcuuccuacaaaaucuuucggauugaaaaggguaaaaucgugaagucaguggagaugaacgcccccaauuaucauuacgaagagugcaguuguuacccugacagcuccgagauuacuugcgucugccgcgauaacuggcacgggucuaauagaccauggguuagcuucaaccagaaucucgaauaucagauaggauacaucuguucaggcauuuuuggcgacaacccgaggcccaaugauaaaaccgggaguugcggaccuguguccagcaacggugcgaacggcguaaagggguucucuuuuaaguauggaaauggcguguggaucggucggacaaaaucaaucaguagccgcaacggguucgagaugauuugggacccaaauggcuggaccggaacggauaacaauuuuuccauaaagcaagacaucgucggcauuaacgaauggucuggguacucggggagcuucgugcagcaucccgagcugacuggucuggacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 139581 - RNA, 1410 nt, Artificial Sequence; identical to SEQ ID NO: 138754
  derived and/or modified sequence opt3 from neuraminidase__InfluenzaA__ACY77937

SEQ ID NO: 139582 - RNA, 1410 nt, Artificial Sequence; identical to SEQ ID NO: 138754
  derived and/or modified sequence opt3 from neuraminidase__InfluenzaA__ACY77947

SEQ ID NO: 139583 - RNA, 1410 nt, Artificial Sequence; identical to SEQ ID NO: 138754
  derived and/or modified sequence opt3 from neuraminidase__InfluenzaA__ACY77967

SEQ ID NO: 139584 - RNA, 1410 nt, Artificial Sequence; identical to SEQ ID NO: 138744
  derived and/or modified sequence opt3 from neuraminidase__InfluenzaA__ACY77977

SEQ ID NO: 139585 - RNA, 1410 nt, Artificial Sequence; identical to SEQ ID NO: 138754
  derived and/or modified sequence opt3 from neuraminidase__InfluenzaA__ACY77987

SEQ ID NO: 139586 - RNA, 1410 nt, Artificial Sequence
  derived and/or modified sequence opt3 from neuraminidase__InfluenzaA__ACY77997
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucacccuggccggaaauucgucauugugcccugugagcggaugggcgauauacaguaaagacaacuccauuagaaucggcucuaagggugauguuuuugugauuagggagccauucaucagcuguuccccguuagaaugccggacauuuuuccugacccagggggcucuacucaaugacaaacauucaaacggaacuaucaaggaucgcagucccuaucgaacacugaugagcuguccuauuggcgaggucccaucucccuacaacucccguuuugaaucaguggccuggagcgcaagugccugccacgacggcauaaauuggcuuaccaucgggauuucuggaccugauaacggugcuguagcaguucugaaauauaauggcaucauaacggacacuauuaaguccuggagaaacaauaucuugaggacccaagagagcgagugugccugcgugaacgggucguguuucacagucaugacugauggaccaucugacggccaggcuuccuacaagaucuuucggauugaaaaagguaagaucgugaaaucaguggagaugaaugcccccaacuaucauuacgaagagugcaguuguuacccugauagcuccgagauuaccugcgucugccgcgacaauuggcacgggucuaacagaccauggguuagcuucaaucagaaccucgaauaucagauaggauacaucuguucaggcauuuuuggcgauaauccgaggcccaacgacaagacagggaguugcggaccuguguccagcaauggugcgaacggcguaaaaggguucucuuuuaaguauggaaacggcguguggaucggucggaccaagucaaucaguagccgcaauggguucgagaugauuugggauccaaacggcuggacgggaacugacaauaacuuuuccauaaaacaagacaucgucggcauuaaugaauggucuggguacucggggagcuucgugcagcaucccgagcugacaggucuggauuguauccgaccuugcuucuggguugaacucauuagaggcaggccaaaggagaacaccaucuggacuuccgggucaaguauaucuuuuuguggagugaauagcgacacagucggcugguccuggcccgauggugcagaguuaccguucaccaucgacaaauga

SEQ ID NO: 139587 - RNA, 1410 nt, Artificial Sequence; identical to SEQ ID NO: 138754
  derived and/or modified sequence opt3 from neuraminidase__InfluenzaA__ACY78017

SEQ ID NO: 139588 - RNA, 1410 nt, Artificial Sequence
  derived and/or modified sequence opt3 from neuraminidase__InfluenzaA__ACZ01955
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugguaacggcgcuguagcaguucugaaguauaaugggaucauaaccgauacgauuaaguccuggagaaacaauaucuugaggacucaagagagcgagugugccugcgugaacggaucguguuucaccgucaugacagacggcccaucugauggucaggcuuccuacaaaaucuuucggauugaaaaggggaaaaucgugaagucaguggagaugaaugcccccaacuaucauuacgaagagugcaguuguuacccugacagcuccgagauuacuugcgucugccgcgauaauuggcacggaucuaacagaccauggguuagcuucaaucagaaccucgaauaucagauaggcuacaucuguucaggcauuuuuggggacaauccgaggcccaacgauaaaaccggaaguugcgguccuguguccagcaauggcgcgaacgggguaaagggauucucuuuuaaguauggcaacgguguguggaucgggcggacaaaaucaaucaguagccgcaauggcuucgagaugauuugggacccaaacggauggaccggcacggauaauaacuuuuccauaaagcaagacaucgucgggauuaaugaauggucuggauacucggguagcuucgugcagcaucccgagcugacuggccuggacuguauccgaccuugcuucuggguugaacucauuagagggaggccaaaagagaacacaaucuggaccuccggaucaaguauaucuuuuuguggcgugaauagcgauacugucgguugguccuggcccgacggggcagaguuaccguucacaaucgauaaguga

SEQ ID NO: 139589 - RNA, 1410 nt, Artificial Sequence; identical to SEQ ID NO: 138754
  derived and/or modified sequence opt3 from neuraminidase__InfluenzaA__ACZ05053

SEQ ID NO: 139590 - RNA, 1410 nt, Artificial Sequence; identical to SEQ ID NO: 138744
  derived and/or modified sequence opt3 from neuraminidase__InfluenzaA__ACZ05064

SEQ ID NO: 139591 - RNA, 1410 nt, Artificial Sequence; identical to SEQ ID NO: 138754
  derived and/or modified sequence opt3 from neuraminidase__InfluenzaA__ACZ05074

SEQ ID NO: 139592 - RNA, 1410 nt, Artificial Sequence; identical to SEQ ID NO: 138754
  derived and/or modified sequence opt3 from neuraminidase__InfluenzaA__ACZ05084

SEQ ID NO: 139593 - RNA, 1410 nt, Artificial Sequence; identical to SEQ ID NO: 138754
  derived and/or modified sequence opt3 from neuraminidase__InfluenzaA__ACZ05094

SEQ ID NO: 139594 - RNA, 1410 nt, Artificial Sequence; identical to SEQ ID NO: 138754
  derived and/or modified sequence opt3 from neuraminidase__InfluenzaA__ACZ05104

SEQ ID NO: 139595 - RNA, 1410 nt, Artificial Sequence; identical to SEQ ID NO: 138754
  derived and/or modified sequence opt3 from neuraminidase__InfluenzaA__ACZ05114

SEQ ID NO: 139596 - RNA, 1410 nt, Artificial Sequence; identical to SEQ ID NO: 138754
  derived and/or modified sequence opt3 from neuraminidase__InfluenzaA__ACZ05124

SEQ ID NO: 139597 - RNA, 1410 nt, Artificial Sequence; identical to SEQ ID NO: 138754
  derived and/or modified sequence opt3 from neuraminidase__InfluenzaA__ACZ05144

SEQ ID NO: 139598 - RNA, 1410 nt, Artificial Sequence; identical to SEQ ID NO: 138754
  derived and/or modified sequence opt3 from neuraminidase__InfluenzaA__ACZ05154

SEQ ID NO: 139599 - RNA, 1410 nt, Artificial Sequence; identical to SEQ ID NO: 138615
  derived and/or modified sequence opt3 from neuraminidase__InfluenzaA__ACZ05164

SEQ ID NO: 139600 - RNA, 1410 nt, Artificial Sequence; identical to SEQ ID NO: 138615
  derived and/or modified sequence opt3 from neuraminidase__InfluenzaA__ACZ05175

SEQ ID NO: 139601 - RNA, 1413 nt, Artificial Sequence
  derived and/or modified sequence opt3 from neuraminidase__InfluenzaA__ACZ05197
augaaccccaaucagaagaucaugaccauuggcagcauauccaucgccauugggaucauuucucugaugcuccaaaucggaaacauaaucucaauuugggcuagucacagcauccagacagguucccagaauaacacuggcauuugcaaucagagaaucauaacguacgagaacucuaccugggugaaucauacauaugucaacauuaauaacacuaauguuguggcaggggaagacaaaaccucgguaacacuugccggaaacucaagccuguguaguaucuccggcugggcgauuuacaccaaggauaauucuaucaggaucgguagcaaaggggacguguucgucauucgggagccuuuuauauccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgaucgguauuuccggcccagacaacggggccguggcuguccugaaguauaauggaaucauaacuggcaccauuaaaagcuggaagaaacagaucuugagaacacaggagucggagugcguguguaugaacgguucuugcuuuacuaucaugaccgaugggcccuccaauaaggccgcgucauacaaaauuuucaagaucgaaaagggaaaaguaacaaagaguauugagcucaacgcaccuaauuuuuauuacgaagaguguagcugcuacccagacaccggcauaguuaugugugugugcagggauaacuggcauggcuccaaucggcccugggucucuuucaaccagaaucuggacuaucaaaucggguacauuugcagcggaguguuuggugauaacccucgcccagaggacggcgaagggucauguaauccggugacggucgauggagccaacggcguuaaagguuucaguuauaaguacgggaauggcguguggaucggaagaacuaaauccaacaggcugcggaagggcuuugagaugaucugggaccccaauggguggacaaacaccgacagcgauuucucuguaaaacaggacguggucgcuauuacugauuggucaggauauagugguagcuuugugcagcacccugaacucacaggcuuagacugcauacgcccauguuucuggguugagcuggugcgagggcuucccagagaaaacaccacgaucuggaccuccggaucuucgauuagcuucugcggcgucaauuccgauacagccaacuggucauggccugacggugcagaguugccauuuacuaucgauaaguga

SEQ ID NO: 139602 - RNA, 1410 nt, Artificial Sequence
  derived and/or modified sequence opt3 from neuraminidase__InfluenzaA__ACZ05208
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugcagcgacccuaacaaugaggaaggugggcacggaguuaaaggcugggcuuucgauucaggcaacgacguguggauggggcgaaccauuagugagaaguccagacuuggauaugagacauuuaaagucaucgaagguuggagcaauccaaagucuaaauugcagauuaacaggcaagugauaguagaucggggcaaucguucaggguacaguggaaucuucagcguugagggcaaguccuguauuaaccgcugcuuuuauguggaacugaucagagguaggaaggaggaaacugagguccuauggaccucuaauucgaucguggucuucugugggacaagcggcacuuacggaaccggcuccuggcccgacggggccgauauuaaccucaugccuauauga

SEQ ID NO: 139603 - RNA, 1410 nt, Artificial Sequence
  derived and/or modified sequence opt3 from neuraminidase__InfluenzaA__ACZ05219
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugggauaacaggauucgcaccauuuagcaaagacaacuccauucggcugucugccgguggcgauaucuggguaacccgcgagcccuaugugucgugcgacccugauaaguguuaccaauucgcgcuagggcagggaacgacucucaauaacguccauucaaauaacaccgugcgagaccguacaccauauagaacucugcuuaugaaugaacugggcguucccuuucacuuggguaccaaacaggugugcauugcuuggagcaguuccucuugucaugaugggaaggccuggcuccacgucugcaucacaggagacgauaagaacgcaaccgccagcuucaucuacaauggcaggcugguggacuccguaguuucauggaguaaagagauucugcggacgcaggaaagcgagugugugugcauaaacggcacuuguacagucgugaugaccgaugggucugcuuccggaaaggcagacacuaaaauccucuuuauugaggaagguaagaucgugcauacaucaaccuuaagcggcagugcccaacacgucgaggaaugcucuugcuauccucgcuacccagggguuagaugugugugcagggauaacuggaagggauccaaucggccgauaguagacauuaacaucaaagaucacagcaucgugucgucuuacgucuguuccggccuggugggugacacgccccgcaagaaugacucaaguagcuccucucauugccuugauccuaacaaugaggaagggggacacggcguuaaaggcugggcuuucgacgaugggaacgacguguggaugggacgaaccauuagcgagaagucaagauuggguuaugagacauuuaaagucaucgaaggcuggaguaauccaaaguccaaacugcagauuaacaggcaagugauaguagaucgggggaaucguagcggauacucuggcaucuucucaguugaggguaagaguuguauuaaccgcugcuuuuauguggaacuaaucagagggaggaaggaggaaacugagguccucuggaccagcaauuccaucguggucuucuguggcacaucuggaacuuacggcaccgggucguggcccgacggagccgauauuaaccugaugccuauauga

SEQ ID NO: 139604 - RNA, 1410 nt, Artificial Sequence; identical to SEQ ID NO: 138615
  derived and/or modified sequence opt3 from neuraminidase__InfluenzaA__ACZ05230

SEQ ID NO: 139605 - RNA, 1410 nt, Artificial Sequence
  derived and/or modified sequence opt3 from neuraminidase__InfluenzaA__ACZ05241
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaaguuaagcgguagugcccaacacgucgaggaaugcucuugcuauccucgcuacccaggcguuagaugugugugcagggacaacuggaaaggguccaaucggccgauaguagauauuaacaucaaggaccacagcaucgugucgucuuacgucuguuccggacuggugggcgacacccccaggaaaaaugauucaaguagcuccucucauugccuugacccuaacaaugaggaaggugggcacggaguuaagggcugggcuuucgaugacggcaacgauguguggauggggcgaacgauuagcgagaaaucaagauugggauaugagaccuuuaaggucaucgaagguuggaguaauccaaaauccaagcugcagauuaaccgccaggugauaguagaccggggcaaucguagcggguacucuggaaucuucucaguugagggcaagaguuguauuaaccgcugcuuuuauguggaacuaaucagagguaggaaagaggaaacagagguccucuggacuagcaauuccaucguggucuucugugggaccucuggcacauacggaacuggcucguggcccgauggggccgacauuaaccugaugccuauauga

SEQ ID NO: 139606 - RNA, 1413 nt, Artificial Sequence
  derived and/or modified sequence opt3 from neuraminidase__InfluenzaA__ACZ05296
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccgguggccgucgauggagcuaacggcguuaaagguuucaguuauaaguacgggaauggcguguggaucggaagaacgaaauccaacaggcugcggaagggcuuugagaugauuugggaccccaauggguggacuaacacagacagcgauuucucuguaaaacaggacguggucgccauaaccgauuggucaggauauagugguagcuuugugcagcacccugaacucacuggcuuagacugcauccgcccauguuucuggguugagcuggugcgagggcuucccagagaaaacacaaccauuuggacguccggaucuucgaucagcuucugcggcgucaauuccgauaccgcaaacuggucauggccugacggugcugaguugccauuuacaauugauaaguga

SEQ ID NO: 139607 - RNA, 1410 nt, Artificial Sequence; identical to SEQ ID NO: 138615
  derived and/or modified sequence opt3 from neuraminidase__InfluenzaA__ACZ05307

SEQ ID NO: 139608 - RNA, 1410 nt, Artificial Sequence
  derived and/or modified sequence opt3 from neuraminidase__InfluenzaA__ACZ05318
augaaccccaaucagaagaucauuaccauaggcagcgugucccugacaaucucuacuauuugcuucuuuaugcaaacggccauccucauuaccacagucacucuucacuucaaacagugugaguuuaacucaccuccaaauaaccagguuaugcugugcgaaccgaccaucauagagagaaauaucacagaaauuguguacuugaccaacacuacaaucgagaaggaaauuugucccaaauuagcugaguauaggaauuggaguaagccucagugcgacaucaccggguucgcaccauuuagcaaagauaacuccauacggcugucugccggaggugacauuuggguaacgcgcgagcccuacgugucgugugauccugacaagugcuaucaauucgcgcuaggccaggggacuacccucaauaacguccauucaaauaacacagugcgagaucguacuccauacagaacccugcuuaugaaugaacugggaguucccuuucacuugggcacaaaacagguguguaucgcuuggagcaguuccucuugccaugacgguaaggccuggcuccacgucuguauuaccggggaugacaagaacgcaacggccagcuucaucuauaauggaaggcugguggauuccguaguuucauggaguaaagagauccugcggacucaggaaagcgagugcguguguauuaacggcacaugcaccgucgugaugacugacggcucugcuuccgggaaggcagauacaaaaauacucuuuaucgaggaaggaaagauugugcauaccucaacguuaagcgguagugcccaacacgucgaggaaugcucuuguuacccucgcuauccaggcguuagaugcguguguagggacaacuggaagggguccaaucggccgaucguagauauaaacauuaaagaccacagcaucgugucgucuuacgucugcuccggacuggugggcgacacccccaggaagaaugauucaaguagcuccucucauugucuugacccuaacaaugaggaaggugggcacggaguuaaaggcugggcuuucgaugacggcaacgauguguggauggggcgaacaaucagcgagaagucaagauugggauacgagacuuuuaaagucauugaagguuggaguaauccaaaguccaaacugcagaucaaccgccaggugauuguagaccggggcaaucguagcggguauucuggaauauucucaguugagggcaagaguugcaucaaccgcuguuuuuacguggaacuaauuagagguaggaaggaggaaaccgagguccucuggacaagcaauuccaucguggucuucugcgggacuucuggcaccuauggaacaggcucguggcccgauggggccgacaucaaccugaugccuauuuga

SEQ ID NO: 139609 - RNA, 1410 nt, Artificial Sequence; identical to SEQ ID NO: 138615
  derived and/or modified sequence opt3 from neuraminidase__InfluenzaA__ACZ05329

SEQ ID NO: 139610 - RNA, 1410 nt, Artificial Sequence; identical to SEQ ID NO: 138528
  derived and/or modified sequence opt3 from neuraminidase__InfluenzaA__ACZ05340

SEQ ID NO: 139611 - RNA, 1410 nt, Artificial Sequence; identical to SEQ ID NO: 139605
  derived and/or modified sequence opt3 from neuraminidase__InfluenzaA__ACZ05362

SEQ ID NO: 139612 - RNA, 1410 nt, Artificial Sequence; identical to SEQ ID NO: 138615
  derived and/or modified sequence opt3 from neuraminidase__InfluenzaA__ACZ05373

SEQ ID NO: 139613 - RNA, 1410 nt, Artificial Sequence; identical to SEQ ID NO: 138615
  derived and/or modified sequence opt3 from neuraminidase__InfluenzaA__ACZ05395

SEQ ID NO: 139614 - RNA, 1410 nt, Artificial Sequence; identical to SEQ ID NO: 138615
  derived and/or modified sequence opt3 from neuraminidase__InfluenzaA__ACZ05406

SEQ ID NO: 139615 - RNA, 1413 nt, Artificial Sequence
  derived and/or modified sequence opt3 from neuraminidase__InfluenzaA__ACZ05450
augaaccccaaucagaagaucauuaccauaggcagcaucuccauugccaucgggauuaucucucugaugcuccaaauaggaucaaucauuaguaucugggcuagccacuccauucagacagguucucagaacaauacuggcaucugcaaccagagaauaauuacguacgaaaauucgaccugggugaaccauacauaugucaauaucaacaauacuaacguuguggcaggggaggacaaaaccucaguaacacuugccggaaauagcagucuguguuccauuucuggcugggcgaucuacaccaaggauaacagcgugaggaucgguuccaaaggggacgucuucgugauucgggagccuuuuauaucaugcagucacuuggaaugucgcacuuucuuuuuaacacaaggagcucugcuaaaugauaagcauagcaacggcaccguuaaagaccgaucuccauaucgugcccucauguccugcccgcugggcgaggcacccucaccuuacaauagcaaguucgaaaguguggccuggucugcuuccgcaugucacgaugggaugggauggcuuacgaucgguauuagcggcccagacaacggggccgucgcugugcugaaguauaacggaaucauaacuggcaccauuaaaucguggaagaaacagaucuugagaacacaggagucugagugcguauguaugaaugguuccugcuuuacuaucaugaccgaugggcccucaaacaaggccgcgaguuacaaaauuuucaagaucgaaaagggaaaaguuacaaagagcauugagcucaaugcaccuaacuuuuauuacgaagaguguuccugcuacccagacaccggcauagugaugugugucugcagggauaauuggcauggcucuaaccggcccugggugagcuucaaucagaaccuggacuaucaaaucggguacauuugcucaggaguguuuggugauaauccucgcccagaggacggcgaagggaguuguaacccggucacgguugauggagccaauggcgugaaagguuucuccuauaaguacgggaacggcguauggaucggaagaacuaaaagcaauaggcugcggaagggcuuugagaugaucugggaccccaacggguggacaaauaccgacucugauuucucagugaaacaggacgucguggcuauuacugauuggaguggauauagcgguuccuuuguucagcacccugaacucacaggcuuagacugcauacgcccauguuucuggguggagcugguccgagggcuucccagagaaaacaccacgaucuggaccucuggaucgagcauuuccuucugcggcgugaacucagauacagccaauuggaguuggccugacggugcagaguugccauuuacuaucgauaaguga

SEQ ID NO: 139616 - RNA, 1410 nt, Artificial Sequence; identical to SEQ ID NO: 138615
  derived and/or modified sequence opt3 from neuraminidase__InfluenzaA__ACZ05461

SEQ ID NO: 139617 - RNA, 1410 nt, Artificial Sequence; identical to SEQ ID NO: 138615
  derived and/or modified sequence opt3 from neuraminidase__InfluenzaA__ACZ05472

SEQ ID NO: 139618 - RNA, 1410 nt, Artificial Sequence
  derived and/or modified sequence opt3 from neuraminidase__InfluenzaA__ACZ05483
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuguagagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcaucgcuuggagcaguuccucuugucaugacgguaaagccuggcuccacgugugcauuacaggggaugacaagaacgcaaccgccagcuucaucuacaauggaaggcugguagauuccguugugucauggaguaaagagauccugcggacgcaggaaagcgagugugucugcauuaacggcacuuguacaguggugaugaccgacggcucugcuuccgggaaggcagauacuaaaauacucuuuaucgaggaaggaaagauuguccauacaucaaccuuaagcgguagugcccaacacguugaggaaugcucuugcuauccucgcuacccaggcgugagauguguaugcagggacaacuggaagggguccaaucggccgaucguggauauaaacauuaaagaccacagcaucgucucgucuuacguguguuccggacugguuggcgacacgccccgcaagaaugauucaaguagcuccucucauugccuugacccuaacaaugaggaaggugggcacggagugaaaggcugggcuuucgaugacggcaacgaugucuggauggggcgaaccaucagcgagaagucaagauugggauaugagacauuuaaagugauugaagguuggaguaauccaaaguccaaacugcagaucaacaggcagguaauuguugaccggggcaaucguagcggguacucuggaauauucucaguggagggcaagaguuguaucaaccgcugcuuuuaugucgaacuaauuagagguaggaaggaggaaacugaggugcucuggaccagcaauuccaucgucguguucugugggacaucuggcacuuacggaaccggcucguggcccgauggggccgacaucaaccugaugccuauuuga

SEQ ID NO: 139619 - RNA, 1410 nt, Artificial Sequence; identical to SEQ ID NO: 138615
  derived and/or modified sequence opt3 from neuraminidase__InfluenzaA__ACZ05494

SEQ ID NO: 139620 - RNA, 1410 nt, Artificial Sequence; identical to SEQ ID NO: 139608
  derived and/or modified sequence opt3 from neuraminidase__InfluenzaA__ACZ05516

SEQ ID NO: 139621 - RNA, 1410 nt, Artificial Sequence
  derived and/or modified sequence opt3 from neuraminidase__InfluenzaA__ACZ05527
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugcagcgacccuaacaaugaggaaggugggcacggaguuaaaggcugggcuuucgaugacggcaacgauguguggauggggcgaaccauuucagagaagaguagacuuggauaugagacauuuaaagucaucgaagguugguccaauccaaagagcaaauugcagauuaacaggcaagugauaguagaccggggcaaucguucuggguacucaggaaucuucaguguugagggcaagagcuguauuaaccgcugcuuuuauguggaacugaucagagguaggaaggaggaaacugagguccuauggaccuccaauucuaucguggucuucugugggacaucgggcacuuacggaaccggcagcuggcccgauggggccgacauuaaccucaugccuauauga

SEQ ID NO: 139622 - RNA, 1410 nt, Artificial Sequence; identical to SEQ ID NO: 139605
  derived and/or modified sequence opt3 from neuraminidase__InfluenzaA__ACZ05538

SEQ ID NO: 139623 - RNA, 1413 nt, Artificial Sequence; identical to SEQ ID NO: 139477
  derived and/or modified sequence opt3 from neuraminidase__InfluenzaA__ACZ05593

SEQ ID NO: 139624 - RNA, 1413 nt, Artificial Sequence
  derived and/or modified sequence opt3 from neuraminidase__InfluenzaA__ACZ05604
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuaggggcugggcgaucuacaccaaggauaauuccauccggauugguucuaaaggggacguguucgucauacgcgagccuuuuaucagcugcucccacuuggaaugucgaacuuucuuuuuaacacaaggagcucugcuaaacgauaagcauucaaauggcaccgugaaagaccguaguccauauagagcccucaugagcugcccgcugggcgaggcacccucuccuuacaacuccaaguucgaaucaguugccuggagcgcuagugcaugucacgaugggaugggauggcuuacgauugguaucucuggcccagacaacggggccguggcuguccugaaguauaauggaauaauuacuggcaccaucaaauccuggaagaaacagaucuugaggacacaggagagcgagugcguguguaugaacgguucgugcuuuacuauuaugaccgaugggcccucuaauaaggccgcguccuacaaaaucuucaagauugaaaagggaaaaguaacaaagucaauagagcucaacgcaccuaauuuuuauuacgaagaguguaguugcuacccagacaccggcaucguuaugugugugugccgggauaacuggcauggcagcaaucgccccugggucuccuucaaccagaaucuggacuaucaaauuggguacaucugcucuggaguguuuggugauaacccuagaccagaggacggcgaagggagcuguaauccggugacggucgauggagccaacggcguuaaagguuucucauauaaguacgggaauggcguguggaucggaaggacuaaaaguaaccggcugcgcaagggcuuugagaugauuugggaccccaauggguggacaaacaccgacuccgauuucagcguaaaacaggacguggucgcuauaacugauuggucuggauauucagguaguuuugugcagcacccugaacucacaggcuuagacugcauccgaccauguuucuggguugagcuggugagagggcuucccagggaaaacaccacgauuuggaccagcggauccucuaucucguucugcggcgucaauagcgauacagccaacugguccuggccugacggugcagaguugccauuuacuauugauaaguga

SEQ ID NO: 139625 - RNA, 1410 nt, Artificial Sequence; identical to SEQ ID NO: 138615
  derived and/or modified sequence opt3 from neuraminidase__InfluenzaA__ACZ05953

SEQ ID NO: 139626 - RNA, 1410 nt, Artificial Sequence; identical to SEQ ID NO: 139621
  derived and/or modified sequence opt3 from neuraminidase__InfluenzaA__ACZ05964

SEQ ID NO: 139627 - RNA, 1410 nt, Artificial Sequence; identical to SEQ ID NO: 138615
  derived and/or modified sequence opt3 from neuraminidase__InfluenzaA__ACZ05997

SEQ ID NO: 139628 - RNA, 1410 nt, Artificial Sequence; identical to SEQ ID NO: 139621
  derived and/or modified sequence opt3 from neuraminidase__InfluenzaA__ACZ06008

SEQ ID NO: 139629 - RNA, 1410 nt, Artificial Sequence; identical to SEQ ID NO: 139621
  derived and/or modified sequence opt3 from neuraminidase__InfluenzaA__ACZ06019

SEQ ID NO: 139630 - RNA, 1413 nt, Artificial Sequence
  derived and/or modified sequence opt3 from neuraminidase__InfluenzaA__ACZ16015
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaaguaagagcauagagcucaacgcaccuaauuuuuauuacgaagaguguuccugcuacccagacacaggcaucguuaugugugugugcagggauaacuggcauggcucuaaucggcccugggucagcuucaaccagaaucuggacuaucaaauuggguacaucugcucaggaguguuuggugauaacccucgcccagaggacggcgaagggaguuguaauccggugaccgucgauggagccaacggcguuaaagguuucuccuauaaguacgggaauggcguguggaucggaagaacgaaaagcaacaggcugcggaagggcuuugagaugauuugggaccccaauggguggacuaacacagacucugauuucucaguaaaacaggacguggucgcuauaaccgauuggaguggauauagcgguuccuuugugcagcacccugaacucacuggcuuagacugcauccgcccauguuucuggguugagcuggugcgagggcuucccagagaaaacacaaccauuuggacgucuggaucgagcaucuccuucugcggcgucaauucagauaccgccaacuggaguuggccugacggugcagaguugccauuuacaauugauaaguga

SEQ ID NO: 139631 - RNA, 1413 nt, Artificial Sequence
  derived and/or modified sequence opt3 from neuraminidase__InfluenzaA__ACZ16025
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugugaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccauuaaagaccgaagcccauaucgugcccucaugucuugcccgcugggcgaggcacccuccccuuacaacucaaaguucgaaagcguggccuggagugcuucugcaugucacgaugggaugggauggcuuacgaucgguauauccggcccagacaacggggccguugcugugcugaaguauaauggaauuaucacuggcaccaucaaaagcuggaagaaacagauuuugagaacacaggagucggagugcgucuguaugaacgguucuugcuuuacuaucaugaccgaugggcccuccaauaaggccgcgucauacaaaauuuucaagauagaaaagggaaaagugacaaagaguaucgagcucaacgcaccuaauuuuuauuacgaagaguguagcugcuacccagacaccggcauuguaauguguguuugcagggauaacuggcauggcuccaaucggcccugggugucuuucaaccagaaucuggacuaucaaaucggguacaucugcagcggagucuuuggugauaacccucgcccagaggacggcgaagggucauguaauccggugacgguggauggagccaacggcgucaaagguuucaguuauaaguacgggaauggcguuuggauuggaagaacuaaauccaacaggcugcggaagggcuuugagaugauaugggaccccaauggguggacaaacaccgacagcgauuucucugugaaacaggacguaguggcuaucacugauuggucaggauauagugguagcuuuguccagcacccugaacucacaggcuuagacugcauucgcccauguuucuggguggagcugguucgagggcuucccagagaaaacaccacgaucuggaccuccggaucuucgauuagcuucugcggcgucaauuccgauacagccaacuggucauggccugacggugcagaguugccauuuacuaucgauaaguga

SEQ ID NO: 139632 - RNA, 1413 nt, Artificial Sequence; identical to SEQ ID NO: 139477
  derived and/or modified sequence opt3 from neuraminidase__InfluenzaA__ACZ16035

SEQ ID NO: 139633 - RNA, 1410 nt, Artificial Sequence
  derived and/or modified sequence opt3 from neuraminidase__InfluenzaA__ACZ16043
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacaauauuagaaucggcuccaaaggugauguuuuugugauuagggagccauucaucucuuguagcccguuagaaugccggaccuuuuuccugacacagggggcucuacucaacgacaagcauuccaacggaaccaucaaagaucgcucacccuaucgaacucugaugaguuguccuauuggcgaggucccaagccccuacaauucucguuuugaauccguggccuggucagcaagcgccugccacgacggcauaaacuggcuuacaaucgggauuaguggaccugauaauggugcuguagcaguucugaaguauaacggcaucauaaccgacacgauuaagucuuggagaaauaacaucuugaggacucaagaguccgagugugccugcgugaaugggagcuguuucaccgucaugacagauggaccaucggacggccaggcuucuuacaaaaucuuucggauugaaaaggguaaaaucgugaaguccguggagaugaacgcccccaauuaucauuacgaagagugcucauguuacccugauaguagcgagauuacuugcgucugccgcgacaacuggcacggguccaauagaccauggguuucuuucaaccagaaucucgaauaucagauaggauacaucuguagcggcauuuuuggcgauaacccgaggcccaaugacaaaaccgggucaugcggaccugugaguuccaacggugcgaacggcguaaagggguucagcuuuaaguauggaaauggcguguggaucggucggacaaaaucuaucucaagucgcaacggguucgagaugauuugggauccaaauggcuggaccggaacggacaacaauuuuagcauaaagcaagacaucgucggcauuaacgaaugguccggguacucuggaucguucgugcagcaucccgagcugacuggucuggauuguauccgaccuugcuucuggguugaacucauuagaggcaggccaaaagagaauacaaucuggaccagcggguccucaauaaguuuuuguggagugaacucugacacugucggcuggagcuggcccgauggugcagaguuaccguucacaaucgacaaguga

SEQ ID NO: 139634 - RNA, 1410 nt, Artificial Sequence
  derived and/or modified sequence opt3 from neuraminidase__InfluenzaA__ACZ16053
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuucggaucgaaaaggguaaaauugugaagucagucgagaugaacgcccccaauuaucauuacgaagagugcaguuguuacccugacagcuccgagaucacuugcguuugccgcgauaacuggcacgggucuaauagaccaugggugagcuucaaccagaaucucgaauaucagauuggauacauauguucaggcaucuuuggcgacaacccgaggcccaaugauaaaaccgggaguugcggaccuguauccagcaacggugcgaacggcgugaagggguucucuuuuaaguauggaaauggcgucuggauuggucggacaaaaucaaucaguagccgcaacggguucgagaugaucugggacccaaauggcuggaccggaacggauaacaauuuuuccacuaagcaagacauugugggcauaaacgaauggucuggguacucggggagcuucguucagcaucccgagcugacaggucuggacuguauccgaccuugcuucuggguggaacucauuagaggcaggccaaaagagaauaccaucuggacuuccgggucaaguauuucuuuuuguggagucaacagcgauacagugggcugguccuggcccgacggugcagaguuaccguucaccaucgauaaguga

SEQ ID NO: 139635 - RNA, 1410 nt, Artificial Sequence; identical to SEQ ID NO: 138744
  derived and/or modified sequence opt3 from neuraminidase__InfluenzaA__ACZ16073

SEQ ID NO: 139636 - RNA, 1410 nt, Artificial Sequence
  derived and/or modified sequence opt3 from neuraminidase__InfluenzaA__ACZ16083
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaagacaguccguagugucugucaaacuggccggcaauucgucauugugcccugugagcgggugggcgauauacaguaaggacaacuccguuaggauuggaucuaaaggcgauguguuugucauccgggagccauucauuagcuguuccccguuagguugccgcaccuuuuuccugacacagggggcucuacucaaugacaagcauucaaacggaaccaucaaagaucgaagucccuaucguacucugaugagcuguccuaucggcgaagugccaucucccuacaacuccagauuugagucaguagccuggagcgcaagugccugccacgacggcauuaauuggcuuacaauagggaucucuggaccugauaacggugcuguugcagugcugaaguauaauggcauuaucaccgacacgauaaaguccuggaggaacaauauuuugcggacucaagaaagcgagugugccugcgucaacgggucguguuucaccgugaugacagauggaccaucuaauggccaggcuuccuacaaaaucuuucgcaucgagaaggguaaaauugugaagucagucgaaaugaacgcccccaauuaucauuacgaggaaugcaguuguuacccugacagcuccgagaucacuugcguuugcagagauaacuggcacgggucuaauaggccaugggugagcuucaaccagaaucucgaguaucagauuggauacauauguucaggcaucuuuggcgacaacccgcggcccaaugauaaaaccgggaguugcggaccuguauccagcaacggugcgaacggcgugaagggguucucuuuuaaguauggaaauggcgucuggauuggucgcacaaaaucaaucaguagccgaaacggguucgaaaugaucugggacccaaauggcuggaccggaacggauaacaauuuuuccauuaagcaagacauagugggcaucaacgaguggucuggguacucggguagcuucguucagcaucccgaacugacuggacuggacuguauuagaccuugcuucuggaucgagcucauuaggggccggccaaaagaaaauacaaucuggaccuccgggucaaguauaucuuuuuguggagugaacagcgauacugucggcugguccuggcccgacggugcagaguuaccguucacaaucgauaaguga

SEQ ID NO: 139637 - RNA, 1410 nt, Artificial Sequence; identical to SEQ ID NO: 138744
  derived and/or modified sequence opt3 from neuraminidase__InfluenzaA__ACZ16093

SEQ ID NO: 139638 - RNA, 1410 nt, Artificial Sequence; identical to SEQ ID NO: 138754
  derived and/or modified sequence opt3 from neuraminidase__InfluenzaA__ACZ16103

SEQ ID NO: 139639 - RNA, 1410 nt, Artificial Sequence; identical to SEQ ID NO: 138754
  derived and/or modified sequence opt3 from neuraminidase__InfluenzaA__ACZ16113

SEQ ID NO: 139640 - RNA, 1410 nt, Artificial Sequence; identical to SEQ ID NO: 138754
  derived and/or modified sequence opt3 from neuraminidase__InfluenzaA__ACZ16123

SEQ ID NO: 139641 - RNA, 1410 nt, Artificial Sequence
  derived and/or modified sequence opt3 from neuraminidase__InfluenzaA__ACZ16133
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaauggguucgagaugauaugggauccaaacggcuggaccggaacggacaauaacuuuuccaucaagcaagacauugugggcaucaaugaauggucuggguacucggggagcuucguccagcaucccgagcugacuggucuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 139642 - RNA, 1410 nt, Artificial Sequence
  derived and/or modified sequence opt3 from neuraminidase__InfluenzaA__ACZ16143
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccucuguccagcaauggugcgaacggcgugaagggguucucuuuuaaguauggaaacggcguauggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguccagcaucccgagcugacuggucucgauuguauccgaccuugcuucuggguggaauuaauuagaggcaggccaaaagagaacacaaucuggaccuccgggucaaguauaucuuuuuguggaguuaauagcgacacugugggcugguccuggcccgauggugcagagcugccguucacaaucgacaaguga

SEQ ID NO: 139643 - RNA, 1410 nt, Artificial Sequence; identical to SEQ ID NO: 138754
  derived and/or modified sequence opt3 from neuraminidase__InfluenzaA__ACZ16153

SEQ ID NO: 139644 - RNA, 1410 nt, Artificial Sequence; identical to SEQ ID NO: 138754
  derived and/or modified sequence opt3 from neuraminidase__InfluenzaA__ACZ16163

SEQ ID NO: 139645 - RNA, 1410 nt, Artificial Sequence; identical to SEQ ID NO: 138744
  derived and/or modified sequence opt3 from neuraminidase__InfluenzaA__ACZ16173

SEQ ID NO: 139646 - RNA, 1410 nt, Artificial Sequence; identical to SEQ ID NO: 138754
  derived and/or modified sequence opt3 from neuraminidase__InfluenzaA__ACZ16193

SEQ ID NO: 139647 - RNA, 1410 nt, Artificial Sequence; identical to SEQ ID NO: 138754
  derived and/or modified sequence opt3 from neuraminidase__InfluenzaA__ACZ16203

SEQ ID NO: 139648 - RNA, 1410 nt, Artificial Sequence; identical to SEQ ID NO: 138754
  derived and/or modified sequence opt3 from neuraminidase__InfluenzaA__ACZ16213

SEQ ID NO: 139649 - RNA, 1410 nt, Artificial Sequence
  derived and/or modified sequence opt3 from neuraminidase__InfluenzaA__ACZ16223
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacgagaccaucaaagaucgcagucccuaucgaacucugaugagcuguccuauuggagaagucccaucucccuacaacucccguuuugagucaguggccuggagcgcaagugccugccacgacggcauaaauuggcuuacaaucggcauuucugggccugauaacggagcuguagcaguucugaaguauaaugguaucauaaccgacacgauuaaguccuggagaaacaauaucuugaggacucaagagagcgaaugugccugcgugaacggcucguguuucaccgucaugacagaugggccaucugacggacaggcuuccuacaaaaucuuucggauugagaagggcaaaaucgugaagucaguggaaaugaaugcccccaacuaucauuacgaggagugcaguuguuacccugauagcuccgaaauuacuugcgucugccgcgacaauuggcacgguucuaacagaccauggguuagcuucaaucagaaccucgaguaucagauaggguacaucuguucaggaauuuuuggcgauaauccgaggcccaacgacaaaaccggcaguugcgggccuguguccagcaauggagcgaacgguguaaagggcuucucuuuuaaguaugggaacggaguguggaucggccggacaaaaucaaucaguagccgcaaugguuucgaaaugauuugggauccaaacggguggaccggcacggacaauaacuuuuccauaaagcaagacaucauuggaaucaaugaguggucuggcuacucggggagcuucguccagcaucccgaacugacuggacuggauuguauucgaccuugcuucuggguggagcucaucagagguaggccaaaagagaacacaauauggaccuccggcucaaguaucucuuuuugugggguuaauagcgacacugugggaugguccuggcccgauggcgcagaauuaccguucacaauugacaaguga

SEQ ID NO: 139650 - RNA, 1410 nt, Artificial Sequence; identical to SEQ ID NO: 138754
  derived and/or modified sequence opt3 from neuraminidase__InfluenzaA__ACZ16233

SEQ ID NO: 139651 - RNA, 1410 nt, Artificial Sequence; identical to SEQ ID NO: 139462
  derived and/or modified sequence opt3 from neuraminidase__InfluenzaA__ACZ16243

SEQ ID NO: 139652 - RNA, 1410 nt, Artificial Sequence
  derived and/or modified sequence opt3 from neuraminidase__InfluenzaA__ACZ16253
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucaacaucgacaaguga

SEQ ID NO: 139653 - RNA, 1410 nt, Artificial Sequence; identical to SEQ ID NO: 138754
  derived and/or modified sequence opt3 from neuraminidase__InfluenzaA__ACZ16263

SEQ ID NO: 139654 - RNA, 1410 nt, Artificial Sequence; identical to SEQ ID NO: 138744
  derived and/or modified sequence opt3 from neuraminidase__InfluenzaA__ACZ16283

SEQ ID NO: 139655 - RNA, 1410 nt, Artificial Sequence; identical to SEQ ID NO: 138754
  derived and/or modified sequence opt3 from neuraminidase__InfluenzaA__ACZ16293

SEQ ID NO: 139656 - RNA, 1410 nt, Artificial Sequence; identical to SEQ ID NO: 138754
  derived and/or modified sequence opt3 from neuraminidase__InfluenzaA__ACZ16303

SEQ ID NO: 139657 - RNA, 1410 nt, Artificial Sequence; identical to SEQ ID NO: 138754
  derived and/or modified sequence opt3 from neuraminidase__InfluenzaA__ACZ16313

SEQ ID NO: 139658 - RNA, 1410 nt, Artificial Sequence; identical to SEQ ID NO: 138754
  derived and/or modified sequence opt3 from neuraminidase__InfluenzaA__ACZ16323

SEQ ID NO: 139659 - RNA, 1410 nt, Artificial Sequence; identical to SEQ ID NO: 138754
  derived and/or modified sequence opt3 from neuraminidase__InfluenzaA__ACZ16333

SEQ ID NO: 139660 - RNA, 1410 nt, Artificial Sequence; identical to SEQ ID NO: 139462
  derived and/or modified sequence opt3 from neuraminidase__InfluenzaA__ACZ16343

SEQ ID NO: 139661 - RNA, 1410 nt, Artificial Sequence; identical to SEQ ID NO: 138754
  derived and/or modified sequence opt3 from neuraminidase__InfluenzaA__ACZ16353

SEQ ID NO: 139662 - RNA, 1410 nt, Artificial Sequence; identical to SEQ ID NO: 138754
  derived and/or modified sequence opt3 from neuraminidase__InfluenzaA__ACZ16363

SEQ ID NO: 139663 - RNA, 1410 nt, Artificial Sequence; identical to SEQ ID NO: 138744
  derived and/or modified sequence opt3 from neuraminidase__InfluenzaA__ACZ16373

SEQ ID NO: 139664 - RNA, 1410 nt, Artificial Sequence; identical to SEQ ID NO: 138754
  derived and/or modified sequence opt3 from neuraminidase__InfluenzaA__ACZ16383

SEQ ID NO: 139665 - RNA, 1410 nt, Artificial Sequence; identical to SEQ ID NO: 138754
  derived and/or modified sequence opt3 from neuraminidase__InfluenzaA__ACZ16393

SEQ ID NO: 139666 - RNA, 1410 nt, Artificial Sequence; identical to SEQ ID NO: 138754
  derived and/or modified sequence opt3 from neuraminidase__InfluenzaA__ACZ16403

SEQ ID NO: 139667 - RNA, 1410 nt, Artificial Sequence; identical to SEQ ID NO: 138754
  derived and/or modified sequence opt3 from neuraminidase__InfluenzaA__ACZ16423

SEQ ID NO: 139668 - RNA, 1410 nt, Artificial Sequence; identical to SEQ ID NO: 138754
  derived and/or modified sequence opt3 from neuraminidase__InfluenzaA__ACZ16433

SEQ ID NO: 139669 - RNA, 1410 nt, Artificial Sequence; identical to SEQ ID NO: 138754
  derived and/or modified sequence opt3 from neuraminidase__InfluenzaA__ACZ16443

SEQ ID NO: 139670 - RNA, 1410 nt, Artificial Sequence; identical to SEQ ID NO: 138754
  derived and/or modified sequence opt3 from neuraminidase__InfluenzaA__ACZ16453

SEQ ID NO: 139671 - RNA, 1410 nt, Artificial Sequence; identical to SEQ ID NO: 139462
  derived and/or modified sequence opt3 from neuraminidase__InfluenzaA__ACZ16463

SEQ ID NO: 139672 - RNA, 1410 nt, Artificial Sequence; identical to SEQ ID NO: 138754
  derived and/or modified sequence opt3 from neuraminidase__InfluenzaA__ACZ16483

SEQ ID NO: 139673 - RNA, 1410 nt, Artificial Sequence; identical to SEQ ID NO: 138754
  derived and/or modified sequence opt3 from neuraminidase__InfluenzaA__ACZ16493

SEQ ID NO: 139674 - RNA, 1410 nt, Artificial Sequence
  derived and/or modified sequence opt3 from neuraminidase__InfluenzaA__ACZ16503
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagauggaugcccccaauuaucauuacgaagagugcaguuguuacccugacagcuccgagauuacuugcgucugccgcgauaacuggcacgggucuaauagaccauggguuagcuucaaccagaaucucgaauaucagauaggauacaucuguucaggcauuuuuggcgacaacccgaggcccaaugauaaaaccgggaguugcggaccuguguccagcaacggugcgaauggcguaaagggguucucuuuuaaguauggaaacggcguguggaucggucggacaaaaucaaucaguagccgcaacggguucgagaugauuugggacccaaauggcuggaccggaacggacaacaauuuuuccauaaagcaagauaucgucggcauuaacgaauggucuggguacucggggagcuucgugcagcaucccgagcugacuggucuggacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 139675 - RNA, 1410 nt, Artificial Sequence; identical to SEQ ID NO: 139462
  derived and/or modified sequence opt3 from neuraminidase__InfluenzaA__ACZ16513

SEQ ID NO: 139676 - RNA, 1410 nt, Artificial Sequence; identical to SEQ ID NO: 138754
  derived and/or modified sequence opt3 from neuraminidase__InfluenzaA__ACZ16523

SEQ ID NO: 139677 - RNA, 1410 nt, Artificial Sequence; identical to SEQ ID NO: 138754
  derived and/or modified sequence opt3 from neuraminidase__InfluenzaA__ACZ16533

SEQ ID NO: 139678 - RNA, 1410 nt, Artificial Sequence; identical to SEQ ID NO: 138744
  derived and/or modified sequence opt3 from neuraminidase__InfluenzaA__ACZ16543

SEQ ID NO: 139679 - RNA, 1410 nt, Artificial Sequence; identical to SEQ ID NO: 138754
  derived and/or modified sequence opt3 from neuraminidase__InfluenzaA__ACZ16553

SEQ ID NO: 139680 - RNA, 1410 nt, Artificial Sequence; identical to SEQ ID NO: 138754
  derived and/or modified sequence opt3 from neuraminidase__InfluenzaA__ACZ16586

SEQ ID NO: 139681 - RNA, 1410 nt, Artificial Sequence; identical to SEQ ID NO: 138754
  derived and/or modified sequence opt3 from neuraminidase__InfluenzaA__ACZ16596

SEQ ID NO: 139682 - RNA, 1410 nt, Artificial Sequence; identical to SEQ ID NO: 138754
  derived and/or modified sequence opt3 from neuraminidase__InfluenzaA__ACZ16606

SEQ ID NO: 139683 - RNA, 1410 nt, Artificial Sequence; identical to SEQ ID NO: 138754
  derived and/or modified sequence opt3 from neuraminidase__InfluenzaA__ACZ16633

SEQ ID NO: 139684 - RNA, 1410 nt, Artificial Sequence
  derived and/or modified sequence opt3 from neuraminidase__InfluenzaA__ACZ16643
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugagauauaauggcaucauaaccgacacgauuaaguccuggaggaacaauaucuugcggacucaagagagcgagugugccugcgugaacgggucguguuucaccgucaugacagauggaccaucugacggccaggcuuccuacaagaucuuucgcauugaaaaagguaagaucgugaaaucaguggagaugaaugcccccaacuaucauuacgaagagugcaguuguuacccugauagcuccgagauuacuugcgucugcagagacaauuggcacgggucuaacaggccauggguuagcuucaaucagaaccucgaauaucagauaggauacaucuguucaggcauuuuuggcgauaauccgcggcccaacgacaagaccgggaguugcggaccuguguccagcaauggugcgaacggcguaaaaggguucucuuuuaaguauggaaacggcguguggaucggucgcacaaagucaaucaguagccgaaauggguucgagaugauuugggauccaaacggcuggaccggaacggacaauaacuuuuccauaaaacaagacaucgucggcauuaaugaauggucuggguacucggggagcuucgugcagcaucccgagcugacuggucuggauuguaucagaccuugcuucuggguugaacucauuaggggccggccaaaggagaacacaaucuggaccuccgggucaaguauaucuuuuuguggagugaauagcgacacugucggcugguccuggcccgauggugcagaguuaccguucacaaucgacaaauga

SEQ ID NO: 139685 - RNA, 1410 nt, Artificial Sequence; identical to SEQ ID NO: 138754
  derived and/or modified sequence opt3 from neuraminidase__InfluenzaA__ACZ16653

SEQ ID NO: 139686 - RNA, 1410 nt, Artificial Sequence; identical to SEQ ID NO: 138754
  derived and/or modified sequence opt3 from neuraminidase__InfluenzaA__ACZ16663

SEQ ID NO: 139687 - RNA, 1410 nt, Artificial Sequence; identical to SEQ ID NO: 138754
  derived and/or modified sequence opt3 from neuraminidase__InfluenzaA__ACZ16673

SEQ ID NO: 139688 - RNA, 1410 nt, Artificial Sequence; identical to SEQ ID NO: 138754
  derived and/or modified sequence opt3 from neuraminidase__InfluenzaA__ACZ16683

SEQ ID NO: 139689 - RNA, 1410 nt, Artificial Sequence; identical to SEQ ID NO: 138754
  derived and/or modified sequence opt3 from neuraminidase__InfluenzaA__ACZ16693

SEQ ID NO: 139690 - RNA, 1410 nt, Artificial Sequence; identical to SEQ ID NO: 138754
  derived and/or modified sequence opt3 from neuraminidase__InfluenzaA__ACZ16703

SEQ ID NO: 139691 - RNA, 1410 nt, Artificial Sequence; identical to SEQ ID NO: 138754
  derived and/or modified sequence opt3 from neuraminidase__InfluenzaA__ACZ16713

SEQ ID NO: 139692 - RNA, 1410 nt, Artificial Sequence; identical to SEQ ID NO: 138754
  derived and/or modified sequence opt3 from neuraminidase__InfluenzaA__ACZ16723

SEQ ID NO: 139693 - RNA, 1410 nt, Artificial Sequence; identical to SEQ ID NO: 138754
  derived and/or modified sequence opt3 from neuraminidase__InfluenzaA__ACZ16733

SEQ ID NO: 139694 - RNA, 1410 nt, Artificial Sequence; identical to SEQ ID NO: 138754
  derived and/or modified sequence opt3 from neuraminidase__InfluenzaA__ACZ16743

SEQ ID NO: 139695 - RNA, 1410 nt, Artificial Sequence; identical to SEQ ID NO: 138754
  derived and/or modified sequence opt3 from neuraminidase__InfluenzaA__ACZ16753

SEQ ID NO: 139696 - RNA, 1410 nt, Artificial Sequence; identical to SEQ ID NO: 138754
  derived and/or modified sequence opt3 from neuraminidase__InfluenzaA__ACZ16763

SEQ ID NO: 139697 - RNA, 1410 nt, Artificial Sequence; identical to SEQ ID NO: 138744
  derived and/or modified sequence opt3 from neuraminidase__InfluenzaA__ACZ16773

SEQ ID NO: 139698 - RNA, 1410 nt, Artificial Sequence; identical to SEQ ID NO: 138754
  derived and/or modified sequence opt3 from neuraminidase__InfluenzaA__ACZ16783

SEQ ID NO: 139699 - RNA, 1410 nt, Artificial Sequence; identical to SEQ ID NO: 138754
  derived and/or modified sequence opt3 from neuraminidase__InfluenzaA__ACZ16793

SEQ ID NO: 139700 - RNA, 1410 nt, Artificial Sequence; identical to SEQ ID NO: 138754
  derived and/or modified sequence opt3 from neuraminidase__InfluenzaA__ACZ16803

SEQ ID NO: 139701 - RNA, 1410 nt, Artificial Sequence; identical to SEQ ID NO: 138754
  derived and/or modified sequence opt3 from neuraminidase__InfluenzaA__ACZ16813

SEQ ID NO: 139702 - RNA, 1410 nt, Artificial Sequence; identical to SEQ ID NO: 138744
  derived and/or modified sequence opt3 from neuraminidase__InfluenzaA__ACZ16823

SEQ ID NO: 139703 - RNA, 1410 nt, Artificial Sequence; identical to SEQ ID NO: 138754
  derived and/or modified sequence opt3 from neuraminidase__InfluenzaA__ACZ16833

SEQ ID NO: 139704 - RNA, 1410 nt, Artificial Sequence; identical to SEQ ID NO: 138754
  derived and/or modified sequence opt3 from neuraminidase__InfluenzaA__ACZ16843

SEQ ID NO: 139705 - RNA, 1410 nt, Artificial Sequence; identical to SEQ ID NO: 139674
  derived and/or modified sequence opt3 from neuraminidase__InfluenzaA__ACZ16853

SEQ ID NO: 139706 - RNA, 1410 nt, Artificial Sequence; identical to SEQ ID NO: 138754
  derived and/or modified sequence opt3 from neuraminidase__InfluenzaA__ACZ16863

SEQ ID NO: 139707 - RNA, 1410 nt, Artificial Sequence; identical to SEQ ID NO: 138754
  derived and/or modified sequence opt3 from neuraminidase__InfluenzaA__ACZ16873

SEQ ID NO: 139708 - RNA, 1410 nt, Artificial Sequence; identical to SEQ ID NO: 138754
  derived and/or modified sequence opt3 from neuraminidase__InfluenzaA__ACZ16883

SEQ ID NO: 139709 - RNA, 1410 nt, Artificial Sequence; identical to SEQ ID NO: 138754
  derived and/or modified sequence opt3 from neuraminidase__InfluenzaA__ACZ16893

SEQ ID NO: 139710 - RNA, 1410 nt, Artificial Sequence; identical to SEQ ID NO: 138754
  derived and/or modified sequence opt3 from neuraminidase__InfluenzaA__ACZ16903

SEQ ID NO: 139711 - RNA, 1410 nt, Artificial Sequence; identical to SEQ ID NO: 138754
  derived and/or modified sequence opt3 from neuraminidase__InfluenzaA__ACZ16913

SEQ ID NO: 139712 - RNA, 1410 nt, Artificial Sequence; identical to SEQ ID NO: 138754
  derived and/or modified sequence opt3 from neuraminidase__InfluenzaA__ACZ16923

SEQ ID NO: 139713 - RNA, 1410 nt, Artificial Sequence; identical to SEQ ID NO: 138754
  derived and/or modified sequence opt3 from neuraminidase__InfluenzaA__ACZ16933

SEQ ID NO: 139714 - RNA, 1410 nt, Artificial Sequence; identical to SEQ ID NO: 138754
  derived and/or modified sequence opt3 from neuraminidase__InfluenzaA__ACZ16943

SEQ ID NO: 139715 - RNA, 1410 nt, Artificial Sequence; identical to SEQ ID NO: 138744
  derived and/or modified sequence opt3 from neuraminidase__InfluenzaA__ACZ16953

SEQ ID NO: 139716 - RNA, 1410 nt, Artificial Sequence; identical to SEQ ID NO: 138754
  derived and/or modified sequence opt3 from neuraminidase__InfluenzaA__ACZ16963

SEQ ID NO: 139717 - RNA, 1410 nt, Artificial Sequence; identical to SEQ ID NO: 138754
  derived and/or modified sequence opt3 from neuraminidase__InfluenzaA__ACZ16973

SEQ ID NO: 139718 - RNA, 1410 nt, Artificial Sequence; identical to SEQ ID NO: 138754
  derived and/or modified sequence opt3 from neuraminidase__InfluenzaA__ACZ16983

SEQ ID NO: 139719 - RNA, 1410 nt, Artificial Sequence; identical to SEQ ID NO: 138754
  derived and/or modified sequence opt3 from neuraminidase__InfluenzaA__ACZ16993

SEQ ID NO: 139720 - RNA, 1410 nt, Artificial Sequence; identical to SEQ ID NO: 138754
  derived and/or modified sequence opt3 from neuraminidase__InfluenzaA__ACZ17003

SEQ ID NO: 139721 - RNA, 1410 nt, Artificial Sequence; identical to SEQ ID NO: 138754
  derived and/or modified sequence opt3 from neuraminidase__InfluenzaA__ACZ17023

SEQ ID NO: 139722 - RNA, 1410 nt, Artificial Sequence; identical to SEQ ID NO: 138754
  derived and/or modified sequence opt3 from neuraminidase__InfluenzaA__ACZ17043

SEQ ID NO: 139723 - RNA, 1410 nt, Artificial Sequence; identical to SEQ ID NO: 138754
  derived and/or modified sequence opt3 from neuraminidase__InfluenzaA__ACZ17053

SEQ ID NO: 139724 - RNA, 1410 nt, Artificial Sequence
  derived and/or modified sequence opt3 from neuraminidase__InfluenzaA__ACZ17063
augaaccccaaucagaagaucauuaccauaggcagcgugugcaugacaaucgggauggccaaccugauucuccaaaucggaaauauuaucuccauauggaucucucacucaauucagcuuggugaccagaaccagaucgagacuuguaaucaaagugucauuacguacgaaaacaauaccuggguuaaccagacauaugugaauaucagcaacacuaauuucgcugcaggccaguccguagugucugucaaacuggccgggaacucgucauugugcccugugagcggaugggcgauauacaguaaggauaauuccauuagaaucggcucuaaaggugacguuuuugugauuagggagccauucaucagcuguuccccguuagaaugccggaccuuuuuccugacacagggggcucuacucaacgauaagcauucaaauggaaccaucaaagaccgcagucccuaucgaacucugaugagcuguccuauuggcgaggucccaucucccuacaacucccguuuugaaucaguggccuggagcgcaagugccugccacgauggcauaaacuggcuuacaaucgggauuucuggaccugacaauggugcuguagcaguucugaaguauaacggcaucauaaccgauacgauuaaguccuggagaaauaacaucuugaggacucaagagagcgagugugccugcgugaaugggucguguuucaccgucaugacagacggaccaucugauggccaggcuuccuacaaaaucuuucggauugaaaaggguaaaaucgugaagucaguggagaugaacgcccccaauuaucauuacgaagagugcaguuguuacccugacagcuccgagauuacuugcgucugccgcgauaacuggcacgggucuaauagaccauggguuagcuucaaccagaaucucgaauaucagauaggauacaucuguucaggcauuuuuggcgacaacccgaggcccaaugauaaaaccgggaguugcggaccuguguccagcaacggugcgaauggcguaaagggguucucuuuuaaguauggaaacggcguguggaucggucggacaaaaucaaucaguagccgcaacggguucgagaugauuugggacccaaauggcuggaccggaacggacaacaauuuuuccauaaagcaagauaucgucggcauuaacgaauggucuggguacucggguagcuucgugcagcaucccgagcugacuggacuggacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 139725 - RNA, 1410 nt, Artificial Sequence; identical to SEQ ID NO: 138754
  derived and/or modified sequence opt3 from neuraminidase__InfluenzaA__ACZ17073

SEQ ID NO: 139726 - RNA, 1410 nt, Artificial Sequence; identical to SEQ ID NO: 139462
  derived and/or modified sequence opt3 from neuraminidase__InfluenzaA__ACZ17083

SEQ ID NO: 139727 - RNA, 1410 nt, Artificial Sequence
  derived and/or modified sequence opt3 from neuraminidase__InfluenzaA__ACZ17093
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuugaaugccggaccuucuuuuuaacacagggggcucugcuaaaugacaagcauucaaacggaaccaucaaagaucgcagucccuaucgaacucucaugagcuguccuauuggcgaggucccaucucccuacaacucccguuucgaaucaguggccuggagcgcaagugccugccacgacggcauaaauuggcugacaaucgggauuucuggaccugauaacggugcuguagcaguucuuaaguauaauggcaucauaaccgacacgauuaaguccuggagaaacaauauccugaggacucaagagagcgagugugccugcgugaacgggucguguuuuaccgucaugacagauggaccaucugacggccaggcuuccuacaaaaucuuccggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuuuaaucagaacuuggaauaucagauaggauacaucuguucaggcauuuucggcgauaauccgaggcccaacgacaaaaccgggaguugcggaccuguguccagcaauggugcgaacggcguaaagggguuuucuuucaaguauggaaacggcguguggaucggucggacaaaaucaaucaguagccgcaauggguuugagaugauuugggauccaaacggcuggaccggaacggacaauaacuucuccauaaagcaagacaucgucggcauuaaugaauggucuggguacucggggagcuucgugcagcaucccgagcucacuggucuggauuguauccgaccuugcuuuuggguugaacugauuagaggcaggccaaaagagaacacaaucuggaccuccgggucaaguauaucuuucuguggagugaauagcgacacugucggcugguccuggcccgauggugcagagcucccguuuacaaucgacaaguga

SEQ ID NO: 139728 - RNA, 1410 nt, Artificial Sequence
  derived and/or modified sequence opt3 from neuraminidase__InfluenzaA__ACZ17113
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugaacgggugggcgauauacagcaaggacaauaguauuagaaucggcuccaaaggugauguuuuugugauuagggagccauucaucucuuguagcccguuagaaugccggaccuuuuuccugacacagggggcucuacucaacgacaagcauuccaacggaaccaucaaagaucgcucacccuaucgaacucugaugaguuguccuauuggcgaggucccaagccccuacaauucucguuuugaauccguggccuggucagcaagcgccugccacgacggcauaaacuggcuuacaaucgggauuaguggaccugauaauggugcuguagcaguucugaaguauaacggcaucauaaccgacacgauuaagucuuggagaaauaacaucuugaggacucaagaguccgagugugccugcgugaaugggagcuguuucaccgucaugacagauggaccaucggacggccaggcuucuuacaaaaucuuucggauugaaaaggguaaaaucgugaaguccguggagaugaacgcccccaauuaucauuacgaagagugcucauguuacccugauaguagcgagauuacuugcgucugccgcgacaacuggcacggguccaauagaccauggguuucuuucaaccagaaucucgaauaucagauaggauacaucuguagcggcauuuuuggcgauaacccgaggcccaaugacaaaaccgggucaugcggaccugugaguuccaacggugcgaacggcguaaagggguucagcuuuaaguauggaaauggcguguggaucggucggacaaaaucuaucucaagucgcaacggguucgagaugauuugggauccaaauggcuggaccggaacggacaacaauuuuagcauaaagcaagacaucgucggcauuaacgaaugguccggguacucuggaucguucgugcagcaucccgagcugacuggucuggauuguauccgaccuugcuucuggguugaacucauuagaggcaggccaaaagagaauacaaucuggaccagcggguccucaauaaguuuuuguggagugaacucugacacugucggcuggagcuggcccgauggugcagaguuaccguucacaaucgacaaguga

SEQ ID NO: 139729 - RNA, 1410 nt, Artificial Sequence; identical to SEQ ID NO: 138754
  derived and/or modified sequence opt3 from neuraminidase__InfluenzaA__ACZ17123

SEQ ID NO: 139730 - RNA, 1410 nt, Artificial Sequence; identical to SEQ ID NO: 138754
  derived and/or modified sequence opt3 from neuraminidase__InfluenzaA__ACZ17133

SEQ ID NO: 139731 - RNA, 1410 nt, Artificial Sequence
  derived and/or modified sequence opt3 from neuraminidase__InfluenzaA__ACZ17163
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaauaggaaccucgaauaucagauaggauacaucuguucaggcauuuuuggcgauaauccgcggcccaacgacaaaaccgggaguugcggaccuguguccagcaauggugcgaacggcguaaagggguucucuuuuaaguauggaaacggcguguggaucggucgcacaaaaucaaucaguagccgaaauggguucgagaugauuugggauccaaacggcuggaccggaacggacaauaacuuuuccauaaagcaggacaucgucggcauuaaugaauggucuggguacucggggagcuucgugcaacaucccgagcugacuggucuggauuguaucagaccuugcuucuggguugaacucauuaggggccggccaaaagagaacacaaucuggaccuccgggucaaguauaucuuuuuguggagugaauagcgacacugucggcugguccuggcccgauggugcagaguuaccguucacaaucgacaaguga

SEQ ID NO: 139732 - RNA, 1410 nt, Artificial Sequence; identical to SEQ ID NO: 139731
  derived and/or modified sequence opt3 from neuraminidase__InfluenzaA__ACZ17173

SEQ ID NO: 139733 - RNA, 1410 nt, Artificial Sequence; identical to SEQ ID NO: 139731
  derived and/or modified sequence opt3 from neuraminidase__InfluenzaA__ACZ17183

SEQ ID NO: 139734 - RNA, 1410 nt, Artificial Sequence; identical to SEQ ID NO: 139731
  derived and/or modified sequence opt3 from neuraminidase__InfluenzaA__ACZ17193

SEQ ID NO: 139735 - RNA, 1410 nt, Artificial Sequence; identical to SEQ ID NO: 139731
  derived and/or modified sequence opt3 from neuraminidase__InfluenzaA__ACZ17203

SEQ ID NO: 139736 - RNA, 1410 nt, Artificial Sequence; identical to SEQ ID NO: 138754
  derived and/or modified sequence opt3 from neuraminidase__InfluenzaA__ACZ17213

SEQ ID NO: 139737 - RNA, 1410 nt, Artificial Sequence; identical to SEQ ID NO: 138754
  derived and/or modified sequence opt3 from neuraminidase__InfluenzaA__ACZ17223

SEQ ID NO: 139738 - RNA, 1410 nt, Artificial Sequence; identical to SEQ ID NO: 138754
  derived and/or modified sequence opt3 from neuraminidase__InfluenzaA__ACZ17233

SEQ ID NO: 139739 - RNA, 1410 nt, Artificial Sequence; identical to SEQ ID NO: 138754
  derived and/or modified sequence opt3 from neuraminidase__InfluenzaA__ACZ17243

SEQ ID NO: 139740 - RNA, 1410 nt, Artificial Sequence; identical to SEQ ID NO: 138754
  derived and/or modified sequence opt3 from neuraminidase__InfluenzaA__ACZ17263

SEQ ID NO: 139741 - RNA, 1410 nt, Artificial Sequence
  derived and/or modified sequence opt3 from neuraminidase__InfluenzaA__ACZ17273
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcuucaauuggcuuacaauagggaucucuggaccugauaacggugcuguagcaguucugaaguauaauggcauuaucaccgacacgauaaaguccuggagaaacaauauuuugaggacucaagagagcgagugugccugcgugaacgggucguguuuuaccgucaugacagauggaccaucugacggccaggcuuccuacaaaaucuuccggaucgaaaaggguaaaauugugaagucaguggagaugaaugcccccaacuaucauuacgaagagugcaguuguuacccugauagcuccgagaucacuugcgucugccgcgacaauuggcacgggucuaacagaccauggguuagcuuuaaucagaaccucgaauaucagauuggauacauauguucaggcaucuucggcgauaauccgaggcccaacgacaaaaccgggaguugcggaccugugcuguccaauggugcgaacggcguaaagggguuuagcuucaaguauggaaacggcguguggauuggucggacaaaaucuaucucaagucgcaauggguuugagaugaucugggauccaaacggcuggaccggaacggacaauaacuucagcauuaagcaagacauagucggcaucaaugaaugguccggguacucuggaucguucgugcagcaucccgagcugacuggucucgauuguauucgaccuugcuuuuggguugaauuaaucagaggcaggccaaaagagaacacaauuuggaccagcggguccucaaucaguuucuguggagucaauucugacacugugggcuggagcuggcccgauggugcagagcugccguuuacaauagacaaguga

SEQ ID NO: 139742 - RNA, 1410 nt, Artificial Sequence; identical to SEQ ID NO: 138754
  derived and/or modified sequence opt3 from neuraminidase__InfluenzaA__ACZ17283

SEQ ID NO: 139743 - RNA, 1410 nt, Artificial Sequence; identical to SEQ ID NO: 138784
  derived and/or modified sequence opt3 from neuraminidase__InfluenzaA__ACZ17293

SEQ ID NO: 139744 - RNA, 1410 nt, Artificial Sequence; identical to SEQ ID NO: 138784
  derived and/or modified sequence opt3 from neuraminidase__InfluenzaA__ACZ17303

SEQ ID NO: 139745 - RNA, 1410 nt, Artificial Sequence; identical to SEQ ID NO: 138784
  derived and/or modified sequence opt3 from neuraminidase__InfluenzaA__ACZ17313

SEQ ID NO: 139746 - RNA, 1410 nt, Artificial Sequence; identical to SEQ ID NO: 138754
  derived and/or modified sequence opt3 from neuraminidase__InfluenzaA__ACZ17401

SEQ ID NO: 139747 - RNA, 1410 nt, Artificial Sequence; identical to SEQ ID NO: 138754
  derived and/or modified sequence opt3 from neuraminidase__InfluenzaA__ACZ17411

SEQ ID NO: 139748 - RNA, 1410 nt, Artificial Sequence; identical to SEQ ID NO: 138754
  derived and/or modified sequence opt3 from neuraminidase__InfluenzaA__ACZ17421

SEQ ID NO: 139749 - RNA, 1410 nt, Artificial Sequence
  derived and/or modified sequence opt3 from neuraminidase__InfluenzaA__ACZ17431
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuucggaucgaaaaggguaaaauugugaagucagucgagaugaacgcccccaauuaucauuacgaagagugcaguuguuacccugacagcuccgagaucacuugcguuugccgcgauaacuggcacgggucuaauagaccaugggugagcuucaaccagaaucucgaauaucagauuggauacauauguucaggcaucuuuggcgacaacccgaggcccaaugauaaaaccgggaguugcggaccuguauccagcaacggugcgaacggcgugaagggguucucuuuuaaguauggaaauggcgucuggauuggucggacaaaaucaaucaacagucgcaauggguucgagaugaucugggacccaaacggcuggaccggaacggauaauaacuuuagcauuaagcaagacauagugggcaucaaugaaugguccggguacucuggaucguucguucagcaucccgagcugacuggucuggacuguauucgaccuugcuucuggguggaacucaucagaggcaggccaaaagagaacacaauuuggaccagcggguccucaaucaguuuuuguggagucaauucugauacugugggcuggagcuggcccgacggugcagaguuaccguucacaauagauaaguga

SEQ ID NO: 139750 - RNA, 1410 nt, Artificial Sequence; identical to SEQ ID NO: 139749
  derived and/or modified sequence opt3 from neuraminidase__InfluenzaA__ACZ17441

SEQ ID NO: 139751 - RNA, 1410 nt, Artificial Sequence; identical to SEQ ID NO: 138744
  derived and/or modified sequence opt3 from neuraminidase__InfluenzaA__ACZ17451

SEQ ID NO: 139752 - RNA, 1410 nt, Artificial Sequence; identical to SEQ ID NO: 138754
  derived and/or modified sequence opt3 from neuraminidase__InfluenzaA__ACZ17461

SEQ ID NO: 139753 - RNA, 1410 nt, Artificial Sequence; identical to SEQ ID NO: 138754
  derived and/or modified sequence opt3 from neuraminidase__InfluenzaA__ACZ17471

SEQ ID NO: 139754 - RNA, 1410 nt, Artificial Sequence; identical to SEQ ID NO: 138784
  derived and/or modified sequence opt3 from neuraminidase__InfluenzaA__ACZ17481

SEQ ID NO: 139755 - RNA, 1410 nt, Artificial Sequence; identical to SEQ ID NO: 138754
  derived and/or modified sequence opt3 from neuraminidase__InfluenzaA__ACZ17491

SEQ ID NO: 139756 - RNA, 1410 nt, Artificial Sequence; identical to SEQ ID NO: 139220
  derived and/or modified sequence opt3 from neuraminidase__InfluenzaA__ACZ27803

SEQ ID NO: 139757 - RNA, 1410 nt, Artificial Sequence; identical to SEQ ID NO: 138744
  derived and/or modified sequence opt3 from neuraminidase__InfluenzaA__ACZ27813

SEQ ID NO: 139758 - RNA, 1410 nt, Artificial Sequence; identical to SEQ ID NO: 138754
  derived and/or modified sequence opt3 from neuraminidase__InfluenzaA__ACZ27823

SEQ ID NO: 139759 - RNA, 1410 nt, Artificial Sequence; identical to SEQ ID NO: 138744
  derived and/or modified sequence opt3 from neuraminidase__InfluenzaA__ACZ27833

SEQ ID NO: 139760 - RNA, 1410 nt, Artificial Sequence; identical to SEQ ID NO: 138754
  derived and/or modified sequence opt3 from neuraminidase__InfluenzaA__ACZ45022

SEQ ID NO: 139761 - RNA, 1410 nt, Artificial Sequence
  derived and/or modified sequence opt3 from neuraminidase__InfluenzaA__ACZ53958
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcaagauugugcacacauccucacugagcgggagugcucaacacguggaggaaugcucuuguuauccucgguacccaggaguccgcugcguuuguagagacaacuggaagggcuccaauaggccgaucguggauauaaacguaaaagacuacagcauugugucgucuuaugucugcuccggucuugugggggacacgccccggaagaaugauucaaguagcuccucucauuguuuggacccuaacaaugaggaaggaggccacggcguuaaagggugggccuucgaugacggaaacgauguguggaugggucgcaccaucagcgagaagcugcgaucaggcuacgagaccuuuaaagucaucgaaggguggaguaagccaaauuccaaacuacagauuaacagacaggugaucguagacaggggaaaucggagcggcuauucugguauuuucucaguugaggggaagaguugcauaaaccguuguuuuuacguggaacucauccgcggcagaaagcaggagacagaaguccuguggacuagcaauuccauuguggucuucugcggaaccucuggcacauaugggacuggaucgugucccgaugguagcgugcuuaaccugaugccuaucuga

SEQ ID NO: 139762 - RNA, 1410 nt, Artificial Sequence
  derived and/or modified sequence opt3 from neuraminidase__InfluenzaA__ACZ53969
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccgacuaucauagagagaaauaucaccgaaauuguauauuuaacaaacaccacuaucgagaaggaaauuugucccaaacuggcagaguacaggaauuggucaaagccucagugcaacaucacaggguucgccccauuuaguaaagacaauagcauacggcuauccgcgggaggugauauuugggugacccgcgagcccuaugucucuugugacccugauaagugcuaccaauucgcucucggccaggggacgacucugaacaauggacauucgaacgacaccgugcacgaucgaacaccauaucguacucuucugaugaaugaauugggcguucccuuucaucucgguaccaaacagguguguaucgccuggucaagcaguuccugccacgacgggaaggcauggcugcaugucugugugacaggagaugacgagaacgccaccgcuucuuucauuuacaauggcagacugguagauagcaucggcuccuggucaaagaaaauccucaggacgcaggaaagugagugcguuuguauuaacgggacuugcacaguggucaugaccgacggaagcgcaucugguaaggccgauacuaaaauauuauuuaucgaggaaggcgagauugugcacacauccccucugucagggagcgcucaacacguggaagagugcaguuguuauccacgguacccgggaguccgcugcguuuguagagacaacuggaagggcucuaauaggcccaucguggauauaaacguaaaggacuacuccauugugagcucguaugucugcucuggucuugugggggacaccccucggaaaaaugauuccucaaguagcucccauuguuuggacccaaacaaugaagagggaggccacggcguuaaggggugggccuucgaugacggaaacgauguguggaugggucgcacgaucucugagaaaagccgaucaggcuacgaaaccuuuaaggucaucgagggguggaguaaacccaauuccaagcugcagauuaacagacaggugaucguagacaggggaaaucggagcggcuauucugguauuuucucaguugaagggaaaaguugcauaaaccguuguuuuuacguggagcuaauccgcggcagaaagcaggaaacagagguccucuggacuagcaauuccauuguggucuucugcggaaccucuggcacauaugggacuggaucguggccugaugguagcgugcugaaccuuaugccaaucuga

SEQ ID NO: 139763 - RNA, 1410 nt, Artificial Sequence
  derived and/or modified sequence opt3 from neuraminidase__InfluenzaA__ACZ53980
augaaccccaaucagaacaagcugccuaucggcagcgugucccucaccauugccacaauaugcuuccuuaugcaaaucgcuauucugaaaacuacggucaccuugcacuuuaagcaguacgaguguaauucuccaccgaacaaucagguuauguuaugcgaacccacaaucauugagagaaaccugacuaaaaucguguaucuaaccaauacaaccauaaagaaagaaaucuguccuaagcagccaaaguacaggaacuggucaaaacccaagugcaaaauuacugagcucgcaccuuucaguaaggacaauagcauccggcuguccgccgggggagauauuuggguaacacgcgaaccauaugugucuugugaccccgauaaaugcuaccaauuugcgcuuggucagggcaccacgcugaacaaugggcauucgaacgacacuguccacgaucgaaccccuuaucguacauugcucaugaaugagcugggagugccauuccaucugggcacuaagcagguuuguaucgcuuggucaagcaguuccugccacgacgguaaggccuggcuccauguguguauaaccggggaugacaaaaacgcaacagccucuuuuauuuacaauggaagauuagucgauagcaucguguccuggucaaaggagauucugaggacccaggaaagugagugcguauguaucaacggcacgugcacuguugugaugacagacggcagcgcuucugggaaagcagauaccaagauccuuuucauugaagagggaaaaauaguccacaucuccccguugucagguagcgcccaacacguggaggaaugcaguuguuauccccgguacccuggcgugcgcugcauuuguagagacaacuggaaggggucuaauaggccagucguugauaucaacauggaggacuacuccauagacagcucguaugugugcucuggacugguaggcgauacuccccggaaaaaugacuccucaaguagcucccauugucuagauccuaacaaugaagagggugggcacggagugaagggcugggcuuuugacgauggcaacgacgucuggauggggcgcacaauuucugaaaagcuccgaagcggauacgagaccuucaaagugaucgguggcuggucaaagccaaauaguaaacugcagaucaacagacagguuauuguggauagggggaaucgguccggauauagcggcaucuuuucugucgaggguaagucaugcauuaaccguuguuucuacguggaacuuauacgcgggagaaaacaggagacggaaguacuguggaccaguaauagcaucguuguguuuugcggcacauccggaacuuauggcaccgggucuuggcccgacggaucggucuugaaccucaugccgauuuga

SEQ ID NO: 139764 - RNA, 1410 nt, Artificial Sequence; identical to SEQ ID NO: 138754
  derived and/or modified sequence opt3 from neuraminidase__InfluenzaA__ACZ56082

SEQ ID NO: 139765 - RNA, 1410 nt, Artificial Sequence; identical to SEQ ID NO: 139337
  derived and/or modified sequence opt3 from neuraminidase__InfluenzaA__ACZ57183

SEQ ID NO: 139766 - RNA, 1413 nt, Artificial Sequence
  derived and/or modified sequence opt3 from neuraminidase__InfluenzaA__ACZ81542
augaaccccaaucagaaggugaucaccauuggcagcauauccaucgccauugggaucauuucucugaugcuccaaaucggaaacauaaucucaauuugggcuagucacagcauccagacagguucccagaauaacacuggcauuugcaaucagagaaucauaacguacgagaacucuaccugggugaaucauacauauguuaacauuaauaacacuaaugugguagcaggggaagacaaaaccucggugacacuugccggaaacucaagccuguguaguaucuccggcugggcgauuuacaccaaggauaauucuaucaggaucgguagcaaaggggacgucuucgugauucgggagccuuuuauauccugcucacacuuggaaugucgcacuuucuuuuuaacacaaggagcucugcuaaacgauaagcauaguaauggcaccguuaaagaccgaagcccauaucgugcccucaugucuugcccgcugggcgaggcacccuccccuuacaacucaaaguucgaaagcguggccuggagugcuucugcaugucacgaugggaugggauggcuuacgaucgguauuuccggcccagacaacggggccgucgcugugcugaaguauaauggaaucauaacuggcaccauuaaaagcuggaagaaacagaucuugagaacacaggagucggagugcguauguaugaacgguucuugcuuuacuaucaugaccgaugggcccuccaauaaggccgcgucauacaaaauuuucaagaucgaaaagggaaaaguuacaaagaguauugagcucaacgcaccuaauuuuuauuacgaagaguguagcugcuacccagacaccggcauagugaugugugucugcagggauaacuggcauggcuccaaucggcccugggugucuuucaaccagaaucuggacuaucaaaucggguacauuugcagcggaguguuuggugauaacccucgcccagaggacggcgaagggucauguaauccggucacgguugauggagccaacggcgugaaagguuucaguuauaaguacgggaauggcguauggaucggaagaacuaaauccaacaggcugcggaagggcuuugagaugaucugggaccccaauggguggacaaacaccgacagcgauuucucugugaaacaggacgucguggcuauuacugauuggucaggauauagugguagcuuuguucagcacccugaacucacaggcuuagacugcauacgcccauguuucuggguggagcugguccgagggcuucccagagaaaacaccacgaucuggaccuccggaucuucgauuagcuucugcggcgucaauuccgauacagccaacuggucauggccugacggugcagaguugccauuuacuaucgauaaguga

SEQ ID NO: 139767 - RNA, 1413 nt, Artificial Sequence
  derived and/or modified sequence opt3 from neuraminidase__InfluenzaA__ACZ81543
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacaauaccugggugaaccauacauaugucaauaucaacaauacuaacguuguggcaggggaagacaaaaccucuguaacacuugccggaaauucgucacuguguagcauuaguggcugggcgaucuacaccaaggauaacuccaucaggauugguucuaaaggggacguguucgucauacgggagccuuuuaucagcugcucccacuuggaaugucgcacuuucuuuuuaacacaaggagcucugcuaaaugauaagcauucaaacggcaccgugaaagaccgaaguccauaucgugcccucaugagcugcccgcugggcgaggcacccucuccuuacaacuccaaguucgaaucaguugccuggagcgcuagugcaugucacgaugggaugggauggcuuacgauugguaucucuggcccagacaauggggccguggcuguccugaaguauaacggaauaauuacuggcaccaucaaauccuggaaggagcagaucuugagaacacaggagagcgaaugcguguguaugaaugguucgugcuuuacuauuaugaccgaugggcccucuaacaaagccgcguccuacaagaucuucaaaauugagaagggaaagguaacaaaaucaauagaacucaaugcaccuaacuuuuauuacgaggaguguaguugcuacccagacaccggcaucguuaugugugugugcagggauaauuggcauggcagcaaccggcccugggucuccuucaaucagaaccuggacuaucaaacgggguacauuugcucuggaguguuuggugauaauccucgcccagaagacggcgaggggagcuguaacccggugacugucgauggagccaauggcguuaaggguuucucauauaaauacgggaacggcguguggaucggaagaacaaagaguaauaggcugcggaaaggcuuugaaaugaucugggaccccaacggguggaccaacacugacuccgauuucagcguaaagcaggacguggucgcuauuacagauuggucuggauauucagguaguuuugugcagcacccugagcucaccggcuuagacugcauacgcccauguuucuggguugaacuggugcgagggcuucccagagagaauacgaccaucuggacaagcggauccucuauuucguucugcggcgucaacagcgauacugccaauugguccuggccugacggugcagaguugccauuuaccaucgauaaauga

SEQ ID NO: 139768 - RNA, 1410 nt, Artificial Sequence
  derived and/or modified sequence opt3 from neuraminidase__InfluenzaA__ACZ81546
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacagggagcgcaccauucuccaaagauaacucuauucggcugucggccggaggugacaucuggguaacccgcgagcccuaugugucaugcgauccugacaaguguuaccaauuugcgcuaggccaggggacgacucucaauaacguccauagcaauaacaccgugcacgaucgaacaccauaucguacucugcuuaugaaugaacugggaguucccuuccauuugggcaccaaacaggugugcauugcuuggaguuccucuagcugucacgacgguaaggccuggcuccaugucugcaucacaggggaugacaagaacgcaaccgccuccuuuaucuacaauggaagacugguggauucaguaguuaguuggagcaaagagauucugaggacgcaggaaucugagugugugugcauaaacggcacuuguacagucgugaugaccgacggcuccgcuucagggaaggcagauacuaaaauccucuucauugaggaaggaaagaucgugcacacaagcaccuuaagugguucugcccaacacgucgaggaaugcuccugcuauccucgguacccaggcguucgcugugugugcagagacaacuggaaggggagcaauaggccgauaguagauauuaacaucaaagaccauucgaucgugucuuccuacgucuguucaggacuggugggcgacacgccccggaagaaugauaguagcuccucuagccacugccuugacccuaacaaugaggaaggugggcauggaguuaaaggcugggcuuuugaugacggcaacgauguguggauggggcgcaccauuucagagaagagucgauugggauaugagacauucaaagucaucgaagguugguccaauccaaagagcaaacugcagauuaacagacaggugauaguagacaggggcaaucggucuggguacucaggaaucuuuaguguugagggcaagagcuguauuaaccguugcuucuauguggaacuaauccgcgguagaaaggaggaaacugagguccucuggaccuccaauucuaucguggucuuuugugggacaucgggcacuuacggaaccggcagcuggcccgauggggccgacauuaaccugaugccuauauga

SEQ ID NO: 139769 - RNA, 1410 nt, Artificial Sequence
  derived and/or modified sequence opt3 from neuraminidase__InfluenzaA__ACZ81547
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacacgaaagaccacagcaucgugucgucuuacgucuguuccggacuggugggcgacacccccaggaagaaugauucaaguagcuccucucauugccuugacccuaacaaugaggaaggugggcacggaguuaaaggcugggcuuucgaugacggcaacgauguguggauggggcgaacaaucagcgagaagucaagauugggauaugagacuuuuaaagucauugaagguuggaguaauccaaaguccaaacugcagaucaaccgccaggugauuguagacaagggcaaucggagcggguacucuggaauauucucaguugagggcaagaguuguaucaaccguugcuuuuauguggaacuaauucgcgguagaaaagaggaaaccgagguccucuggacaagcaauuccaucguggucuucugugggacuucuggcaccuacggaacaggcucguggcccgauggggccgacaucaaccugaugccuauuuga

SEQ ID NO: 139770 - RNA, 1410 nt, Artificial Sequence; identical to SEQ ID NO: 138754
  derived and/or modified sequence opt3 from neuraminidase__InfluenzaA__ACZ81634

SEQ ID NO: 139771 - RNA, 1410 nt, Artificial Sequence
  derived and/or modified sequence opt3 from neuraminidase__InfluenzaA__ACZ81644
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucauuggcaucaaugaauggucuggguacucggggagcuucguccagcaucccgagcugacuggucuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 139772 - RNA, 1410 nt, Artificial Sequence
  derived and/or modified sequence opt3 from neuraminidase__InfluenzaA__ACZ81653
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucugaacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 139773 - RNA, 1410 nt, Artificial Sequence; identical to SEQ ID NO: 138754
  derived and/or modified sequence opt3 from neuraminidase__InfluenzaA__ACZ95840

SEQ ID NO: 139774 - RNA, 1410 nt, Artificial Sequence; identical to SEQ ID NO: 138754
  derived and/or modified sequence opt3 from neuraminidase__InfluenzaA__ACZ95850

SEQ ID NO: 139775 - RNA, 1410 nt, Artificial Sequence; identical to SEQ ID NO: 138754
  derived and/or modified sequence opt3 from neuraminidase__InfluenzaA__ACZ95860

SEQ ID NO: 139776 - RNA, 1410 nt, Artificial Sequence; identical to SEQ ID NO: 138754
  derived and/or modified sequence opt3 from neuraminidase__InfluenzaA__ACZ95870

SEQ ID NO: 139777 - RNA, 1410 nt, Artificial Sequence; identical to SEQ ID NO: 138754
  derived and/or modified sequence opt3 from neuraminidase__InfluenzaA__ACZ95880

SEQ ID NO: 139778 - RNA, 1410 nt, Artificial Sequence; identical to SEQ ID NO: 138754
  derived and/or modified sequence opt3 from neuraminidase__InfluenzaA__ACZ95890

SEQ ID NO: 139779 - RNA, 1410 nt, Artificial Sequence; identical to SEQ ID NO: 138754
  derived and/or modified sequence opt3 from neuraminidase__InfluenzaA__ACZ95900

SEQ ID NO: 139780 - RNA, 1410 nt, Artificial Sequence; identical to SEQ ID NO: 138754
  derived and/or modified sequence opt3 from neuraminidase__InfluenzaA__ACZ95910

SEQ ID NO: 139781 - RNA, 1410 nt, Artificial Sequence; identical to SEQ ID NO: 138754
  derived and/or modified sequence opt3 from neuraminidase__InfluenzaA__ACZ95920

SEQ ID NO: 139782 - RNA, 1410 nt, Artificial Sequence; identical to SEQ ID NO: 139641
  derived and/or modified sequence opt3 from neuraminidase__InfluenzaA__ACZ95930

SEQ ID NO: 139783 - RNA, 1410 nt, Artificial Sequence; identical to SEQ ID NO: 138754
  derived and/or modified sequence opt3 from neuraminidase__InfluenzaA__ACZ95940

SEQ ID NO: 139784 - RNA, 1410 nt, Artificial Sequence; identical to SEQ ID NO: 139771
  derived and/or modified sequence opt3 from neuraminidase__InfluenzaA__ACZ95950

SEQ ID NO: 139785 - RNA, 1410 nt, Artificial Sequence; identical to SEQ ID NO: 138754
  derived and/or modified sequence opt3 from neuraminidase__InfluenzaA__ACZ95960

SEQ ID NO: 139786 - RNA, 1410 nt, Artificial Sequence; identical to SEQ ID NO: 139771
  derived and/or modified sequence opt3 from neuraminidase__InfluenzaA__ACZ95970

SEQ ID NO: 139787 - RNA, 1410 nt, Artificial Sequence; identical to SEQ ID NO: 138754
  derived and/or modified sequence opt3 from neuraminidase__InfluenzaA__ACZ95980

SEQ ID NO: 139788 - RNA, 1410 nt, Artificial Sequence; identical to SEQ ID NO: 138754
  derived and/or modified sequence opt3 from neuraminidase__InfluenzaA__ACZ95990

SEQ ID NO: 139789 - RNA, 1410 nt, Artificial Sequence; identical to SEQ ID NO: 138754
  derived and/or modified sequence opt3 from neuraminidase__InfluenzaA__ACZ96000

SEQ ID NO: 139790 - RNA, 1410 nt, Artificial Sequence; identical to SEQ ID NO: 138754
  derived and/or modified sequence opt3 from neuraminidase__InfluenzaA__ACZ96010

SEQ ID NO: 139791 - RNA, 1410 nt, Artificial Sequence
  derived and/or modified sequence opt3 from neuraminidase__InfluenzaA__ACZ96020
augaaccccaaucagaagaucauuaccauaggcagcgugugcaugacaaucgggauggccaaccugauucuccaaaucggaaauauuauccuuauauggaucucccacucuauucagcuggguaaccagaaucagacugagacguguaaccaaucagucaucaccuacgaaaauaacacauggguuaaucagacuuaugugaacauuaguaauaccaacuucgcugcaggccagagcguaguguccgucaaauuggccggaaauucuucguuaugcccugugucagggugggcgaucuacagcaaggacaacaguguuagaauaggcuccaaaggugauguguuugucauuagggagccauucaucucuuguagcccgcuggaaugccggacauuuuuccuaacccagggggcucuccugaaugacaagcauuccaacggaacuauuaaagaucgcucacccuaucgaacacuuaugaguuguccuaucggcgaggugccaagccccuacaacucucguuuugaauccguagccuggucagcaagcgccugccacgacggcaucaauuggcugaccauugggauaaguggaccugauaacggugcuguugcaguguugaaguauaauggcaucauuacggacacuaucaagucuuggagaaacaauauacucaggacccaagaguccgagugugccugcgucaacgggagcuguuucacagugaugacugauggaccaucgaauggccaggcuucuuacaaaauuuuucggaucgaaaaggguaaaaucgugaaguccgucgagaugaacgcccccaauuaucauuacgaagagugcucauguuacccugacaguagcgagauuaccugcguuugccgcgauaacuggcacggguccaauagaccaugggugucuuucaaccagaaucuggaauaucagaucggauacauuuguagcggcauauuuggcgacaacccgaggcccaucgauaaaacagggucaugcggaccuguaaguuccaauggugcgaacggcgugaagggguucagcuuuaaguauggaaacggcgucuggauuggucggaccaaaucuaucucaagucgcaauggguucgagaugaucugggacccaaacggcuggacgggaacugauaauaacuuuagcauuaagcaagacauagugggcaucaaugaaugguccggguacucuggaucguucguucagcaucccgagcugacaggucucgacuguauucgaccuugcuucuggguggaauuaaucagaggcaggccaaaagagaacaccauuuggacuagcggguccucaaucaguuuuuguggagucaauucugauacagugggcuggagcuggcccgacggugcagagcugccguucaccauagauaaguga

SEQ ID NO: 139792 - RNA, 1410 nt, Artificial Sequence; identical to SEQ ID NO: 138754
  derived and/or modified sequence opt3 from neuraminidase__InfluenzaA__ACZ96050

SEQ ID NO: 139793 - RNA, 1410 nt, Artificial Sequence; identical to SEQ ID NO: 138754
  derived and/or modified sequence opt3 from neuraminidase__InfluenzaA__ACZ96060

SEQ ID NO: 139794 - RNA, 1410 nt, Artificial Sequence; identical to SEQ ID NO: 138754
  derived and/or modified sequence opt3 from neuraminidase__InfluenzaA__ACZ96072

SEQ ID NO: 139795 - RNA, 1410 nt, Artificial Sequence; identical to SEQ ID NO: 138754
  derived and/or modified sequence opt3 from neuraminidase__InfluenzaA__ACZ96082

SEQ ID NO: 139796 - RNA, 1410 nt, Artificial Sequence; identical to SEQ ID NO: 138754
  derived and/or modified sequence opt3 from neuraminidase__InfluenzaA__ACZ96092

SEQ ID NO: 139797 - RNA, 1410 nt, Artificial Sequence; identical to SEQ ID NO: 138754
  derived and/or modified sequence opt3 from neuraminidase__InfluenzaA__ACZ96102

SEQ ID NO: 139798 - RNA, 1410 nt, Artificial Sequence; identical to SEQ ID NO: 138754
  derived and/or modified sequence opt3 from neuraminidase__InfluenzaA__ACZ96112

SEQ ID NO: 139799 - RNA, 1410 nt, Artificial Sequence
  derived and/or modified sequence opt3 from neuraminidase__InfluenzaA__ACZ96122
augaaccccaaucagaagaucauuaccauaggcagcgugugcaugacaaucgggauggccaaccugauucuccaaaucggaaauauuaucuccauauggaucucucacucaauucagcuugguaaccagaaucagaucgaggcuuguaaccaaagugucauuacuuacgaaaauaacacguggguuaaucagaccuaugugaacaucagcaauacaaacuucgcagccggccaguccguagugucugucaaacuggcgggaaauucgucauugugcccugugagcggaugggcuauauacaguaaggacaacuccauuagaaucggcucuaaaggugauguuuuugugauuagggagccauucaucagcuguuccccguuagaaugccggaccuuuuuccugacucagggggcccuacucaaugacaagcauucaaacggaacaaucaaagaucgcagucccuaucgaacccugaugagcuguccuauuggcgaggucccaucucccuacaacucccguuuugaaucaguggcauggagcgccagugcuugccacgacggcauaaauuggcuuacuaucgggauuucuggaccugauaacggugcaguagccguucugaaguauaauggcaucauaacagacaccauuaaguccuggagaaacaauaucuugaggacgcaagagagcgagugugcuugcgugaacgggucguguuucacugucaugaccgauggaccaucugacggccaggccuccuacaaaaucuuucggauugaaaaggguaaaaucgugaagucaguggagaugaaugcgcccaacuaucauuacgaagagugcaguuguuacccugauagcuccgagauuacaugcgucugccgcgacaauuggcacgggucuaacagaccauggguuagcuucaaucagaaccucgaauaucagauaggauacaucuguucaggcauuuuuggcgauaauccgaggcccaacgacaaaacugggaguugcggaccuguguccagcaauggugcaaacggcguaaagggguucucuuuuaaguauggaaacggcguguggaucggucggaccaaaucaaucaguagccgcaauggguucgagaugauuugggauccaaacggcuggacaggaaaggacaauaacuuuuccauaaaacaagacaucgucggcauuaaugaauggucuggguacucggggagcuucgugcagcaucccgagcugaccggucuggauuguauccgaccuugcuucuggguugaacucauuagaggcaggccaaaggagaacacgaucuggacuuccgggucaaguauaucuuuuuguggaaucaauagcgacacagugggcugguccuggcccgauggugccgaguuaccguucaccauugacaaauga

SEQ ID NO: 139800 - RNA, 1410 nt, Artificial Sequence; identical to SEQ ID NO: 138754
  derived and/or modified sequence opt3 from neuraminidase__InfluenzaA__ACZ96132

SEQ ID NO: 139801 - RNA, 1410 nt, Artificial Sequence; identical to SEQ ID NO: 138754
  derived and/or modified sequence opt3 from neuraminidase__InfluenzaA__ACZ96142

SEQ ID NO: 139802 - RNA, 1410 nt, Artificial Sequence; identical to SEQ ID NO: 138754
  derived and/or modified sequence opt3 from neuraminidase__InfluenzaA__ACZ96152

SEQ ID NO: 139803 - RNA, 1410 nt, Artificial Sequence; identical to SEQ ID NO: 138754
  derived and/or modified sequence opt3 from neuraminidase__InfluenzaA__ACZ96162

SEQ ID NO: 139804 - RNA, 1410 nt, Artificial Sequence; identical to SEQ ID NO: 138754
  derived and/or modified sequence opt3 from neuraminidase__InfluenzaA__ACZ96172

SEQ ID NO: 139805 - RNA, 1410 nt, Artificial Sequence
  derived and/or modified sequence opt3 from neuraminidase__InfluenzaA__ACZ96182
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugaccgccauucaaacggaaccaucaaggaucgaagucccuaucguacucugaugagcuguccuauuggcgaggucccaucucccuacaacuccagauuugaaucaguggccuggagcgcaagugccugccacgacggcauaaauuggcuuacaaucgggauuucuggaccugauaacggugcuguagcaguucugaaauauaauggcaucauaaccgacacgauuaaguccuggaggaacaauaucuugcggacucaagagagcgagugugccugcgugaacgggucguguuucaccgucaugacagauggaccaucugacggccaggcuuccuacaagaucuuucgcauugaaaaagguaagaucgugaaaucaguggagaugaaugcccccaacuaucauuacgaagagugcaguuguuacccugauagcuccgagauuacuugcgucugcagagacaauuggcacgggucuaacaggccauggguuagcuucaaucagaaccucgaauaucagauaggauacaucuguucaggcauuuuuggcgauaauccgcggcccaacgacaagaccgggaguugcggaccuguguccagcaauggugcgaacggcguaaaaggguucucuuuuaaguauggaaacggcguguggaucggucgcacaaagucaaucaguagccgaaauggguucgagaugauuugggauccaaacggcuggaccggaacggacaauaacuuuuccauaaaacaagacaucgucggcauuaaugaauggucuggguacucggggagcuucgugcagcaucccgagcugacuggucuggauuguaucagaccuugcuucuggguugaacucauuaggggccggccaaaggagaacacaaucuggaccuccgggucaaguauaucuuuuuguggagugaauagcgacacugucggcugguccuggcccgauggugcagaguuaccguucacaaucgacaaauga

SEQ ID NO: 139806 - RNA, 1410 nt, Artificial Sequence
  derived and/or modified sequence opt3 from neuraminidase__InfluenzaA__ACZ96192
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggaguaacgacaaaaccggguccugcggacccgugagcucuaauggugcgaacggcguaaagggguucucauuuaaguauggaaacggcguguggaucggucggacaaaaaguaucagcucccgcaauggguucgagaugauuugggauccuaacggcuggaccggaacggacaauaacuuuucuauaaagcaagacaucgucggcauuaaugaauggucgggguacagcggauccuucgugcagcauccagagcugacuggucuggauuguauccgacccugcuucuggguugaacucauuagaggcaggccuaaagagaacacaaucuggaccucagggaguucuauaucguuuuguggagucaauuccgacacugugggcuggucauggccagauggugcagaguuacccuucacaaucgacaaguga

SEQ ID NO: 139807 - RNA, 1410 nt, Artificial Sequence
  derived and/or modified sequence opt3 from neuraminidase__InfluenzaA__ACZ96232
augaaccccaaucagaagaucauuaccauaggcagcgugugcaugacagucgggauggccaaccugauccuccaaauuggaaauaucauuuccaucuggauaucucacucaauccagcuugguaaccagaaucagauugagacuuguaaccaaaguguuaucacguacgaaaauaacaccugggugaaucagacauauguaaacauuagcaauacuaacuucgcugcaggccaguccguggucucugugaaacuggccggaaauucgucauugugcccuguuagcggaugggcgaucuacaguaaggacaacuccauaagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaaugacuuuuccauuaagcaagauauagugggcaucaacgaauggucuggguacucggggagcuucguucagcaucccgagcugacuggucuggacuguauucgaccuugcuucuggguggaacucaucagaggcaggccaaaagagaauacaauuuggaccuccgggucaaguaucucuuuuuguggagucaacagcgauacugugggcugguccuggcccgacggugcagaguuaccguucacaauagauaaguga

SEQ ID NO: 139808 - RNA, 1410 nt, Artificial Sequence
  derived and/or modified sequence opt3 from neuraminidase__InfluenzaA__ACZ96242
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagaguccacaaucuggaccucagggaguucuaucagcuuuuguggagugaacuccgacacugucggcuggucauggcccgauggugcagaguuaccguucacaauagacaaguga

SEQ ID NO: 139809 - RNA, 1410 nt, Artificial Sequence; identical to SEQ ID NO: 138754
  derived and/or modified sequence opt3 from neuraminidase__InfluenzaA__ACZ96252

SEQ ID NO: 139810 - RNA, 1410 nt, Artificial Sequence; identical to SEQ ID NO: 138754
  derived and/or modified sequence opt3 from neuraminidase__InfluenzaA__ACZ96292

SEQ ID NO: 139811 - RNA, 1410 nt, Artificial Sequence; identical to SEQ ID NO: 138754
  derived and/or modified sequence opt3 from neuraminidase__InfluenzaA__ACZ96302

SEQ ID NO: 139812 - RNA, 1410 nt, Artificial Sequence; identical to SEQ ID NO: 138754
  derived and/or modified sequence opt3 from neuraminidase__InfluenzaA__ACZ96312

SEQ ID NO: 139813 - RNA, 1410 nt, Artificial Sequence
  derived and/or modified sequence opt3 from neuraminidase__InfluenzaA__ACZ96322
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacugaccggaaauucgucauugugcccugugagcggaugggccauauacaguaaggacaacuccauuagaaucggcucuaaaggugauguuuuugugauuagggagccauucaucagcuguuccccguuagaaugccggacauuuuuccugacccagggggcgcuacucaaugacaagcauucaaacggaacuaucaaagaucgcagucccuaucgaacacugaugagcuguccuauuggcgaggucccaucucccuacaacucccguuuugaaucaguggcuuggagcgccagugcaugccacgacggcauaaauuggcuuaccaucgggauuucuggaccugauaacggugccguagcuguucugaaguauaauggcaucauaacggacacuauuaaguccuggagaaacaauaucuugaggacccaagagagcgagugugcaugcgugaacgggucguguuucacagucaugacugauggaccaucugacggccaggccuccuacaaaaucuuucggauugaaaaggguaaaaucgugaagucaguggagaugaaugcucccaacuaucauuacgaagagugcaguuguuacccugauagcuccgagauuaccugcgucugccgcgacaauuggcacgggucuaacagaccauggguuagcuucaaucagaaccucgaauaucagauaggauacaucuguucaggcauuuuuggcgauaauccgaggcccaacgacaaaacagggaguugcggaccuguguccagcaauggugccaacggcguaaagggguucucuuuuaaguauggaaacggcguguggaucggucggaccaaaucaaucaguagccgcaauggguucgagaugauuugggauccaaacggcuggacgggaacugacaauaacuuuuccauaaagcaagacaucgucggcauuaaugaauggucuggguacucggggagcuucgugcagcaucccgagcugacaggucuggauuguauccgaccuugcuucuggguugaacucauuagaggcaggccaaaagagaacaccaucuggacuuccgggucaaguauaucuuuuuguggagugaauagcgacacagucggcugguccuggcccgauggugcggaguuaccguucaccaucgacaaguga

SEQ ID NO: 139814 - RNA, 1410 nt, Artificial Sequence; identical to SEQ ID NO: 139813
  derived and/or modified sequence opt3 from neuraminidase__InfluenzaA__ACZ96332

SEQ ID NO: 139815 - RNA, 1410 nt, Artificial Sequence; identical to SEQ ID NO: 138754
  derived and/or modified sequence opt3 from neuraminidase__InfluenzaA__ACZ96352

SEQ ID NO: 139816 - RNA, 1410 nt, Artificial Sequence; identical to SEQ ID NO: 139813
  derived and/or modified sequence opt3 from neuraminidase__InfluenzaA__ACZ96362

SEQ ID NO: 139817 - RNA, 1410 nt, Artificial Sequence; identical to SEQ ID NO: 138754
  derived and/or modified sequence opt3 from neuraminidase__InfluenzaA__ACZ96375

SEQ ID NO: 139818 - RNA, 1410 nt, Artificial Sequence; identical to SEQ ID NO: 139813
  derived and/or modified sequence opt3 from neuraminidase__InfluenzaA__ACZ96385

SEQ ID NO: 139819 - RNA, 1410 nt, Artificial Sequence
  derived and/or modified sequence opt3 from neuraminidase__InfluenzaA__ACZ96395
augaaccccaaucagaagaucauuaccauaggcagcgugugcaugacaaucgggauggccaaccugauucuccaaaucggaaauauuaucuccauauggaucucucacucaauucagcuugguaaccagaaucagacugagacguguaaccaaagugucaucaccuacgaaaauaacacauggguuaaucagacuuaugugaacauuagcaauaccaacuucgcugcaggccaguccguagugucugucaaacuggccggaaauucgucauugugcccugugagcggaugggcgaucuacaguaaggacaacuccguuagaauaggcucuaaaggugauguguuugucauuagggagccauucaucagcuguuccccguuagaaugccggacauuuuuccugacccagggggcucuacucaaugacaagcauucaaacggaacuauuaaagaucgcagucccuaucgaacacugaugagcuguccuaucggcgaggugccaucucccuacaacucccguuuugaaucaguagccuggagcgcaagugccugccacgacggcaucaauuggcuuaccauugggauaucuggaccugauaacggugcuguugcagugcugaaguauaauggcaucauuacggacacuaucaaguccuggagaaacaauauauugaggacccaagagagcgagugugccugcgucaacgggucguguuucacagugaugacugauggaccaucuaauggccaggcuuccuacaaaauuuuucggaucgaaaaggguaaaaucgugaagucagucgagaugaacgcccccaauuaucauuacgaagagugcaguuguuacccugacagcuccgagauuaccugcguuugccgcgauaacuggcacgggucuaauagaccaugggugagcuucaaccagaaucucgaauaucagaucggauacauuuguucaggcauauuuggcgacaacccgaggcccaucgauaaaacagggaguugcggaccuguauccagcaauggugcgaacggcgugaagggguucucuuuuaaguauggaaacggcgucuggauuggucggaccaaaucaaucaguagccgcaauggguucgagaugaucugggacccaaacggcuggacgggaacugauaauaacuuuuccauuaagcaagacauagugggcaucaaugaauggucuggguacucggggagcuucguucagcaucccgagcugacaggucuggacuguauucgaccuugcuucuggguggaacucaucagaggcaggccaaaagagaacaccauuuggacuuccgggucaaguaucucuuuuuguggagucaauagcgauacagugggcugguccuggcccgacggugcagaguuaccguucaccauagauaaguga

SEQ ID NO: 139820 - RNA, 1410 nt, Artificial Sequence; identical to SEQ ID NO: 138754
  derived and/or modified sequence opt3 from neuraminidase__InfluenzaA__ACZ96408

SEQ ID NO: 139821 - RNA, 1410 nt, Artificial Sequence; identical to SEQ ID NO: 138754
  derived and/or modified sequence opt3 from neuraminidase__InfluenzaA__ACZ96428

SEQ ID NO: 139822 - RNA, 1410 nt, Artificial Sequence; identical to SEQ ID NO: 138754
  derived and/or modified sequence opt3 from neuraminidase__InfluenzaA__ACZ96438

SEQ ID NO: 139823 - RNA, 1410 nt, Artificial Sequence; identical to SEQ ID NO: 138754
  derived and/or modified sequence opt3 from neuraminidase__InfluenzaA__ACZ96448

SEQ ID NO: 139824 - RNA, 1410 nt, Artificial Sequence; identical to SEQ ID NO: 138754
  derived and/or modified sequence opt3 from neuraminidase__InfluenzaA__ACZ96479

SEQ ID NO: 139825 - RNA, 1410 nt, Artificial Sequence; identical to SEQ ID NO: 139771
  derived and/or modified sequence opt3 from neuraminidase__InfluenzaA__ACZ96489

SEQ ID NO: 139826 - RNA, 1410 nt, Artificial Sequence; identical to SEQ ID NO: 138754
  derived and/or modified sequence opt3 from neuraminidase__InfluenzaA__ACZ96499

SEQ ID NO: 139827 - RNA, 1410 nt, Artificial Sequence
  derived and/or modified sequence opt3 from neuraminidase__InfluenzaA__ACZ96509
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggaucaaucagacauauguuaacauaagcaauacuaacuucgcugcaggccaguccgugguaucugugaaacuggccggaaauucgucauugugcccugucagcggaugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaauggguucgagaugauaugggauccaaacggcuggaccggaacggacaauaacuuuuccaucaagcaagacauugugggcaucaaugaauggucuggguacucggggagcuucguccagcaucccgagcugacuggucuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 139828 - RNA, 1410 nt, Artificial Sequence; identical to SEQ ID NO: 138754
  derived and/or modified sequence opt3 from neuraminidase__InfluenzaA__ACZ96519

SEQ ID NO: 139829 - RNA, 1410 nt, Artificial Sequence; identical to SEQ ID NO: 138754
  derived and/or modified sequence opt3 from neuraminidase__InfluenzaA__ACZ96529

SEQ ID NO: 139830 - RNA, 1410 nt, Artificial Sequence
  derived and/or modified sequence opt3 from neuraminidase__InfluenzaA__ACZ96552
augaaccccaaucagaagaucauuaccauaggcagcgugugcaugacaaucgggauggccaaccugauucuccaaaucggaaauauuaucuccauauggaucucucacucaagucagcuugguaaccagaaucagauugagacuuguaaccaaagcgucaucacguacgaaaauaacaccuggguuaaucagacauaugugaacauuuccaauacuaacuucgcugcaggccagucuguagugucggucaaacuggccgggaauagcucauugugcccugugaguggaugggcgaucuacuccaaggacaacucuauaagaauuggcagcaaaggugauguuuuugugaucagggagccauucauuuccuguucaccguuagaaugccggaccuuuuuccugacacagggggcucuacucaaugacaagcauaguaacggaaccaucaaagaucgcagccccuaucgaacucugaugucuuguccuaucggcgaggucccaucccccuacaacucacguuuugaaagcguggccuggagugcaucugccugccacgacggcauuaauuggcuuacaauagggaucuccggaccugauaacggugcuguagcaguucugaaguauaauggcauuaucaccgacacgauaaagagcuggagaaacaauauuuugaggacucaagagucggagugugccugcgugaacgggucuuguuucaccgucaugacagauggaccauccgacggccaggcuucauacaaaaucuuucggaucgaaaaggguaaaauugugaagaguguggagaugaaugcccccaacuaucauuacgaagagugcagcuguuacccugauuccucugagaucacuugcgucugccgcgacaauuggcacgggagcaacagaccauggguuucauucaaucagaaccucgaauaucagauuggauacauauguaguggcaucuuuggcgauaauccgaggcccaacgacaaaaccggguccugcggaccugugagcucuaauggugcgaacggcguaaagggguucucauuuaaguauggaaacggcguguggauuggucggacaaaaaguaucagcucccgcaauggguucgagaugaucugggauccaaacggcuggaccggaacggacaauaacuuuucuauuaagcaagacauagucggcaucaaugaauggucgggguacagcggauccuucgugcagcaucccgagcugacuggucuggauuguauucgaccuugcuucuggguugaacucaucagaggcaggccaaaagagaacacaauuuggaccucagggaguucuaucagcuuuuguggagucaauuccgacacugugggcuggucauggcccgauggugcagaguuaccguucacaauagacaaguga

SEQ ID NO: 139831 - RNA, 1410 nt, Artificial Sequence; identical to SEQ ID NO: 138754
  derived and/or modified sequence opt3 from neuraminidase__InfluenzaA__ACZ96562

SEQ ID NO: 139832 - RNA, 1410 nt, Artificial Sequence; identical to SEQ ID NO: 138754
  derived and/or modified sequence opt3 from neuraminidase__InfluenzaA__ACZ96572

SEQ ID NO: 139833 - RNA, 1410 nt, Artificial Sequence; identical to SEQ ID NO: 138754
  derived and/or modified sequence opt3 from neuraminidase__InfluenzaA__ACZ96582

SEQ ID NO: 139834 - RNA, 1410 nt, Artificial Sequence
  derived and/or modified sequence opt3 from neuraminidase__InfluenzaA__ACZ96592
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaguccucauacaaaaucuuuaagauugaaaaagguaagaucgugaaaaguguggagaugaaugcucccaacuaucauuacgaagagugcagcuguuacccugauuccucugagauuacuugcgucugccgggacaauuggcacgggagcaaccgcccauggguuucauucaaucagaaccucgaauaucagauaggauacaucuguaguggcauuuuuggcgauaauccgagacccaacgacaagaccggguccugcggaccugugagcucuaauggugccaacggcguaaagggguucucauuuaaauauggaaacggcguguggaucgguaggacaaagaguaucagcucccggaauggguucgagaugauuugggauccaaacggcuggaccggaacggacaauaacuuuucuauaaaacaagacaucgucggcauuaaugaauggucgggguacagcggauccuucgugcagcaucccgagcugacuggucuggauuguauccgcccuugcuucuggguugaacucauucgaggcagaccaaaggagaacacaaucuggaccucagggaguucuauaucguuuuguggagucaauuccgacacugugggcuggucauggcccgauggugcggaguuaccguucacaaucgacaaauga

SEQ ID NO: 139835 - RNA, 1410 nt, Artificial Sequence; identical to SEQ ID NO: 138754
  derived and/or modified sequence opt3 from neuraminidase__InfluenzaA__ACZ96602

SEQ ID NO: 139836 - RNA, 1410 nt, Artificial Sequence
  derived and/or modified sequence opt3 from neuraminidase__InfluenzaA__ACZ96612
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucguuacguacgaaaauaacaccugggugaaucagacauauguaaacauuagcaauacuaacuucgcugcaggccaguccguggucucugugaaacuggccggaaauucgucauugugcccuguuagcggaugggcgaucuacaguaaggacaacuccgugagaauaggcucuaaaggugaugucuuugugauuagggagccauucaucagcuguuccccguuagaaugccggaccuuuuuccugacacagggggcucuacucaaugacaagcauucaaacggaaccauuaaagaucgcagucccuaucgaacucugaugagcuguccuaucggcgagguaccaucucccuacaacucccguuuugaaucaguugccuggagcgcaagugccugccacgacggcaucaauuggcuuacaauugggauaucuggaccugauaacggugcuguggcaguccugaaguauaauggcaucauuaccgacacgaucaaguccuggagaaacaauauauugaggacucaagagagcgagugugccugcgugaacgggucguguuucaccgugaugacagauggaccaucuaauggccaggcuuccuacaaaauuuuucggaucgaaaaggguaaaaucgucaagucaguugagaugaacgcccccaauuaucauuacgaagagugcaguuguuacccugacagcuccgagauuacuugcgugugccgcgauaacuggcacgggucuaauagaccaugggugagcuucaaccagaaucucgaauaucagaucggauacauuuguucaggcauauuuggcgacaacccgaggcccaaugauaaaaccgggaguugcggaccuguauccagcaacggugcgaacggcgucaagggguucucuuuuaaguauggaaauggcguguggaucggucggacaaaaucaauuaguagccgcaacggguucgagaugaucugggacccaaauggcuggaccggaacggauaacaauuuuuccaucaagcaagacauuguuggcauaaacgaauggucuggguacucggggagcuucgugcagcaucccgagcugacuggucuggacuguauccgaccuugcuucugggucgaacucauuagaggcaggccaaaagagaauacaaucuggaccuccgggucaaguauuucuuuuuguggagugaacagcgauacuguaggcugguccuggcccgacggugcagaguuaccguucacaaucgauaaguga

SEQ ID NO: 139837 - RNA, 1410 nt, Artificial Sequence; identical to SEQ ID NO: 138784
  derived and/or modified sequence opt3 from neuraminidase__InfluenzaA__ACZ96622

SEQ ID NO: 139838 - RNA, 1410 nt, Artificial Sequence; identical to SEQ ID NO: 138784
  derived and/or modified sequence opt3 from neuraminidase__InfluenzaA__ACZ96632

SEQ ID NO: 139839 - RNA, 1410 nt, Artificial Sequence; identical to SEQ ID NO: 138784
  derived and/or modified sequence opt3 from neuraminidase__InfluenzaA__ACZ96642

SEQ ID NO: 139840 - RNA, 1410 nt, Artificial Sequence; identical to SEQ ID NO: 138784
  derived and/or modified sequence opt3 from neuraminidase__InfluenzaA__ACZ96652

SEQ ID NO: 139841 - RNA, 1410 nt, Artificial Sequence; identical to SEQ ID NO: 138784
  derived and/or modified sequence opt3 from neuraminidase__InfluenzaA__ACZ96662

SEQ ID NO: 139842 - RNA, 1410 nt, Artificial Sequence; identical to SEQ ID NO: 138784
  derived and/or modified sequence opt3 from neuraminidase__InfluenzaA__ACZ96672

SEQ ID NO: 139843 - RNA, 1410 nt, Artificial Sequence; identical to SEQ ID NO: 138784
  derived and/or modified sequence opt3 from neuraminidase__InfluenzaA__ACZ96682

SEQ ID NO: 139844 - RNA, 1410 nt, Artificial Sequence; identical to SEQ ID NO: 138784
  derived and/or modified sequence opt3 from neuraminidase__InfluenzaA__ACZ96692

SEQ ID NO: 139845 - RNA, 1410 nt, Artificial Sequence; identical to SEQ ID NO: 138784
  derived and/or modified sequence opt3 from neuraminidase__InfluenzaA__ACZ96702

SEQ ID NO: 139846 - RNA, 1410 nt, Artificial Sequence; identical to SEQ ID NO: 138784
  derived and/or modified sequence opt3 from neuraminidase__InfluenzaA__ACZ96712

SEQ ID NO: 139847 - RNA, 1410 nt, Artificial Sequence; identical to SEQ ID NO: 138784
  derived and/or modified sequence opt3 from neuraminidase__InfluenzaA__ACZ96722

SEQ ID NO: 139848 - RNA, 1410 nt, Artificial Sequence; identical to SEQ ID NO: 138784
  derived and/or modified sequence opt3 from neuraminidase__InfluenzaA__ACZ96732

SEQ ID NO: 139849 - RNA, 1410 nt, Artificial Sequence; identical to SEQ ID NO: 138784
  derived and/or modified sequence opt3 from neuraminidase__InfluenzaA__ACZ96742

SEQ ID NO: 139850 - RNA, 1410 nt, Artificial Sequence; identical to SEQ ID NO: 138744
  derived and/or modified sequence opt3 from neuraminidase__InfluenzaA__ACZ96752

SEQ ID NO: 139851 - RNA, 1410 nt, Artificial Sequence; identical to SEQ ID NO: 138744
  derived and/or modified sequence opt3 from neuraminidase__InfluenzaA__ACZ96762

SEQ ID NO: 139852 - RNA, 1410 nt, Artificial Sequence; identical to SEQ ID NO: 138744
  derived and/or modified sequence opt3 from neuraminidase__InfluenzaA__ACZ96772

SEQ ID NO: 139853 - RNA, 1410 nt, Artificial Sequence; identical to SEQ ID NO: 138744
  derived and/or modified sequence opt3 from neuraminidase__InfluenzaA__ACZ96782

SEQ ID NO: 139854 - RNA, 1410 nt, Artificial Sequence; identical to SEQ ID NO: 138744
  derived and/or modified sequence opt3 from neuraminidase__InfluenzaA__ACZ96792

SEQ ID NO: 139855 - RNA, 1410 nt, Artificial Sequence; identical to SEQ ID NO: 138754
  derived and/or modified sequence opt3 from neuraminidase__InfluenzaA__ACZ96802

SEQ ID NO: 139856 - RNA, 1410 nt, Artificial Sequence; identical to SEQ ID NO: 138754
  derived and/or modified sequence opt3 from neuraminidase__InfluenzaA__ACZ96812

SEQ ID NO: 139857 - RNA, 1410 nt, Artificial Sequence; identical to SEQ ID NO: 139337
  derived and/or modified sequence opt3 from neuraminidase__InfluenzaA__ACZ96822

SEQ ID NO: 139858 - RNA, 1410 nt, Artificial Sequence
  derived and/or modified sequence opt3 from neuraminidase__InfluenzaA__ACZ96842
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucuaauggccaggcuuccuacaaaaucuuucggaucgaaaaggguaaaauugugaagucagucgagaugaucgcccccaacuaucauuacgaagagugcaguuguuacccugacagcuccgagauuacuugcguuugccgcgauaauuggcacgggucuaacagaccaugggugagcuucaaucagaaccucgaauaucagauaggauacaucuguucaggcauuuuuggcgacaauccgaggcccaacgauaaaaccgggaguugcggaccuguauccagcaauggugcgaacggcgugaagggguucucuuuuaaguauggaaacggcgucuggaucggucggacaaaaucaaucaguagccgcaauggguucgagaugauuugggacccaaacggcuggaccggaacggauaauaacuuuuccauaaagcaagacaucgugggcauuaaugaauggucuggguacucggggagcuucguucagcaucccgagcugacuggucuggacuguauccgaccuugcuucuggguggaacucauuagaggcaggccaaaagagaacacaaucuggaccuccgggucaaguauaucuuuuuguggagucaauagcgauacugugggcugguccuggcccgacggugcagaguuaccguucacaaucgauaaguga

SEQ ID NO: 139859 - RNA, 1410 nt, Artificial Sequence; identical to SEQ ID NO: 138754
  derived and/or modified sequence opt3 from neuraminidase__InfluenzaA__ACZ96852

SEQ ID NO: 139860 - RNA, 1410 nt, Artificial Sequence; identical to SEQ ID NO: 138754
  derived and/or modified sequence opt3 from neuraminidase__InfluenzaA__ACZ96862

SEQ ID NO: 139861 - RNA, 1410 nt, Artificial Sequence
  derived and/or modified sequence opt3 from neuraminidase__InfluenzaA__ACZ96872
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucuaugaaacuggccggaaauucgucauugugcccugucagcggaugggcgauauacaguaaggacaacuccauuagaaucggcucuaaaggugauguguuuguuauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggugccaucucccuacaacucccguuuugaaucagucgccuggagcgcaagugccugccacgacggcauaaauuggcuuacaaucgggauuucuggaccugauaacggugcuguggcaguacugaaguauaauggcaucauaaccgacacgauuaaguccuggagaaacaauaucuugaggacucaagagagcgagugugccugcguuaacgggucguguuucaccgugaugacagauggaccaucugacggccaggcuuccuacaaaaucuuucggauugaaaaggguaaaaucgucaagucaguggagaugaaugcccccaacuaucauuacgaagagugcaguuguuacccugauagcuccgagauuacuugcgugugccgcgacaauuggcacgggucuaacagaccaugggucagcuucaaucagaaccucgaauaucagauaggauacaucuguucaggcauuuuuggcgauaauccgaggcccaacgacaaaaccgggaguugcggaccuguuuccagcaauggugcgaacggcgugaagggguucucuuuuaaguauggaaacggcguauggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguccagcaucccgagcugacuggucuggauuguauccgaccuugcuucuggguggaacucauuagaggcaggccaaaagagaacacaaucuggaccuccgggucaaguauaucuuuuuguggaguuaauagcgacacugugggcugguccuggcccgauggugcagaguuaccguucacaaucgacaaguga

SEQ ID NO: 139862 - RNA, 1410 nt, Artificial Sequence; identical to SEQ ID NO: 138744
  derived and/or modified sequence opt3 from neuraminidase__InfluenzaA__ACZ96882

SEQ ID NO: 139863 - RNA, 1410 nt, Artificial Sequence; identical to SEQ ID NO: 139861
  derived and/or modified sequence opt3 from neuraminidase__InfluenzaA__ACZ96892

SEQ ID NO: 139864 - RNA, 1410 nt, Artificial Sequence; identical to SEQ ID NO: 139861
  derived and/or modified sequence opt3 from neuraminidase__InfluenzaA__ACZ96902

SEQ ID NO: 139865 - RNA, 1410 nt, Artificial Sequence; identical to SEQ ID NO: 138744
  derived and/or modified sequence opt3 from neuraminidase__InfluenzaA__ACZ96912

SEQ ID NO: 139866 - RNA, 1410 nt, Artificial Sequence; identical to SEQ ID NO: 138744
  derived and/or modified sequence opt3 from neuraminidase__InfluenzaA__ACZ96922

SEQ ID NO: 139867 - RNA, 1410 nt, Artificial Sequence; identical to SEQ ID NO: 139861
  derived and/or modified sequence opt3 from neuraminidase__InfluenzaA__ACZ96932

SEQ ID NO: 139868 - RNA, 1410 nt, Artificial Sequence; identical to SEQ ID NO: 139861
  derived and/or modified sequence opt3 from neuraminidase__InfluenzaA__ACZ96942

SEQ ID NO: 139869 - RNA, 1410 nt, Artificial Sequence; identical to SEQ ID NO: 138744
  derived and/or modified sequence opt3 from neuraminidase__InfluenzaA__ACZ96952

SEQ ID NO: 139870 - RNA, 1410 nt, Artificial Sequence; identical to SEQ ID NO: 138744
  derived and/or modified sequence opt3 from neuraminidase__InfluenzaA__ACZ97024

SEQ ID NO: 139871 - RNA, 1410 nt, Artificial Sequence; identical to SEQ ID NO: 139861
  derived and/or modified sequence opt3 from neuraminidase__InfluenzaA__ACZ97336

SEQ ID NO: 139872 - RNA, 1410 nt, Artificial Sequence; identical to SEQ ID NO: 139861
  derived and/or modified sequence opt3 from neuraminidase__InfluenzaA__ACZ97346

SEQ ID NO: 139873 - RNA, 1410 nt, Artificial Sequence; identical to SEQ ID NO: 138754
  derived and/or modified sequence opt3 from neuraminidase__InfluenzaA__ACZ97366

SEQ ID NO: 139874 - RNA, 1410 nt, Artificial Sequence; identical to SEQ ID NO: 138754
  derived and/or modified sequence opt3 from neuraminidase__InfluenzaA__ACZ97376

SEQ ID NO: 139875 - RNA, 1410 nt, Artificial Sequence; identical to SEQ ID NO: 138754
  derived and/or modified sequence opt3 from neuraminidase__InfluenzaA__ACZ97386

SEQ ID NO: 139876 - RNA, 1410 nt, Artificial Sequence; identical to SEQ ID NO: 139861
  derived and/or modified sequence opt3 from neuraminidase__InfluenzaA__ACZ97396

SEQ ID NO: 139877 - RNA, 1410 nt, Artificial Sequence; identical to SEQ ID NO: 138754
  derived and/or modified sequence opt3 from neuraminidase__InfluenzaA__ACZ98171

SEQ ID NO: 139878 - RNA, 1410 nt, Artificial Sequence; identical to SEQ ID NO: 138754
  derived and/or modified sequence opt3 from neuraminidase__InfluenzaA__ACZ98181

SEQ ID NO: 139879 - RNA, 1410 nt, Artificial Sequence
  derived and/or modified sequence opt3 from neuraminidase__InfluenzaA__ACZ98191
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuagcuacgaaaauaacacguggguuaaucagaccuaugugaacaucuccaauacaaacuucgcugcaggccagucuguagugucggucaaacuggccgggaauagcagcuugugcccugugaguggaugggcgauauacuccaaggacaacucuauuagaaucggcagcaaaggugauguuuuugugauuagggagccauucaucuccuguucaccguuagaaugccggaccuuuuuccugacucagggggcucuacucaaugacaagcauaguaacggaacaaucaaagaucgcagccccuaucgaacccugaugucuuguccuauuggcgaggucccaucccccuacaacucacguuuugaaagcguggccuggagugcaucugccugccacgacggcauaaauuggcuuacuaucgggauuuccggaccugauaacggugcuguagcaguucugaaguauaauggcaucauaacagacaccauuaagagcuggagaaacaauaucuugaggacgcaagagucggagugugccugcgugaacgggucuuguuucacugucaugaccgauggaccauccgacggccaggcuucauacaaaaucuuucggauugaaaaggguaaaaucgugaagaguguggagaugaaugcccccaacuaucauuacgaagagugcagcuguuacccugauuccucugagauuacaugcgucugccgcgacaauuggcacgggagcaacagaccauggguuucauucaaucagaaccucgaauaucagauaggauacaucuguaguggcauuuuuggcgauaauccgaggcccaacgacaaaacuggguccugcggaccugugagcucuaauggugcgaacggcguaaagggguucucauuuaaguauggaaacggcguguggaucggucggaccaaaaguaucagcucccgcaauggguucgagaugauuugggauccaaacggcuggacaggaaccgacaauaacuuuucuauaaagcaagacaucgucggcauuaaugaauggucgggguacagcggauccuucgugcagcaucccgagcugacgggucuggauuguauccgaccuugcuucuggguugaacucauuagaggcaggccaaaagagaacacuaucuggacaucagggaguucuauaucauuuuguggagucaauuccgacaccgugggcuggucauggcccgauggugcagaguuaccguucacuaucgacaaguga

SEQ ID NO: 139880 - RNA, 1410 nt, Artificial Sequence; identical to SEQ ID NO: 138744
  derived and/or modified sequence opt3 from neuraminidase__InfluenzaA__ACZ98201

SEQ ID NO: 139881 - RNA, 1410 nt, Artificial Sequence; identical to SEQ ID NO: 138754
  derived and/or modified sequence opt3 from neuraminidase__InfluenzaA__ACZ98211

SEQ ID NO: 139882 - RNA, 1410 nt, Artificial Sequence; identical to SEQ ID NO: 138754
  derived and/or modified sequence opt3 from neuraminidase__InfluenzaA__ACZ98221

SEQ ID NO: 139883 - RNA, 1410 nt, Artificial Sequence; identical to SEQ ID NO: 138754
  derived and/or modified sequence opt3 from neuraminidase__InfluenzaA__ACZ98231

SEQ ID NO: 139884 - RNA, 1410 nt, Artificial Sequence; identical to SEQ ID NO: 138754
  derived and/or modified sequence opt3 from neuraminidase__InfluenzaA__ACZ98241

SEQ ID NO: 139885 - RNA, 1410 nt, Artificial Sequence; identical to SEQ ID NO: 139731
  derived and/or modified sequence opt3 from neuraminidase__InfluenzaA__ACZ98251

SEQ ID NO: 139886 - RNA, 1410 nt, Artificial Sequence; identical to SEQ ID NO: 138754
  derived and/or modified sequence opt3 from neuraminidase__InfluenzaA__ACZ98261

SEQ ID NO: 139887 - RNA, 1410 nt, Artificial Sequence; identical to SEQ ID NO: 138754
  derived and/or modified sequence opt3 from neuraminidase__InfluenzaA__ACZ98271

SEQ ID NO: 139888 - RNA, 1410 nt, Artificial Sequence; identical to SEQ ID NO: 138754
  derived and/or modified sequence opt3 from neuraminidase__InfluenzaA__ACZ98281

SEQ ID NO: 139889 - RNA, 1410 nt, Artificial Sequence; identical to SEQ ID NO: 138754
  derived and/or modified sequence opt3 from neuraminidase__InfluenzaA__ACZ98291

SEQ ID NO: 139890 - RNA, 1410 nt, Artificial Sequence; identical to SEQ ID NO: 138744
  derived and/or modified sequence opt3 from neuraminidase__InfluenzaA__ACZ98301

SEQ ID NO: 139891 - RNA, 1410 nt, Artificial Sequence
  derived and/or modified sequence opt3 from neuraminidase__InfluenzaA__ACZ98321
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaauagucgcaacggguucgagaugauuugggauccaaauggcuggaccggaacggacaacaauuuuagcauaaagcaagacaucgucggcauuaacgaaugguccggguacucuggaucguucgugcagcaucccgagcugacuggucuggauuguauccgaccuugcuucuggguugaacucauuagaggcaggccaaaagagaauacaaucuggaccagcggguccucaauaaguuuuuguggagugaacucugacacugucggcuggagcuggcccgauggugcagaguuaccguucacaaucgacaaguga

SEQ ID NO: 139892 - RNA, 1410 nt, Artificial Sequence; identical to SEQ ID NO: 138754
  derived and/or modified sequence opt3 from neuraminidase__InfluenzaA__ACZ98331

SEQ ID NO: 139893 - RNA, 1410 nt, Artificial Sequence
  derived and/or modified sequence opt3 from neuraminidase__InfluenzaA__ACZ98341
augaaccccaaucagaagaucauuaccauaggcagcgugugcaucacaauugggauggccaaccugauccuccaaauuggaaauaucauauccaucuggauuucucacccuauccagcuugguaaccagaaucagauugagacuuguaaccaaucagucaucacguacgaaaauaacaccuggguuaaucagacauaugugaacauaaguaauacuaaccuggcugcaggccagagcguaguguccgucaaauuggccggaaauucuucguuaugcccagugucagggugggcgauuuacagcaaggacaacaguaucagaauuggcuccaaaggugauguuuucgugaucagggagccguuuaucucuuguagcccccuggaaugccggaccuucuuucuaacacagggggcucuccugaaugacaagcauuccaacggaaccauuaaagaucgcucaccuuaucgaacucuuaugaguuguccaauaggcgagguccccagcccuuacaacucucguuucgaauccguggccuggucagcaagcgccugccacgacggcaucaauuggcugacaauugggaucaguggaccagauaacggugcuguagcaguuuugaaguauaauggcauaauuaccgacacgaucaagucuuggagaaacaauauccucaggacucaagaguccgagugugccugcgugaacgggagcuguuuuaccgucaugacagauggacccucggacggccaggcuucuuacaaaauuuuccggaucgaaaaggguaaaauugugaaguccguggagaugaaugccccuaacuaucauuacgaagagugcucauguuacccagauaguagcgagauaacuugcgucugccgcgacaauuggcacggguccaacagaccguggguuucuuuuaaucagaaccuggaauaucagaucggauacauuuguagcggcaucuucggcgauaaucccaggccuaacgacaaaaccgggucaugcggaccagugaguuccaauggugcgaacggcguaaagggguuuagcuucaaguauggaaacggcguguggaucggucggacaaaaucuauuucaagucgcaauggguuugagaugauaugggaucccaacggcuggaccggaacggacaauaacuucagcaucaagcaagacauugucggcaucaaugaaugguccggguacucuggaucguuugugcagcauccugagcugacuggucucgauuguauucgaccaugcuucuggguugaauuaaucagaggcaggcccaaagagaacacaauauggaccagcggguccucaaucaguuucuguggagucaauucugacacugugggcuggagcuggccggauggugcagagcugccuuuuacaauugacaaguga

SEQ ID NO: 139894 - RNA, 1410 nt, Artificial Sequence; identical to SEQ ID NO: 138754
  derived and/or modified sequence opt3 from neuraminidase__InfluenzaA__ACZ98351

SEQ ID NO: 139895 - RNA, 1410 nt, Artificial Sequence; identical to SEQ ID NO: 138754
  derived and/or modified sequence opt3 from neuraminidase__InfluenzaA__ACZ98361

SEQ ID NO: 139896 - RNA, 1410 nt, Artificial Sequence; identical to SEQ ID NO: 138754
  derived and/or modified sequence opt3 from neuraminidase__InfluenzaA__ACZ98371

SEQ ID NO: 139897 - RNA, 1410 nt, Artificial Sequence; identical to SEQ ID NO: 138754
  derived and/or modified sequence opt3 from neuraminidase__InfluenzaA__ACZ98381

SEQ ID NO: 139898 - RNA, 1410 nt, Artificial Sequence; identical to SEQ ID NO: 138754
  derived and/or modified sequence opt3 from neuraminidase__InfluenzaA__ACZ98391

SEQ ID NO: 139899 - RNA, 1410 nt, Artificial Sequence; identical to SEQ ID NO: 138754
  derived and/or modified sequence opt3 from neuraminidase__InfluenzaA__ACZ98401

SEQ ID NO: 139900 - RNA, 1410 nt, Artificial Sequence; identical to SEQ ID NO: 138754
  derived and/or modified sequence opt3 from neuraminidase__InfluenzaA__ACZ98411

SEQ ID NO: 139901 - RNA, 1410 nt, Artificial Sequence; identical to SEQ ID NO: 138784
  derived and/or modified sequence opt3 from neuraminidase__InfluenzaA__ACZ98421

SEQ ID NO: 139902 - RNA, 1410 nt, Artificial Sequence; identical to SEQ ID NO: 138754
  derived and/or modified sequence opt3 from neuraminidase__InfluenzaA__ACZ98431

SEQ ID NO: 139903 - RNA, 1410 nt, Artificial Sequence; identical to SEQ ID NO: 138754
  derived and/or modified sequence opt3 from neuraminidase__InfluenzaA__ACZ98441

SEQ ID NO: 139904 - RNA, 1410 nt, Artificial Sequence; identical to SEQ ID NO: 138754
  derived and/or modified sequence opt3 from neuraminidase__InfluenzaA__ACZ98451

SEQ ID NO: 139905 - RNA, 1410 nt, Artificial Sequence; identical to SEQ ID NO: 138754
  derived and/or modified sequence opt3 from neuraminidase__InfluenzaA__ACZ98461

SEQ ID NO: 139906 - RNA, 1410 nt, Artificial Sequence; identical to SEQ ID NO: 139337
  derived and/or modified sequence opt3 from neuraminidase__InfluenzaA__ACZ98674

SEQ ID NO: 139907 - RNA, 1410 nt, Artificial Sequence; identical to SEQ ID NO: 139861
  derived and/or modified sequence opt3 from neuraminidase__InfluenzaA__ACZ98684

SEQ ID NO: 139908 - RNA, 1410 nt, Artificial Sequence; identical to SEQ ID NO: 139807
  derived and/or modified sequence opt3 from neuraminidase__InfluenzaA__ACZ98694

SEQ ID NO: 139909 - RNA, 1410 nt, Artificial Sequence; identical to SEQ ID NO: 138754
  derived and/or modified sequence opt3 from neuraminidase__InfluenzaA__ADA60801

SEQ ID NO: 139910 - RNA, 1410 nt, Artificial Sequence; identical to SEQ ID NO: 138754
  derived and/or modified sequence opt3 from neuraminidase__InfluenzaA__ADA69294

SEQ ID NO: 139911 - RNA, 1410 nt, Artificial Sequence; identical to SEQ ID NO: 138754
  derived and/or modified sequence opt3 from neuraminidase__InfluenzaA__ADA69304

SEQ ID NO: 139912 - RNA, 1410 nt, Artificial Sequence; identical to SEQ ID NO: 138754
  derived and/or modified sequence opt3 from neuraminidase__InfluenzaA__ADA69314

SEQ ID NO: 139913 - RNA, 1410 nt, Artificial Sequence; identical to SEQ ID NO: 138754
  derived and/or modified sequence opt3 from neuraminidase__InfluenzaA__ADA69324

SEQ ID NO: 139914 - RNA, 1410 nt, Artificial Sequence; identical to SEQ ID NO: 138754
  derived and/or modified sequence opt3 from neuraminidase__InfluenzaA__ADA69334

SEQ ID NO: 139915 - RNA, 1410 nt, Artificial Sequence; identical to SEQ ID NO: 138754
  derived and/or modified sequence opt3 from neuraminidase__InfluenzaA__ADA69451

SEQ ID NO: 139916 - RNA, 1410 nt, Artificial Sequence; identical to SEQ ID NO: 138754
  derived and/or modified sequence opt3 from neuraminidase__InfluenzaA__ADA69453

SEQ ID NO: 139917 - RNA, 1410 nt, Artificial Sequence
  derived and/or modified sequence opt3 from neuraminidase__InfluenzaA__ADA71153
augaaccccaaucagaagaucauuaccauaggcagcgugucccugacaaucucuacuauuugcuucuuuaugcaaaucgccauucucgucacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcaucgcuuggagcaguuccucuugucaugacgguaaagccuggcuccacgugugcauuacaggggaugacaagaacgcaaccgccagcuucaucuacaauggaaggcugguagauuccguugugucauggaguaaagacauccugcggacgcaggagagcgaaugugucugcauuaacggcacuuguacaguggugaugaccgauggcucugcuuccgggaaggcagacacuaaaauacucuuuaucgaggagggaaagauuguccauacaucaaccuuaagcgguagugcccaacacguugaagagugcucuugcuauccucgcuacccaggcgugagauguguaugcagggauaacuggaagggguccaaucggccgaucguggacauaaacauuaaagaccacagcaucgucucgcgcuacguguguucuggacugguuggcgaucccccucgaaagaaugacuccucaaguagcucccauugccuugauccaaacaaugaagagggugggcacggagugaaaggcugggcuuucgacgauggcaacgacgucuggauggggagaacgaucucugaaaagagcagguugggauaugagaccuuuaaagugauugaggguuggucaaaucccaagaguaaacugcagaucaaccggcagguaauuguugaucguggcaaucgcuccggguacagcggaauauucucuguggaaggcaagucauguaucaacagaugcuuuuaugucgagcuaauuaggggucggaaggaagagacagaagugcucuggaccaguaauagcaucgucguguucugugggacuuccggcacauacggaacuggcucuuggccugacggggccaacaucaaucugaugccaauuuga

SEQ ID NO: 139918 - RNA, 1413 nt, Artificial Sequence
  derived and/or modified sequence opt3 from neuraminidase__InfluenzaA__ADA71155
augaaccccaaucagaagaucauuaccauaggcagcaucuccauugccaucgggauuaucucucugaugcuccaaauaggaaacaucauuucaaucugggcuagucacagcauucagaucgguucccagaauaacacaggcauaugcaaucagagaauuaucacuuacgagaacucuacgugggugaaucauaccuaugucaacauuaauaacacaaaaguuguggcaggggaagacaagacuucgguaacccuugccggaaauucaagccuguguaguaucuccggcugggcgaucuacacaaaagauaacucuauuaggauagguagcaagggggacguguucgucauccgggagccuuuuauuuccugcucacacuuggaaugucgcaccuucuuuuuaacucaaggagcucugcuaaaugauaaacauaguaacggcacagugaaggaccgaagcccauaucgugcccucaugucuugcccgcugggcgaggcacccuccccuuacaauucaaaguucgaaagcguugccuggagugcuucugcaugucacgaugggaugggauggcuuaccaucgguauauccggcccagacaacggggccguggcuguccugaaauauaacggaauuaucacgggcacuaucaagagcuggaaaaagcagauuuugagaacccaggagucggagugcguguguaugaaugguucuugcuuuacaaucaugacugaugggcccuccaacaaagccgcgucauacaagauuuucaagauagaaaaaggaaagguaaccaaaaguaucgagcucaaugcaccuaacuuuuauuacgaagaguguagcugcuacccagacacaggcauuguuaugugugugugcagggauaauuggcauggcuccaaccggcccugggucucuuucaaucagaaccuggacuaucaaaucggguacaucugcagcggaguguuuggugauaauccucgcccagaggacggcgaagggucauguaacccggugaccgucgauggagccaauggcguuaaggguuucaguuauaaauacgggaacggcguguggauuggaagaacgaaguccaauaggcugcggaaaggcuuugagaugauaugggaccccaacggguggacuaauacagacagcgauuucucuguaaagcaggacguggucgcuaucaccgauuggucaggauauagugguagcuuugugcagcacccugaacucacuggcuuagacugcauucgcccauguuucuggguugagcuggugcgagggcuucccagagaaaacacaaccaucuggacguccggaucuucgauuagcuucugcggcgucaacuccgauaccgccaauuggucauggccugacggugcagaguugccauuuacaaucgauaaguga

SEQ ID NO: 139919 - RNA, 1413 nt, Artificial Sequence; identical to SEQ ID NO: 139477
  derived and/or modified sequence opt3 from neuraminidase__InfluenzaA__ADA71157

SEQ ID NO: 139920 - RNA, 1413 nt, Artificial Sequence
  derived and/or modified sequence opt3 from neuraminidase__InfluenzaA__ADA71159
augaaccccaaucagaagaucauuaccauaggcagcaucuccauugccaucgggauuaucucucugaugcuccaaauaggaaacaucauuucaaucugggcuagucacagcauucagaucgguucccagaauaacacaggcauaugcaaucagagaauuaucacuuacgagaacucuacgugggugaaucauaccuaugucaacauuaauaacacaaaaguuguggcaggggaaggaaagacuucgguaacccuugccggcaauucaagccuguguaguaucuccgguugggcgaucaacacaaaagacaauucuauuaggauagggagcaagggagauguguucgucauccgggagccuuuuauuuccugcucacacuuggaaugucgcaccuucuuuuuaacucaaggcgcucugcuaaacgacaaacauaguaaucgaacagugaaggaucguagcccauacagagcccucaugucuugcccgcugggcgaggcacccuccccuuauaacucaaaguucgaaagcguugccuggagugcuucugcaugucacgacgggaugggauggcuuaccaucgguauauccggcccagauaacggggccguggcuguccugaaauacaauggaauuaucacgggcacuaucaagagcuggaaaaagcagauuuugaggacccaggagucggagugcguguguaugaacgguucuugcuuuacaaucaugacugacgggcccuccaauaaagccgcgucauauaagauuuucaagauagaaaaaggaaagguaaccaaaaguaucgagcucaacgcaccuaauuuuuacuaugaagaguguagcugcuacccagauacaggcauuguuaugugugugugccgggacaacuggcauggcuccaaucgccccugggucucuuucaaccagaaucuggauuaccaaaucggguauaucugcagcggaguguuuggugacaacccuagaccagaggauggcgaagggucauguaauccggugaccgucgacggagccaacggcguuaaggguuucaguuacaaauaugggaauggcguguggauuggaaggacgaaguccaaccggcugcgcaaaggcuuugagaugauaugggaucccaauggguggacuaacacagacagcgacuucucuguaaagcaggauguggucgcuaucaccgacuggucaggauacagugguagcuuugugcagcacccugaacucacuggcuuagauugcauucgaccauguuucuggguugagcuggugagagggcuucccagggaaaacacaaccaucuggacguccggaucuucgauuagcuucugcggcgucaauuccgacaccgccaacuggucauggccugauggugcagaguugccauuuacaaucgacaaguga

SEQ ID NO: 139921 - RNA, 1410 nt, Artificial Sequence
  derived and/or modified sequence opt3 from neuraminidase__InfluenzaA__ADA71161
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaaucauaaguccaaacugcagauuaacaggcaagugauaguagaccggggcaaucguagcggguacucuggaaucuucucaguugagggcaagaguuguauuaaccgcugcuuuuauguggaacuaaucagagguaggaaggaggaaacugagguccucuggaccagcaauuccaucguggucuucugugggacaucuggcacuuacggaaccggcucguggccagauggggccgaccugaaccuuaugcccauuuga

SEQ ID NO: 139922 - RNA, 1413 nt, Artificial Sequence
  derived and/or modified sequence opt3 from neuraminidase__InfluenzaA__ADA71165
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucaguaagauugaaaagggaaaaguaacaaagagcauagagcucaacgcaccuaauuucuauuacgaagaguguuccugcuacccagacaccggcaucguuaugugugugugcagggauaacuggcauggcucuaaucggcccugggucagcuuuaaccagaaucuggacuaucaaauuggguacaucugcucaggaguguucggugauaacccucgcccagaggacggcgaagggaguuguaauccggugacggucgauggagccaacggcguuaaagguuuuuccuauaaguacgggaauggcguguggaucggaagaacuaaaagcaacaggcugcggaagggcuucgagaugauuugggaccccaauggguggacaaacaccgacucugauuuuucaguaaaacaggacguggucgcuauaacugauuggaguggauauagcgguuccuucgugcagcacccugaacucacaggcuuagacugcauccgcccauguuuuuggguugagcuggugcgagggcuucccagagaaaacaccacgauuuggaccucuggaucgagcaucuccuucugcggcgucaauucagauacagccaacuggaguuggccugacggugcagaguugccauucacuauugauaaguga

SEQ ID NO: 139923 - RNA, 1410 nt, Artificial Sequence
  derived and/or modified sequence opt3 from neuraminidase__InfluenzaA__ADA71167
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgaggacguacaccauauagaacucugcuuaugaaugaacugggcguucccuuucacuuggguaccaaacaggugugcauugcuuggagcaguuccucuugucaugaugggaaggccuggcuccacgucugcaucacaggagacgauaagaacgcaaccgccagcuucaucuacaauggcaggcugguggacuccguaguuucauggaguaaagauauucugcggacgcaggagagcgaaugugugugcauaaacggcacuuguacagucgugaugaccgacgggucugcuuccggaaaggcagauacuaaaauccucuuuauugaggaggguaagaucgugcauacaucaaccuuaagcggcagugcccaacacgucgaagagugcucuugcuauccucgcuacccagggguuagaugugugugcagggacaacuggaagggauccaaucggccgauaguagauauuaacaucaaagaccacagcaucgugucgucuuacgucuguuccggccuggugggugacacgccccgcaagaaugauucaaguagcuccucucauugccuuaacccuaauaacgaagaagggggacacggcguuaaaggcugggcuuucgacgaugggaaugacguguggaugggacgaaccauuagcgagaagucaagauuggguuaugagacauuuaaagucaucgagggcuggaguaacccaaaguccaaacugcagauuaauaggcaagugauaguagaucgggggaaccguagcggauacucuggcaucuucucaguugaagguaagaguuguauuaaucgcugcuuuuauguggagcuaaucagagggaggaaggaagagacugaaguccucuggaccagcaacuccaucguggucuucuguggcacaucuggaacuuacggcaccgggucguggcccgacggagccaauauuaaccugaugccuauauga

SEQ ID NO: 139924 - RNA, 1413 nt, Artificial Sequence
  derived and/or modified sequence opt3 from neuraminidase__InfluenzaA__ADA71169
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccccuguaacacuugugggaaauucgucacuguguagcauuaguggcugggccaucuacaccaaagauaacuccaucaggauugguucuaagggggacgucuucgugauacgggagccauuuaucagcugcucccauuuggaguguaaaacuuucuuuuuaacacaaggagcgcugcuaaaugauaagcacucaaacggcaccguuaaggaccgcaguccguaucgagcucucaugagcugcccccugggcgaagccccuucuccauacaauuccaaauucgagucaguggcauggagcgccagugcuugucaugaugggauuggauggcuuacgaucgguauaucuggccccgacaacggggcagucgccgugcugaaguauaaaggaauuaucacuggcaccaucaaguccuggaaaaagcagauuuugcguacacaggaaagcgagugcguauguaucaacgguucgugcuuuacuauuaugaccgaugggccuucugacggagcugccuccuacaagauauucaaaaucgagaagggcaaaguuacaaagucaauggaacucaaugcgccaaacuuucacuaugaggaauguaguugcuaccccgauaccggcacggugaugugugucugcagagacaauuggcacgggagcaacaggccuuggguguccuucaaucagaaccuggauuaccaaauuggauauaucugcucugguguguuuggcgacaauccacggccgaaagauggggagggaagcuguaaccccgucacuguugacggcgcaaauggugugaagggguucucauacaaauauggcaacggaguauggaucggccgcacaaagaguaauagaauuaggaagggguuugagaugauaugggacccuaacggauggaccaauacugauuccgacuucagcgugaaacaggauaucgucgccauuacagacuggucugguuacucaggcaguuuugugcagcauccagaacugaccgggcucgauugcauccggcccuguuucuggguugaguuagugcgcggacugccucgagaaaacacgaccauuuggacaagcggcuccucuaucucguucugcggugucaauggggacauagcuaacuggagcuggccagauggcgccgagcuucccuuuacuaucgacaaguga

SEQ ID NO: 139925 - RNA, 1413 nt, Artificial Sequence; identical to SEQ ID NO: 139477
  derived and/or modified sequence opt3 from neuraminidase__InfluenzaA__ADA71171

SEQ ID NO: 139926 - RNA, 1410 nt, Artificial Sequence
  derived and/or modified sequence opt3 from neuraminidase__InfluenzaA__ADA71173
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagcucguacaccauauagaacucugcuuaugaaugaacugggaguucccuuucacuugggcaccaaacaggugugcauugccuggagcaguuccucuugucaugaugguaaggcauggcuccacgucugcaucacaggggacgauaagaacgccaccgcuagcuucaucuacaauggaaggcugguggacuccguaguuucauggaguaaagauauucugcggacgcaggagagcgaaugugugugcauaaacggcacuuguacagucgugaugaccgacggcucugcauccgggaaggccgauacuaaaauccucuuuauugaggagggaaagaucgugcauacaucaaccuuaagcgguagugcucaacacgucgaagagugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuuaacccuaauaacgaagagggugggcacggaguuaaaggcugggccuucgacgauggcaaugacguguggauggggcgaaccauuagcgaaaagucaagauugggauaugagacauuuaaagucaucgaggguuggaguaacccaaaguccaaacugcagauuaauaggcaagugauaguagaucggggcaaccguagcggguacucuggaaucuucucaguugaaggcaagaguuguauuaaucgcugcuuuuauguggagcuaaucagagguaggaaggaagagacugaaguccucuggaccagcaacuccaucguggucuucugugggacaucuggcacuuacggaaccggcucguggcccgacggggcgaauauuaaccugaugccuauauga

SEQ ID NO: 139927 - RNA, 1413 nt, Artificial Sequence
  derived and/or modified sequence opt3 from neuraminidase__InfluenzaA__ADA71175
augaaccccaaucagaagaucauuaccauaggcagcaucuccauugccaucgggauuaucucucugaugcuccaaauaggaaacaucauuucaaucugggcuagucacagcauucagaucgguucccagaauaacacaggcauaugcaaucagagaauuaucacuuacgagaacucuacgugggugaaucauaccuaugucaacauuaauaacacaaaaguuguggcaggggaagacaagacuucgguaacccuugccggaaauucaagccuguguaguaucuccggcugggcgaucaacacaaaagauaauucuauuaggauagguagcaagggggacguguucgucauccgggagccuuuuauuuccugcucacacuuggaaugucgcaccuucuuuuuaacucaaggagcucugcuaaacgauaaacauaguaauggcacagugaaggaccgaagcccauaccgugcccucaugucuugcccgcugggcgaggcacccuccccuuauaacucaaaguucgaaagcguugccuggagugcuucugcaugucacgaugggaugggauggcuuaccaucgguauauccggcccagacaacggggccguggcuguccugaaauacaauggaauuaucacgggcacuaucaagagcuggaaaaagcagauuuugagaacccaggagucggagugcguguguaugaacgguucuugcuuuacaaucaugacugaugggcccuccaauaaagccgcgucauauaagauuuucaagauagaaaaaggaaagguaaccaaaaguaucgagcucaacgcaccuaauuuuuacuaugaagaguguagcugcuacccagacacaggcauuguuaugugugugugcagggauaacuggcauggcuccaaucggcccugggucucuuucaaccagaaucuggacuaccaaaucggguauaucugcagcggaguguuuggugauaacccucgcccagaggacggcgaagggucauguaauccggugaccgucgauggagccaacggcguuaaggguuucaguuacaaauaugggaauggcguguggauuggaagaacgaaguccaacaggcugcggaaaggcuuugagaugauaugggaccccaauggguggacuaacacagacagcgauuucucuguaaagcaggacguggucgcuaucaccgauuggucaggauacagugguagcuuugugcagcacccugaacucacuggcuuagacugcauucgcccauguuucuggguugagcuggugcgagggcuucccagagaaaacacaaccaucuggacguccggaucuucgauuagcuucugcggcgucaauuccgauaccgccaacuggucauggccugacggugcagaguugccauuuacaaucgauaaguga

SEQ ID NO: 139928 - RNA, 1413 nt, Artificial Sequence; identical to SEQ ID NO: 139477
  derived and/or modified sequence opt3 from neuraminidase__InfluenzaA__ADA71177

SEQ ID NO: 139929 - RNA, 1410 nt, Artificial Sequence
  derived and/or modified sequence opt3 from neuraminidase__InfluenzaA__ADA71193
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaguggugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 139930 - RNA, 1410 nt, Artificial Sequence
  derived and/or modified sequence opt3 from neuraminidase__InfluenzaA__ADA79589
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggucgagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaagucacguuuugaaagcguggccuggagugcaucugccugccacgacggcauaaacuggcuuacaaucgggauuuccggaccugauaacggugcuguagcaguucugaaguauaauggcaucauaaccgacacgauuaaaagcuggagaaacaauaucuugaggacucaagagucggagugugccugcgugaacgggucuuguuucaccgucaugacagauggaccauccgacggccaggcuucauacaagaucuuucggauugaaaaagguaagaucgugaaaaguguggagaugaaugcccccaacuaucauuacgaagagugcagcuguuacccugauuccucugagauuacuugcgucugccgcgacaauuggcacgggagcaacagaccauggguuucauucaaucagaaccucgaauaucagauaggauacaucuguaguggcauuuuuggcgauaauccgaggcccaacgacaagaccggguccugcggaccugugagcucuaauggugcgaacggcguaaagggguucucauuuaaauauggaaauggcguguggaucggucggacaaagaguaucagcucccgcaacggguucgagaugauuugggauccaaacggcuggaccggaacggacaauaacuuuucuauaaaacaagacaucgucggcauuaaugaauggucgggguacagcggauccuucgugcagcaucccgagcugacuggucuggauuguauccgaccuugcuucuggguugaacucauuagaggcaggccaaaggagaacacaaucuggaccucagggaguucuauaucauuuuguggagucaauuccgacacugugggcuggucauggcccgauggugcagaguuaccguucacaaucgacaaauga

SEQ ID NO: 139931 - RNA, 1410 nt, Artificial Sequence
  derived and/or modified sequence opt3 from neuraminidase__InfluenzaA__ADA79599
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaaguuuuccauaaaacaagacaucgucggcauuaacgaauggucuggguacucggggagcuucgugcagcaucccgagcugacuggucuggauuguauccgaccuugcuucuggguugaacucauuagaggcaggccaaaggagaauacaaucuggaccuccgggucaaguauaucuuuuuguggagugaacagcgacacugucggcugguccuggcccgauggugcagaguuaccguucacaaucgacaaauga

SEQ ID NO: 139932 - RNA, 1410 nt, Artificial Sequence; identical to SEQ ID NO: 139931
  derived and/or modified sequence opt3 from neuraminidase__InfluenzaA__ADA79609

SEQ ID NO: 139933 - RNA, 1410 nt, Artificial Sequence
  derived and/or modified sequence opt3 from neuraminidase__InfluenzaA__ADA79619
augaaccccaaucagaagaucauuaccauaggcagcaucugcaugacaauugggauggccaaccugauccuccaaauuggaaauaucauauccaucuggauuucucacucaauccagcuugguaaccagaaucagauugagacuuguaaccaaagugugaucacguacgaaaauaacaccugggucaaucagacauauguuaacauaagcaauacuaacuucgcugcaggccaguccguggccucuguaaaacuggcgggaaauucgucauugugcccugugagcggaugggcuauuuacaguaaggacaacuccaucagaauuggcucuaaaggugaugucuuugugaucagggagccauucaucagcuguuccccguuagaaugccggaccuuuuuccugacacagggggcccuacucaaugacaagcauucaaacggaaccauuaaagaucgcagucccuaucgaacucugaugagcuguccuauaggcgagguuccaucucccuacaacucccguuuugaaucaguggcauggagcgccagugcuugccacgacggcaucaauuggcuuacaauugggaucucuggaccugauaacggugcagucgccgugcugaaguauaauggcauaauuaccgacacgaucaaguccuggagaaacaauaucuugaggacucaagagagcgagugugcuugcguaaacgggucguguuucaccguuaugacagauggaccaucugacggccaggccuccuacaaaauuuuucggaucgaaaaggguaaaauugugaagucagucgagaugaaugcgcccaacuaucauuacgaagagugcaguuguuacccugauagcuccgagauaacuugcgugugccgcgacaauuggcacgggucuaacagaccaugggugagcuucaaucagaaccucgaauaucagaucggauacauuuguucaggcaucuuuggcgauaauccgaggcccaacgacaaaaccgggaguugcggaccugucuccagcaauggugcaaacggcguuaagggguucucuuuuaaguauggaaacggcguguggaucggucggacaaaaucaauuaguagccgcaauggguucgagaugauaugggauccaaacggcuggaccggaacggacaauaacuuuuccaucaagcaagacauuguaggcaucaaugaauggucuggguacucggggagcuucgugcagcaucccgagcugacuggucuggauuguauucgaccuugcuucugggucgaacucaucagaggcaggccaaaagagaacacaauauggaccuccgggucaaguaucucuuuuuguggagugaauagcgacacuguuggcugguccuggcccgauggugccgaguuaccguucacaauugacaaguga

SEQ ID NO: 139934 - RNA, 1410 nt, Artificial Sequence; identical to SEQ ID NO: 138754
  derived and/or modified sequence opt3 from neuraminidase__InfluenzaA__ADA81211

SEQ ID NO: 139935 - RNA, 1410 nt, Artificial Sequence
  derived and/or modified sequence opt3 from neuraminidase__InfluenzaA__ADA83035
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugcucaaccuuuuuccugacacagggggcucuacucaaugacaagcauaguaacggaaccaucaaagaucggagccccuaucgcacucugaugucuuguccuauuggcgaggucccaucccccuacaacucacgauuugaaagcguggccuggagugcaucugccugccacgacggcauaaauuggcuuacaaucgggauuuccggaccugauaacggugcuguagcaguucugaaguauaauggcaucauaaccgacacgauuaagagcuggcguaacaauaucuugagaacucaagagucggagugugccugcgugaacgggucuuguuucaccgucaugacagauggaccauccgacggccaggcuucauacaaaaucuuuaggauugaaaaggguaaaaucgugaagaguguggagaugaaugcccccaacuaucauuacgaagagugcagcuguuacccugauuccucugagauuacuugcgucugccgggacaauuggcacgggagcaaccgcccauggguuucauucaaucagaaccucgaauaucagauaggauacaucuguaguggcauuuuuggcgauaauccgagacccaacgacaaaaccggguccugcggaccugugagcucuaauggugcgaacggcguaaagggguucucauuuaaguauggaaacggcguguggaucgguaggacaaaaaguaucagcucccggaauggguucgagaugauuugggauccaaacggcuggaccggaacggacaauaacuuuucuauaaagcaagacaucgucggcauuaaugaauggucgggguacagcggauccuucgugcagcaucccgagcugacuggucuggauuguauccgcccuugcuucuggguugaacucauucgaggcagaccaaaagagaacacaaucuggaccucagggaguucuauaucguuuuguggagucaauuccgacacugugggcuggucauggcccgauggugcagaguuaccguucacaaucgacaaguga

SEQ ID NO: 139936 - RNA, 1410 nt, Artificial Sequence
  derived and/or modified sequence opt3 from neuraminidase__InfluenzaA__ADA83037
augaaccccaaucagaagaucauuaccauaggcagcgugugcaugacaaucgggauggccaaccugauucuccaaaucggaaauauuaucuccauauggaucucucacucaauucagcuugguaaccaggaccagaucgagacuuguaaucaaagugucauuacguacgaaaacaauaccuggguuaaccagacauaugugaauaucagcaacacuaauuucgcugcaggccaguccguagugucugucaaacuggccgggaacucgucauugugcccugugagcggaugggcgauauacaguaaggauaauuccauuagaaucggcucuaaaggugacguuuuugugauuagggagccauucaucagcuguuccccguuagaaugccggaccuuuuuccugacacagggggcucuacucaacgauaagcauucaaauggaaccaucaaagaccgcagucccuaucgaacucugaugagcuguccuauuggcgaggucccaucucccuacaacucccguuuugaaucaguggccuggagcgcaagugccugccacgauggcauaaacuggcuuacaaucgggauuucuggaccugacaauggugcuguagcaguucugaaguauaacggcaucauaaccgauacgauuaaguccuggagaaauaacaucuugaggacucaagagagcgagugugccugcgugaaugggucguguuucaccgucaugacagacggaccaucugauggccaggcuuccuacaaaaucuuucggauugaaaaggguaaaaucgugaagucaguggagaugaacgcccccaauuaucauuacgaagagugcaguuguuacccugacagcuccgagauuacuugcgucugccgcgauaacuggcacgggucuaauagaccauggguuagcuucaaccagaaucucgaauaucagauaggauacaucuguucaggcauuuuuggcgacaacccgaggcccaaugauaaaaccgggaguugcggaccuguguccagcaacggugcgaauggcguaaagggguucucuuuuaaguauggaaacggcguguggaucggucggacaaaaucaaucaguagccgcaacggguucgagaugauuugggacccaaauggcuggaccggaacggacaacaaguuuuccauaaaacaagauaucgucggcauuaaugaauggucuggguacucggguagcuucgugcagcaucccgagcugacuggacuggacuguauccgaccuugcuucuggguugaacucauuagaggcaggccaaaggagaacacaaucuggaccuccgggucaaguauaucuuuuuguggagugaauagcgauacugucggcugguccuggcccgacggugcagaguuaccguucacaaucgauaaauga

SEQ ID NO: 139937 - RNA, 1410 nt, Artificial Sequence; identical to SEQ ID NO: 138754
  derived and/or modified sequence opt3 from neuraminidase__InfluenzaA__ADA83588

SEQ ID NO: 139938 - RNA, 1410 nt, Artificial Sequence; identical to SEQ ID NO: 138754
  derived and/or modified sequence opt3 from neuraminidase__InfluenzaA__ADA83592

SEQ ID NO: 139939 - RNA, 1410 nt, Artificial Sequence; identical to SEQ ID NO: 138754
  derived and/or modified sequence opt3 from neuraminidase__InfluenzaA__ADA83596

SEQ ID NO: 139940 - RNA, 1410 nt, Artificial Sequence; identical to SEQ ID NO: 138754
  derived and/or modified sequence opt3 from neuraminidase__InfluenzaA__ADA83600

SEQ ID NO: 139941 - RNA, 1410 nt, Artificial Sequence; identical to SEQ ID NO: 138754
  derived and/or modified sequence opt3 from neuraminidase__InfluenzaA__ADA83604

SEQ ID NO: 139942 - RNA, 1410 nt, Artificial Sequence; identical to SEQ ID NO: 138754
  derived and/or modified sequence opt3 from neuraminidase__InfluenzaA__ADA83608

SEQ ID NO: 139943 - RNA, 1410 nt, Artificial Sequence; identical to SEQ ID NO: 138754
  derived and/or modified sequence opt3 from neuraminidase__InfluenzaA__ADA83612

SEQ ID NO: 139944 - RNA, 1410 nt, Artificial Sequence; identical to SEQ ID NO: 139108
  derived and/or modified sequence opt3 from neuraminidase__InfluenzaA__ADA83616

SEQ ID NO: 139945 - RNA, 1410 nt, Artificial Sequence; identical to SEQ ID NO: 138754
  derived and/or modified sequence opt3 from neuraminidase__InfluenzaA__ADA83624

SEQ ID NO: 139946 - RNA, 1410 nt, Artificial Sequence; identical to SEQ ID NO: 138754
  derived and/or modified sequence opt3 from neuraminidase__InfluenzaA__ADA83630

SEQ ID NO: 139947 - RNA, 1410 nt, Artificial Sequence; identical to SEQ ID NO: 138754
  derived and/or modified sequence opt3 from neuraminidase__InfluenzaA__ADA83634

SEQ ID NO: 139948 - RNA, 1410 nt, Artificial Sequence; identical to SEQ ID NO: 138754
  derived and/or modified sequence opt3 from neuraminidase__InfluenzaA__ADA83638

SEQ ID NO: 139949 - RNA, 1410 nt, Artificial Sequence; identical to SEQ ID NO: 138754
  derived and/or modified sequence opt3 from neuraminidase__InfluenzaA__ADA83642

SEQ ID NO: 139950 - RNA, 1410 nt, Artificial Sequence; identical to SEQ ID NO: 138754
  derived and/or modified sequence opt3 from neuraminidase__InfluenzaA__ADA83649

SEQ ID NO: 139951 - RNA, 1410 nt, Artificial Sequence; identical to SEQ ID NO: 138754
  derived and/or modified sequence opt3 from neuraminidase__InfluenzaA__ADA83653

SEQ ID NO: 139952 - RNA, 1410 nt, Artificial Sequence; identical to SEQ ID NO: 138754
  derived and/or modified sequence opt3 from neuraminidase__InfluenzaA__ADA83657

SEQ ID NO: 139953 - RNA, 1410 nt, Artificial Sequence; identical to SEQ ID NO: 138754
  derived and/or modified sequence opt3 from neuraminidase__InfluenzaA__ADA83661

SEQ ID NO: 139954 - RNA, 1410 nt, Artificial Sequence; identical to SEQ ID NO: 138754
  derived and/or modified sequence opt3 from neuraminidase__InfluenzaA__ADA83669

SEQ ID NO: 139955 - RNA, 1410 nt, Artificial Sequence; identical to SEQ ID NO: 138754
  derived and/or modified sequence opt3 from neuraminidase__InfluenzaA__ADA83673

SEQ ID NO: 139956 - RNA, 1410 nt, Artificial Sequence; identical to SEQ ID NO: 138754
  derived and/or modified sequence opt3 from neuraminidase__InfluenzaA__ADA83677

SEQ ID NO: 139957 - RNA, 1410 nt, Artificial Sequence; identical to SEQ ID NO: 138754
  derived and/or modified sequence opt3 from neuraminidase__InfluenzaA__ADA83681

SEQ ID NO: 139958 - RNA, 1410 nt, Artificial Sequence; identical to SEQ ID NO: 138754
  derived and/or modified sequence opt3 from neuraminidase__InfluenzaA__ADA83685

SEQ ID NO: 139959 - RNA, 1410 nt, Artificial Sequence; identical to SEQ ID NO: 138754
  derived and/or modified sequence opt3 from neuraminidase__InfluenzaA__ADA86069

SEQ ID NO: 139960 - RNA, 1410 nt, Artificial Sequence; identical to SEQ ID NO: 138754
  derived and/or modified sequence opt3 from neuraminidase__InfluenzaA__ADB27973

SEQ ID NO: 139961 - RNA, 1410 nt, Artificial Sequence; identical to SEQ ID NO: 138754
  derived and/or modified sequence opt3 from neuraminidase__InfluenzaA__ADB27983

SEQ ID NO: 139962 - RNA, 1410 nt, Artificial Sequence
  derived and/or modified sequence opt3 from neuraminidase__InfluenzaA__ADB66693
augaaccccaaucagaagaucauuaccauaggcagcgugugcaugacaaucgggauggccaaccugauucuccaaaucggaaauauuaucuccauauggaucauucacucuauccagcuugguaaccagaaucagauugagacuuguaaccaaucagucaucacguacgaaaauaacaccuggguuaaucagacauaugugaacauaaguaauacuaacuucgcugcaggccagagcguaguguccgucaaacuggccggaaauucuucguugugcccugugucagggugggcgauuuacagcaaggacaacaguaucagaauuggcuccaaaggugauguuuuugugaucagggagccauucaucucuuguagcccguuagaaugccggaccuuuuuccugacacagggggcucuacucaaugacaagcauuccaacggaaccauuaaagaucgcucacccuaucgaacucugaugaguuguccuauaggcgaggucccaagccccuacaacucucguuuugaauccguggccuggucagcaagcgccugccacgacggcaucaauuggcuuacaauugggaucaguggaccugauaacggugcuguagcaguucugaaguauaauggcauaauuaccgacacgaucaagucuuggagaaacaauaucuugaggacucaagaguccgagugugccugcgugaacgggagcuguuucaccgucaugacagauggaccaucggacggccaggcuucuuacaaaauuuuucggaucgaaaaggguaaaauugugaaguccguggagaugaaugcccccaacuaucauuacgaagagugcucauguuacccugauaguagcgagauaacuugcgucugccgcgacaauuggcacggguccaacagaccauggguuucuuucaaucagaaccucgaauaucagaucggauacauuuguagcggcaucuuuggcgauaauccgaggcccaacgacaaaaccgggucaugcggaccugugaguuccaauggugcgaacggcguaaagggguucagcuuuaaguauggaaacggcguguggaucggucggacaaaaucuauuucaagucgcaauggguucgagaugauaugggauccaaacggcuggaccggaacggacaauaacuuuagcaucaagcaagacauugucggcaucaaugaaugguccggguacucuggaucguucgugcagcaucccgagcugacuggucuggauuguauucgaccuugcuucuggguugaacucaucagaggcaggccaaaagagaacacaauauggaccagcggguccucaaucaguuuuuguggagucaauucugacacugugggcuggagcuggcccgauggugcagaguuaccguucacaauugacaaguga

SEQ ID NO: 139963 - RNA, 1410 nt, Artificial Sequence; identical to SEQ ID NO: 138754
  derived and/or modified sequence opt3 from neuraminidase__InfluenzaA__ADB66695

SEQ ID NO: 139964 - RNA, 1410 nt, Artificial Sequence; identical to SEQ ID NO: 138754
  derived and/or modified sequence opt3 from neuraminidase__InfluenzaA__ADB66696

SEQ ID NO: 139965 - RNA, 1410 nt, Artificial Sequence
  derived and/or modified sequence opt3 from neuraminidase__InfluenzaA__ADB66697
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccggaaauucgucauugugcccugugagcgggugggcgauuuacaguaaggacaacuccaucagaauuggcucuaaaggugauguuuuugugaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggucccaucucccuacaacucccguuuugaaucaguggccuggagcgcaagugccugccacgacggcaucaauuggcuuacaauugggaucucuggaccugauaacggugcuguagcaguucugaaguauaauggcauaauuaccgacacgaucaaguccuggagaaacaauaucuugaggacucaagagagcgagugugccugcgugaacgggucguguuucaccgucaugacagauggaccaucugacgaacaggcuuccuacaaaauuuuucggaucgagaagggcaaaauugugaagucaguggaaaugaaugcccccaacuaucauuacgaggagugcaguuguuacccugauagcuccgaaauaacuugcgucugccgcgacaauuggcacgguucuaacagaccauggguuagcuucaaucagaaccucgaguauaggaucggguacauuuguucaggaaucuuuggcgauaauccgcggcccaacgacaaaaccggcaguugcgggccuguguccagcaauggagcgaacgguguaaagggcuucucuuuuaaguaugggaacggaguguggaucggccgcacaaaaucaauuaguagccgaaaugguuucgaaaugauaugggauccaaacggguggaccggcacggacaauaacuuuuccaucaagcaggacauugucggaauccaugaguggucuggcuacucggggagcuucgugcaacaccccgaacugacuggacuggauuguauuagaccuugcuucuggguugagcucaucaggggucggccaaaagagaauacaauauggaccuccggcucaaguaucucuuuuuguggggugaacagcgacacugucggaugguccuggcccgauggcgcagaauuaccguucacaauugacaaguga

SEQ ID NO: 139966 - RNA, 1410 nt, Artificial Sequence; identical to SEQ ID NO: 139929
  derived and/or modified sequence opt3 from neuraminidase__InfluenzaA__ADB81401

SEQ ID NO: 139967 - RNA, 1410 nt, Artificial Sequence; identical to SEQ ID NO: 139772
  derived and/or modified sequence opt3 from neuraminidase__InfluenzaA__ADB81421

SEQ ID NO: 139968 - RNA, 1410 nt, Artificial Sequence; identical to SEQ ID NO: 139108
  derived and/or modified sequence opt3 from neuraminidase__InfluenzaA__ADB81431

SEQ ID NO: 139969 - RNA, 1410 nt, Artificial Sequence; identical to SEQ ID NO: 138754
  derived and/or modified sequence opt3 from neuraminidase__InfluenzaA__ADB81441

SEQ ID NO: 139970 - RNA, 1410 nt, Artificial Sequence
  derived and/or modified sequence opt3 from neuraminidase__InfluenzaA__ADB81451
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugugugcgucaacgggucguguuucaccgugaugacagauggaccaucugacggccaggccuccuacaaaaucuuucggauugaaaaggguaaaaucgugaagucagucgagaugaaugcucccaacuaucauuacgaagagugcaguuguuacccugauagcuccgagauuacuugcguuugccgcgacaauuggcacgggucuaacagaccaugggugagcuucaaucagaaccucgaauaucagauaggauacaucuguucaggcauuuuuggcgauaauccgaggcccaacgacaaaaccgggaguugcggaccuguauccagcaauggugccaacggcgugaagggguucucuuuuaaguauggaaacggcgucuggaucggucggacaaaaucaaucaguagccgcaauggguucgagaugauuugggauccaaacggcuggaccggaacggacaauaaguuuuccauaaaacaagacaucgugggcauuaacgaauggucuggguacucggggagcuucguucagcaucccgagcugacuggucuggauuguauccgaccuugcuucuggguggaacucauuagaggcaggccaaaggagaauacaaucuggaccuccgggucaaguauaucuuuuuguggagucaacagcgacacugugggcugguccuggcccgauggugcggaguuaccguucacaaucgacaaauga

SEQ ID NO: 139971 - RNA, 1410 nt, Artificial Sequence; identical to SEQ ID NO: 139931
  derived and/or modified sequence opt3 from neuraminidase__InfluenzaA__ADB81461

SEQ ID NO: 139972 - RNA, 1410 nt, Artificial Sequence; identical to SEQ ID NO: 139931
  derived and/or modified sequence opt3 from neuraminidase__InfluenzaA__ADB82942

SEQ ID NO: 139973 - RNA, 1410 nt, Artificial Sequence; identical to SEQ ID NO: 138909
  derived and/or modified sequence opt3 from neuraminidase__InfluenzaA__ADB82945

SEQ ID NO: 139974 - RNA, 1410 nt, Artificial Sequence; identical to SEQ ID NO: 138754
  derived and/or modified sequence opt3 from neuraminidase__InfluenzaA__ADB89132

SEQ ID NO: 139975 - RNA, 1410 nt, Artificial Sequence; identical to SEQ ID NO: 139337
  derived and/or modified sequence opt3 from neuraminidase__InfluenzaA__ADB89142

SEQ ID NO: 139976 - RNA, 1410 nt, Artificial Sequence; identical to SEQ ID NO: 138754
  derived and/or modified sequence opt3 from neuraminidase__InfluenzaA__ADB89224

SEQ ID NO: 139977 - RNA, 1410 nt, Artificial Sequence
  derived and/or modified sequence opt3 from neuraminidase__InfluenzaA__ADB89234
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggugggaaauucgucauugugcccuguuagcggaugggccauauacaguaaggacaacuccgugagaauuggcucuaaaggugaugucuuugugaucagggagccauucauuagcuguuccccguuagaaugccggaccuuuuuccugacacagggggcgcuacucaaugacaagcauucaaacggaaccaucaaagaucgcagucccuaucgaacucugaugagcuguccuaucggcgagguaccaucucccuacaacucccguuuugaaucaguugcuuggagcgccagugcaugccacgacggcauuaauuggcuuacaauagggaucucuggaccugauaacggugccguggcuguccugaaguauaauggcauuaucaccgacacgauaaaguccuggagaaacaauauuuugaggacucaagagagcgagugugcaugcgugaacgggucguguuucaccgugaugacagauggaccaucuaauggccaggccuccuacaaaaucuuucggaucgaaaaggguaaaauugucaagucaguugagaugaacgcucccaauuaucauuacgaagagugcaguuguuacccugacagcuccgagaucacuugcgugugccgcgauaacuggcacgggucuaauagaccaugggugagcuucaaccagaaucucgaauaucagauuggauacauauguucaggcaucuuuggcgacaacccgaggcccaaugauaaaaccgggaguugcggaccuguauccagcaacggugccaacggcgucaagggguucucuuuuaaguauggaaauggcguguggauuggucggacaaaaucaaucaguagccgcaacggguucgagaugaucugggacccaaauggcuggaccggaacggauaacaauuuuuccauuaagcaagacauaguuggcaucaacgaauggucuggguacucggggagcuucgugcagcaucccgagcugacuggucuggacuguauucgaccuugcuucugggucgaacucaucagaggcaggccaaaagagaauacaauuuggaccuccgggucaaguaucucuuuuuguggagugaacagcgauacuguaggcugguccuggcccgacggugcggaguuaccguucacaauagauaaguga

SEQ ID NO: 139978 - RNA, 1410 nt, Artificial Sequence; identical to SEQ ID NO: 138744
  derived and/or modified sequence opt3 from neuraminidase__InfluenzaA__ADB89244

SEQ ID NO: 139979 - RNA, 1410 nt, Artificial Sequence; identical to SEQ ID NO: 138754
  derived and/or modified sequence opt3 from neuraminidase__InfluenzaA__ADB89264

SEQ ID NO: 139980 - RNA, 1410 nt, Artificial Sequence; identical to SEQ ID NO: 139724
  derived and/or modified sequence opt3 from neuraminidase__InfluenzaA__ADB89274

SEQ ID NO: 139981 - RNA, 1410 nt, Artificial Sequence; identical to SEQ ID NO: 138909
  derived and/or modified sequence opt3 from neuraminidase__InfluenzaA__ADB89284

SEQ ID NO: 139982 - RNA, 1410 nt, Artificial Sequence; identical to SEQ ID NO: 138754
  derived and/or modified sequence opt3 from neuraminidase__InfluenzaA__ADB89294

SEQ ID NO: 139983 - RNA, 1410 nt, Artificial Sequence; identical to SEQ ID NO: 138754
  derived and/or modified sequence opt3 from neuraminidase__InfluenzaA__ADB89304

SEQ ID NO: 139984 - RNA, 1410 nt, Artificial Sequence; identical to SEQ ID NO: 138754
  derived and/or modified sequence opt3 from neuraminidase__InfluenzaA__ADB89314

SEQ ID NO: 139985 - RNA, 1410 nt, Artificial Sequence; identical to SEQ ID NO: 138754
  derived and/or modified sequence opt3 from neuraminidase__InfluenzaA__ADB89324

SEQ ID NO: 139986 - RNA, 1410 nt, Artificial Sequence; identical to SEQ ID NO: 138754
  derived and/or modified sequence opt3 from neuraminidase__InfluenzaA__ADB89334

SEQ ID NO: 139987 - RNA, 1410 nt, Artificial Sequence; identical to SEQ ID NO: 138754
  derived and/or modified sequence opt3 from neuraminidase__InfluenzaA__ADB89344

SEQ ID NO: 139988 - RNA, 1410 nt, Artificial Sequence; identical to SEQ ID NO: 138754
  derived and/or modified sequence opt3 from neuraminidase__InfluenzaA__ADB89364

SEQ ID NO: 139989 - RNA, 1410 nt, Artificial Sequence; identical to SEQ ID NO: 138754
  derived and/or modified sequence opt3 from neuraminidase__InfluenzaA__ADB89374

SEQ ID NO: 139990 - RNA, 1410 nt, Artificial Sequence; identical to SEQ ID NO: 138754
  derived and/or modified sequence opt3 from neuraminidase__InfluenzaA__ADB89384

SEQ ID NO: 139991 - RNA, 1410 nt, Artificial Sequence; identical to SEQ ID NO: 138754
  derived and/or modified sequence opt3 from neuraminidase__InfluenzaA__ADB89394

SEQ ID NO: 139992 - RNA, 1410 nt, Artificial Sequence
  derived and/or modified sequence opt3 from neuraminidase__InfluenzaA__ADB89404
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacagcauuuugaggacucaagagucggagugugccugcgucaaugggucuuguuucaccgugaugacagauggaccauccaacggccaggcuucauacaaaaucuuucggaucgaaaaggguaaaauugugaagagugucgagaugaaugcccccaacuaucauuacgaagagugcagcuguuacccugacuccucugagaucacuugcguuugccgcgauaauuggcacgggagcaacagaccaugggugucauucaaucagaaccucgaauaucagauuggauacauauguaguggcaucuuuggcgacaauccgaggcccaacgauaaaaccggguccugcggaccuguaagcucuaauggugcgaacggcgugaagggguucucauuuaaguauggaaacggcgucuggauuggucggacaaaaaguaucagcucccgcaauggguucgagaugaucugggacccaaacggcuggaccggaacggauaauaacuuuucuauuaagcaagacauagugggcaucaaugaauggucgggguacagcggauccuucguucagcaucccgagcugacuggucuggacuguauucgaccuugcuucuggguggaacucaucagaggcaggccaaaagagaacacaauuuggaccucagggaguucuaucagcuuuuguggagucaauuccgauacugugggcuggucauggcccgacggugcagaguuaccguucacaauagauaaguga

SEQ ID NO: 139993 - RNA, 1410 nt, Artificial Sequence; identical to SEQ ID NO: 138754
  derived and/or modified sequence opt3 from neuraminidase__InfluenzaA__ADB89414

SEQ ID NO: 139994 - RNA, 1410 nt, Artificial Sequence; identical to SEQ ID NO: 138754
  derived and/or modified sequence opt3 from neuraminidase__InfluenzaA__ADB89424

SEQ ID NO: 139995 - RNA, 1410 nt, Artificial Sequence; identical to SEQ ID NO: 138754
  derived and/or modified sequence opt3 from neuraminidase__InfluenzaA__ADB89434

SEQ ID NO: 139996 - RNA, 1410 nt, Artificial Sequence; identical to SEQ ID NO: 138754
  derived and/or modified sequence opt3 from neuraminidase__InfluenzaA__ADB89444

SEQ ID NO: 139997 - RNA, 1410 nt, Artificial Sequence
  derived and/or modified sequence opt3 from neuraminidase__InfluenzaA__ADB89454
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaaaugacggccaggcuucuuacaaaaucuuucggauugaaaaggguaaaaucgugaaguccguggagaugaacgcccccaauuaucauuacgaagagugcucauguuacccugauaguagcgagauuacuugcgucugccgcgacaacuggcacggguccaauagaccauggguuucuuucaaccagaaucucgaauaucagauaggauacaucuguagcggcauuuuuggcgauaacccgaggcccaaugacaaaaccgggucaugcggaccugugaguuccaacggugcgaacggcguaaagggguucagcuuuaaguauggaaauggcguguggaucggucggacaaaaucuaucucaagucgcaacggguucgagaugauuugggauccaaauggcuggaccggaacggacaacaauuuuagcauaaagcaagacaucgucggcauuaacgaaugguccggguacucuggaucguucgugcagcaucccgagcugacuggucuggauuguauccgaccuugcuucuggguugaacucauuagaggcaggccaaaagagaauacaaucuggaccagcggguccucaauaaguuuuuguggagugaacucugacacugucggcuggagcuggcccgauggugcagaguuaccguucacaaucgacaaguga

SEQ ID NO: 139998 - RNA, 1410 nt, Artificial Sequence; identical to SEQ ID NO: 138754
  derived and/or modified sequence opt3 from neuraminidase__InfluenzaA__ADB89464

SEQ ID NO: 139999 - RNA, 1410 nt, Artificial Sequence; identical to SEQ ID NO: 138754
  derived and/or modified sequence opt3 from neuraminidase__InfluenzaA__ADB89484

SEQ ID NO: 140000 - RNA, 1410 nt, Artificial Sequence; identical to SEQ ID NO: 138754
  derived and/or modified sequence opt3 from neuraminidase__InfluenzaA__ADB89494

SEQ ID NO: 140001 - RNA, 1410 nt, Artificial Sequence; identical to SEQ ID NO: 138744
  derived and/or modified sequence opt3 from neuraminidase__InfluenzaA__ADB89504

SEQ ID NO: 140002 - RNA, 1410 nt, Artificial Sequence; identical to SEQ ID NO: 138754
  derived and/or modified sequence opt3 from neuraminidase__InfluenzaA__ADB89514

SEQ ID NO: 140003 - RNA, 1410 nt, Artificial Sequence; identical to SEQ ID NO: 138754
  derived and/or modified sequence opt3 from neuraminidase__InfluenzaA__ADB89524

SEQ ID NO: 140004 - RNA, 1410 nt, Artificial Sequence
  derived and/or modified sequence opt3 from neuraminidase__InfluenzaA__ADB89544
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccuuacuggaaugccggaccuuuuuccuaacacagggggcucuccugaaugacaagcauucaaacggaaccaucaaagaucgcaguccguaucgaacucuuaugagcugucccauuggcgaggucccuucuccauacaacucccguuuugaaucaguggccuggagcgcaagugccugccacgacggcauaaauuggcugacaaucgggauuucuggacccgauaacggugcuguagcaguuuugaaguauaauggcaucauaaccgacacgauuaaguccuggagaaacaauauccucaggacucaagagagcgagugugccugcgugaacgggucguguuucaccgucaugacagauggaccuucugacggccaggcuuccuacaaaaucuuucggauugaaaaggguaaaaucgugaagucaguggagaugaaugccccaaacuaucauuacgaagagugcaguuguuaccccgauagcuccgagauuacuugcgucugccgcgacaauuggcacgggucuaacagaccuuggguuagcuucaaucagaaccuggaauaucagauaggauacaucuguucaggcauuuuuggcgauaauccaaggccgaacgacaaaaccgggaguugcggacccguguccagcaauggugcgaacggcguaaagggguucucuuuuaaguauggaaacggcguguggaucggucggacaaaaucaaucaguagccgcaauggguucgagaugauuugggauccuaacggcuggaccggaacggacaauaacuuuuccauaaagcaagacaucgucggcauuaaugaauggucuggguacucggggagcuucgugcagcauccagagcugacuggucucgauuguauccgacccugcuucuggguugaauuaauuagaggcaggccuaaagagaacacaaucuggaccuccgggucaaguauaucuuuuuguggagugaauagcgacacugucggcugguccuggccagauggugcagagcugcccuucacaaucgacaaguga

SEQ ID NO: 140005 - RNA, 1410 nt, Artificial Sequence; identical to SEQ ID NO: 138754
  derived and/or modified sequence opt3 from neuraminidase__InfluenzaA__ADB89564

SEQ ID NO: 140006 - RNA, 1410 nt, Artificial Sequence; identical to SEQ ID NO: 138754
  derived and/or modified sequence opt3 from neuraminidase__InfluenzaA__ADB89574

SEQ ID NO: 140007 - RNA, 1410 nt, Artificial Sequence; identical to SEQ ID NO: 138754
  derived and/or modified sequence opt3 from neuraminidase__InfluenzaA__ADB89594

SEQ ID NO: 140008 - RNA, 1410 nt, Artificial Sequence; identical to SEQ ID NO: 138754
  derived and/or modified sequence opt3 from neuraminidase__InfluenzaA__ADB89604

SEQ ID NO: 140009 - RNA, 1410 nt, Artificial Sequence
  derived and/or modified sequence opt3 from neuraminidase__InfluenzaA__ADB89614
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcaucuggaucggucggacaaaaucaauuaguagccgcaauggguucgagaugauaugggauccaaacggcuggaccggaacggacaauaacuuuuccaucaagcaagacauugugggcaucaaugaauggucuggguacucggggagcuucguccagcaucccgagcugacuggucuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 140010 - RNA, 1410 nt, Artificial Sequence; identical to SEQ ID NO: 138754
  derived and/or modified sequence opt3 from neuraminidase__InfluenzaA__ADB89624

SEQ ID NO: 140011 - RNA, 1410 nt, Artificial Sequence; identical to SEQ ID NO: 138754
  derived and/or modified sequence opt3 from neuraminidase__InfluenzaA__ADB89634

SEQ ID NO: 140012 - RNA, 1410 nt, Artificial Sequence; identical to SEQ ID NO: 138754
  derived and/or modified sequence opt3 from neuraminidase__InfluenzaA__ADB89644

SEQ ID NO: 140013 - RNA, 1410 nt, Artificial Sequence; identical to SEQ ID NO: 139772
  derived and/or modified sequence opt3 from neuraminidase__InfluenzaA__ADB89664

SEQ ID NO: 140014 - RNA, 1410 nt, Artificial Sequence; identical to SEQ ID NO: 138754
  derived and/or modified sequence opt3 from neuraminidase__InfluenzaA__ADB89674

SEQ ID NO: 140015 - RNA, 1410 nt, Artificial Sequence; identical to SEQ ID NO: 138754
  derived and/or modified sequence opt3 from neuraminidase__InfluenzaA__ADB89684

SEQ ID NO: 140016 - RNA, 1410 nt, Artificial Sequence
  derived and/or modified sequence opt3 from neuraminidase__InfluenzaA__ADB89694
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuacuauaaagcaagacaucgucggcauuaaugaaugguccggguacucuggaucguucgugcagcaucccgagcugacaggucuggauuguauccgaccuugcuucuggguugaacucauuagaggcaggccaaaagagaacaccaucuggacuagcggguccucaauaaguuuuuguggagucaauucugacacagugggcuggagcuggcccgauggugcagaguuaccguucaccaucgacaaguga

SEQ ID NO: 140017 - RNA, 1410 nt, Artificial Sequence; identical to SEQ ID NO: 138754
  derived and/or modified sequence opt3 from neuraminidase__InfluenzaA__ADB89704

SEQ ID NO: 140018 - RNA, 1410 nt, Artificial Sequence; identical to SEQ ID NO: 138754
  derived and/or modified sequence opt3 from neuraminidase__InfluenzaA__ADB89714

SEQ ID NO: 140019 - RNA, 1410 nt, Artificial Sequence; identical to SEQ ID NO: 138615
  derived and/or modified sequence opt3 from neuraminidase__InfluenzaA__ADB89724

SEQ ID NO: 140020 - RNA, 1410 nt, Artificial Sequence; identical to SEQ ID NO: 138615
  derived and/or modified sequence opt3 from neuraminidase__InfluenzaA__ADB89735

SEQ ID NO: 140021 - RNA, 1410 nt, Artificial Sequence; identical to SEQ ID NO: 138754
  derived and/or modified sequence opt3 from neuraminidase__InfluenzaA__ADB90357

SEQ ID NO: 140022 - RNA, 1410 nt, Artificial Sequence; identical to SEQ ID NO: 138754
  derived and/or modified sequence opt3 from neuraminidase__InfluenzaA__ADB90358

SEQ ID NO: 140023 - RNA, 1410 nt, Artificial Sequence
  derived and/or modified sequence opt3 from neuraminidase__InfluenzaA__ADB90359
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaaguauuaucacguacgaaaauaacaccugggucaaucagacauauguuaacauaagcaauacuaacuucgcugcaggccaguccgugguaucugugaaacuggccggaaauucgucauugugcccugucagcggaugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauauaggaucggauacauuuguucaggcaucuuuggcgauaauccgcggcccaacgacaaaaccgggaguugcggaccuguuuccagcaauggugcgaacggcgugaagggguucucuuuuaaguauggaaacggcguauggaucggucgcacaaaaucaauuaguagccgaaauggguucgagaugauaugggauccaaacggcuggaccggaacggacaauaacuuuuccaucaagcaggacauugugggcacuaaugaauggucuggguacucggggagcuucguccaacaucccgagcugacaggucuggauuguaucagaccuugcuucuggguggaacucauuaggggccggccaaaagagaacaccaucuggacuuccgggucaaguauaucuuuuuguggaguuaauagcgacacagugggcugguccuggcccgauggugcagaguuaccguucaccaucgacaaguga

SEQ ID NO: 140024 - RNA, 1410 nt, Artificial Sequence; identical to SEQ ID NO: 138754
  derived and/or modified sequence opt3 from neuraminidase__InfluenzaA__ADB90363

SEQ ID NO: 140025 - RNA, 1410 nt, Artificial Sequence; identical to SEQ ID NO: 139931
  derived and/or modified sequence opt3 from neuraminidase__InfluenzaA__ADB90373

SEQ ID NO: 140026 - RNA, 1410 nt, Artificial Sequence; identical to SEQ ID NO: 138754
  derived and/or modified sequence opt3 from neuraminidase__InfluenzaA__ADB98137

SEQ ID NO: 140027 - RNA, 1410 nt, Artificial Sequence; identical to SEQ ID NO: 139108
  derived and/or modified sequence opt3 from neuraminidase__InfluenzaA__ADB98138

SEQ ID NO: 140028 - RNA, 1410 nt, Artificial Sequence; identical to SEQ ID NO: 138754
  derived and/or modified sequence opt3 from neuraminidase__InfluenzaA__ADB98139

SEQ ID NO: 140029 - RNA, 1410 nt, Artificial Sequence; identical to SEQ ID NO: 139108
  derived and/or modified sequence opt3 from neuraminidase__InfluenzaA__ADB98140

SEQ ID NO: 140030 - RNA, 1410 nt, Artificial Sequence; identical to SEQ ID NO: 139108
  derived and/or modified sequence opt3 from neuraminidase__InfluenzaA__ADB98141

SEQ ID NO: 140031 - RNA, 1410 nt, Artificial Sequence; identical to SEQ ID NO: 138754
  derived and/or modified sequence opt3 from neuraminidase__InfluenzaA__ADC32391

SEQ ID NO: 140032 - RNA, 1410 nt, Artificial Sequence; identical to SEQ ID NO: 138754
  derived and/or modified sequence opt3 from neuraminidase__InfluenzaA__ADC32392

SEQ ID NO: 140033 - RNA, 1410 nt, Artificial Sequence; identical to SEQ ID NO: 138754
  derived and/or modified sequence opt3 from neuraminidase__InfluenzaA__ADC32393

SEQ ID NO: 140034 - RNA, 1410 nt, Artificial Sequence; identical to SEQ ID NO: 138754
  derived and/or modified sequence opt3 from neuraminidase__InfluenzaA__ADC32394

SEQ ID NO: 140035 - RNA, 1410 nt, Artificial Sequence; identical to SEQ ID NO: 138754
  derived and/or modified sequence opt3 from neuraminidase__InfluenzaA__ADC32395

SEQ ID NO: 140036 - RNA, 1410 nt, Artificial Sequence; identical to SEQ ID NO: 138754
  derived and/or modified sequence opt3 from neuraminidase__InfluenzaA__ADC32396

SEQ ID NO: 140037 - RNA, 1410 nt, Artificial Sequence; identical to SEQ ID NO: 138754
  derived and/or modified sequence opt3 from neuraminidase__InfluenzaA__ADC32397

SEQ ID NO: 140038 - RNA, 1410 nt, Artificial Sequence; identical to SEQ ID NO: 138754
  derived and/or modified sequence opt3 from neuraminidase__InfluenzaA__ADC32398

SEQ ID NO: 140039 - RNA, 1410 nt, Artificial Sequence; identical to SEQ ID NO: 138754
  derived and/or modified sequence opt3 from neuraminidase__InfluenzaA__ADC32399

SEQ ID NO: 140040 - RNA, 1410 nt, Artificial Sequence; identical to SEQ ID NO: 138754
  derived and/or modified sequence opt3 from neuraminidase__InfluenzaA__ADC32400

SEQ ID NO: 140041 - RNA, 1410 nt, Artificial Sequence; identical to SEQ ID NO: 138754
  derived and/or modified sequence opt3 from neuraminidase__InfluenzaA__ADC32401

SEQ ID NO: 140042 - RNA, 1410 nt, Artificial Sequence
  derived and/or modified sequence opt3 from neuraminidase__InfluenzaA__ADC32404
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaaggggaguugcggaccuguguccagcaauggugcgaacggcguaaagggguucucuuuuaaauauggaaacggcguguggaucggucggaccaagucaaucaguagccgcaauggguucgagaugauuugggauccaaacggcuggacaggaaccgacaauaacuuuuccauaaaacaagacaucgucggcauuaaugaauggucuggguacucggggagcuucgugcagcaucccgagcugacgggucuggauuguauccgaccuugcuucuggguugaacucauuagaggcaggccaaaggagaacacuaucuggacauccgggucaaguauaucuuuuuguggagugaauagcgacaccgucggcugguccuggcccgauggugcagaguuaccguucacuaucgacaaauga

SEQ ID NO: 140043 - RNA, 1410 nt, Artificial Sequence
  derived and/or modified sequence opt3 from neuraminidase__InfluenzaA__ADC32407
augaaccccaagcagaaaaucauuaccauaggcagcgugugcaugacaaucgggauggccaaucugauucuccaaaucggaaacauuaucuccauauggaucucucacucaauucagcuugguaaucagaaccagaucgagacuuguaaucaaagugucauuacguacgaaaacaauaccuggguuaaccagacauaugugaauaucagcaacacuaauuucgcugcaggccaguccguagugucugucaagcuggccgggaacucgucauugugcccugugagcggaugggcgauauacaguaaagacaauuccauuagaaucggcucuaagggugauguuuuugugauuagggagccauucaucagcuguuccccguuagaaugccggaccuuuuuccugacacagggggcucuacucaacgacaaacauucaaauggaaccaucaaggaucgcagucccuaucgaacucugaugagcuguccuauuggcgaggucccaucucccuacaacucccguuuugaaucaguggccuggagcgcaagugccugccacgacggcauaaacuggcuuacaaucgggauuucuggaccugauaauggugcuguagcaguucugaaguauaacggcaucauaaccgacacgauuaaauccuggagaaauaacaucuugaggacucaagagagcgagugugccugcgugaaugggucguguuucaccgucaugacagauggaccaucugacggccaggcuuccuacaagaucuuucggauugaaaaagguaagaucgugaaaucaguggagaugaacgcccccaauuaucauuacgaagagugcaguuguuacccugauagcuccgagauuacuugcgucugccgcgacaacuggcacgggucuaauagaccauggguuagcuucaaccagaaucucgaauaucagauaggauacaucuguucaggcauuuuuggcgauaacccgaggcccaaugacaagaaggggaguugcggaccuguguccagcaacggugcgaauggcguaaaaggguucucuuuuaaguauggaaacggcguguggaucggucggaccaaaucaaucaguagccgcaacggguucgagaugauuugggauccaaauggcuggacaggaaccgacaacaauuuuuccauaaagcaagacaucgucggcauuaacgaauggucuggguacucggguagcuucgugcagcaucccgagcugacgggacuggauuguauccgaccuugcuucuggguugaacucauuagaggcaggccaaaagagaauacuaucuggacauccgggucaaguauaucuuuuuguggagugaacagcgacaccgucggcugguccuggcccgauggugcagaguuaccguucacuaucgacaaguga

SEQ ID NO: 140044 - RNA, 1410 nt, Artificial Sequence
  derived and/or modified sequence opt3 from neuraminidase__InfluenzaA__ADC34942
augaaccccaaucagaagaucauuaccauaggcagcgugucccugacaaucucuacuauuugcuucuuuaugcaaaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaauuagcugaguacagggaguggucaaagccacaguguaauauaacaggguucgcacccuuuaguaaagacaacagcauucggcuguccgccggaggugauaucuggguaacccgcgaaccuuaugugucuugcgacccagauaaguguuaccaauucgcgcuaggccaggggacgacucucaauaacguccauucgaaugacauugugcgagaucguacccccuauagaacacugcuuaugaacgagcugggaguuccuuuucacuugggcacuaaacaggugugcaucgcuuggucaagcaguuccugucaugacgguaaggccuggcuccacgucugcgugaccggggaugacaagaaugcaacagccucuuucaucuacaacggaaggcugguagauagcauuguuuccuggucaaaagaaauacugcggacccaggagagugagugugugugcaucaauggcacguguacugucgugaugacagacggcagcgcuucugggaaggcagauaccaaaauucucuuuaucgaagagggaaagauagugcauacuuccacauuaucagguagcgcccaacacgucgaagagugcaguugcuauccacgcuacccgggcguuagaugugugugcagggacaacuggcgggggucuaaccgccccauuguagauaucaauaugaaggacuacuccaucgugagcucguaugucuguucuggacuggugggcgacaccccucggaaaaacgauuccucaaguagcggucacugccuuaauccaaacaaugaagaagggggacauggcguuaagggcugggcuuucgacgaugggaacgacguguggaugggaagaacgauuuccgagaaauugaggucugguuacgagaccuuuaaggucaucgagggcuggagcaaucccaacucaaaacugcagauuaaucgacaggugauaguagaucgugggaaccgcaguggauauuccggcaucuucagcguugaagguaagucuuguauuaauagaugcuuuuacguggagcuaaucagggggcggaaagaagagacagagguccucuggacuucaaacaguaucguggucuucuguggcaccagcggaacauauggcacuggguccuggccugacggagccgauauuaaucugaugccaauauga

SEQ ID NO: 140045 - RNA, 1410 nt, Artificial Sequence
  derived and/or modified sequence opt3 from neuraminidase__InfluenzaA__ADC39000
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacaacgucggcugguccuggcccgauggugcagaguuaccguucacuaucgacaaguga

SEQ ID NO: 140046 - RNA, 1410 nt, Artificial Sequence; identical to SEQ ID NO: 138754
  derived and/or modified sequence opt3 from neuraminidase__InfluenzaA__ADC39010

SEQ ID NO: 140047 - RNA, 1413 nt, Artificial Sequence; identical to SEQ ID NO: 138648
  derived and/or modified sequence opt3 from neuraminidase__InfluenzaA__ADC45606

SEQ ID NO: 140048 - RNA, 1413 nt, Artificial Sequence
  derived and/or modified sequence opt3 from neuraminidase__InfluenzaA__ADC45628
augaaccccaaucagaagaucauuaccauaggcagcaucuccauugccaucgggauuaucucucugaugcuccaaaugggaaacauaaucucaauuugggcuagucacagcauccagacagguucccagaaucauacuggcauuugcaaccagagaaucauaacguacgaaaauucuaccugggugaaccacacauaugucaauauuaacaauacuaacguuguggcagggaaagacaagaccccuguaacacuugugggaaauucgucacuguguagcaucaguggcugggccauuuacaccaaagauaacuccaucaggaucgguucuaagggggacgucuucgugauucgggagccauuuauaagcugcucccauuuggaguguaaaacuuucuuuuuaacacaaggagcgcugcuaaaugauaagcacucaaacggcaccguuaaggaccgcaguccguaucgagcucucaugagcugcccccugggcgaagccccuucuccauacaauuccaaauucgagucaguggcauggagcgccagugcuugucaugaugggaucggauggcuuacgauugguaucucuggccccgacaacggggcagucgccgugcugaaguauaaaggaauaauuacuggcaccaucaaguccuggaaaaagcagaucuugcguacacaggaaagcgagugcguauguaugaacgguucgugcuuuacuauuaugaccgaugggccuucuaauggagcugccuccuacaagaucuucaaaauugagaagggcaaaguuacaaagucaauggaacucaacgcgccaaauuuucacuaugaggaauguaguugcuaccccgacaccggcacggugaugugugucugcagagauaacuggcacgggagcaauaggccuuggguguccuucaaccagaaucuggacuaccaaauaggauauaucugcucugguguguuuggcgauaacccacggccgaaagaccgcgaggggagcuguaaucccgucacuguugauggagcaaacggcgugaaggguuucucauacaaauaugggaauggcguauggauuggaagaacaaagaguaacaggauccggaagggcuuugagaugaucugggacccuaauggguggaccaacacugacuccgauuucagcgugaaacaggacauugucgccauaacagauuggucuggauacucagguaguuuugugcagcauccagaacugaccggccucgacugcauccgccccuguuucuggguugaguuagugcgagggcugccuagagaaaauacgaccauuuggacaagcggauccucuaucucguucugcggcgucaacggugauauugcuaacuggagcuggccagacggggccgagcuucccuuuacuaucgauaaguga

SEQ ID NO: 140049 - RNA, 1413 nt, Artificial Sequence
  derived and/or modified sequence opt3 from neuraminidase__InfluenzaA__ADC45639
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccccuguaacacuugugggaaauucgucacuguguagcauuaguggcugggccaucuacaccaaagauaacuccaucaggauugguucuaagggggacgucuucgugauacgggagccauuuaucagcugcucccauuuggaguguaaaacuuucuuuuuaacacaaggagcgcugcuaaaugauaagcacucaaacggcaccguuaaggaccgcaguccguaucgagcucucaugagcugcccccugggcgaagccccuucuccauacaauuccaaauucgagucaguggcauggagcgccagugcuugucaugaugggauuggauggcuuacgaucggugucucuggccccgacaacggggcaguggccguacugaaguauaaaggaauaauuacuggcaccaucaaguccuggaaaaagcagaucuugcguacacaggaaagcgagugcguuuguaugaacgguucgugcuuuacuauuaugaccgaugggccuucuaauggagcugccuccuacaagaucuucaaaauugagaagggcaaagugacaaagucaauggaacucaacgcgccaaauuuucacuaugaggaauguaguugcuaccccgacaccggcacggucaugugugugugcagagauaacuggcacgggagcaauaggccuuggguguccuucaaccagaaucuggacuaccaaauaggauauaucugcucuggugucuuuggcgauaacccacggccgaaagaccgcgaggggagcuguaaucccguuacuguggauggagcaaacggcguaaaggguuucucauacaaauaugggaauggcguguggauuggaagaacaaagaguaacaggauccggaagggcuuugagaugaucugggacccuaauggguggaccaacacugacuccgauuucagcgucaaacaggacauuguggccauaacagauuggucuggauacucagguaguuuuguucagcauccagaacugaccggccucgacugcauccgccccuguuucuggguggaguuaguccgagggcugccuagagaaaauacgaccauuuggacaagcggauccucuaucucguucugcggcgugaacggugauauugcuaacuggagcuggccagacggggccgagcuucccuuuacuaucgauaaguga

SEQ ID NO: 140050 - RNA, 1413 nt, Artificial Sequence; identical to SEQ ID NO: 138648
  derived and/or modified sequence opt3 from neuraminidase__InfluenzaA__ADC45650

SEQ ID NO: 140051 - RNA, 1413 nt, Artificial Sequence; identical to SEQ ID NO: 138648
  derived and/or modified sequence opt3 from neuraminidase__InfluenzaA__ADC45661

SEQ ID NO: 140052 - RNA, 1413 nt, Artificial Sequence
  derived and/or modified sequence opt3 from neuraminidase__InfluenzaA__ADC45683
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcaggggaggacaaaaccccuguaacacuugugggaaauucgucacuguguagcauuaguggcugggccaucuacaccaaggauaacuccaucaggauugguucuaaaggggacgucuucgugauacgggagccauuuaucagcugcucccauuuggaauguaagacuuucuuuuuaacacaaggagcgcugcuaaaugauaaacacucaaacggcaccguuaaggaccgcaguccguaucgagcucucaugagcugcccccugggcgaggccccuucuccauacaauuccaaguucgaaucaguggcauggagcgccagugcuugucaugaugggauuggauggcuuacgaucgguauaucuggccccgacaacggggcagucgccgugcugaaauauaagggaauuaucacuggcaccaucaaauccuggaagaaacagauuuugcguacacaggagagcgagugcguauguaugaacgguucgugcuuuacuaucaugaccgaugggccuucuaauggagcugccuccuacaagauuuucaagauagaaaaaggcaagguuacaaaaucaauggagcucaacgcgccaaauuuucacuaugaagaguguaguugcuaccccgacaccggcacggugaugugugucugcagagauaacuggcacgggagcaauaggccuuggguguccuucaaccagaaucuggacuaccaaaucggauauauuugcucugguguguuuggcgauaacccacggccgaaggaccgcgaggggagcuguaaucccgucacuguugauggagcaaacggcgugaaagguuucucauacaaguaugggaauggcguauggaucggaagaacaaaaaguaacaggauccggaagggcuuugaaaugauuugggacccuaauggguggaccaacacugacuccgauuucagcgugaagcaggacauagucgccaucacagauuggucuggauacucagguaguuuugugcagcauccagagcugaccggccucgacugcauucgccccuguuucuggguugaauuagugcgagggcugccuagagagaauacgaccaucuggacaagcggauccucuauuucguucugcggcgucaacggugauaucgcuaacuggagcuggccagacggggccgaacuucccuuuacuauagauaaauga

SEQ ID NO: 140053 - RNA, 1413 nt, Artificial Sequence
  derived and/or modified sequence opt3 from neuraminidase__InfluenzaA__ADC45705
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaaaaccgaagcccauaucgugcccucaugucuugcccgcugggcgaggcacccuccccuuacaacucaaaguucgaaagcguugccuggagugcuucugcaugucacgacgggaugggauggcuuacgauugguaucuccggcccagauaauggggccguggcuguccugaaguauaacggaauaauuacuggcaccaucaaaagcuggaagaaacagaucuugagaacacaggagucggagugcguguguaugaaugguucuugcuuuacuauuaugaccgacgggcccuccaacaaggccgcgucauacaaaaucuucaagauugaaaagggaaaaguaacaaagaguauagagcucaaugcaccuaacuuucauuaugaagaguguagcugcuacccagauaccggcaucguuaugugugugugcagggacaauuggcacggcuccaaccggcccugggucucuuucaaucagaaccuggauuaccaaauuggguauaucugcagcggaguguuuggugacaauccucgcccagaggauggcgaagggucauguaacccggugacggucgacggagccaauggcguuaaagguuucaguuacaaguaugauaacgggguguggaucggcagaacuaaauccaauaggcugcggaagggauuugagaugauuugggaccccaacggcuggacaaacaccgacagcgauuucucuguaaaacaggacguggucgcuauaacugauuggucaggguacagugguagcuuugugcagcacccugaacucacaggauuagacugcauccgcccauguuucuggguugagcuggugcgaggccuucccagagaaaauaccacgauuuggaccuccgggucuucgaucagcuucugcggagucaacuccgauacagccaauuggucauggccugacggcgcagaguugccauuuacuauugauaaguga

SEQ ID NO: 140054 - RNA, 1413 nt, Artificial Sequence
  derived and/or modified sequence opt3 from neuraminidase__InfluenzaA__ADC45716
augaaccccaaucagaagaucauuaccauaggcagcaucuccauugccaucgggauuaucucucugaugcuccaaauaggaaacaucauuucaaucugggcuagucacagcauucagacagguucccagaaucauacuggcaucugcaaccagagaauaauuacguacgaaaauucuaccugggugaaccacacauaugucaauaucaacaauacuaacguuguggcagggaaagacaagaccccuguaacacuugugggaaauucgucacuguguagcauuaguggcugggccaucuacaccaaagauaacuccaucaggauugguucuaagggggacgucuucgugauacgggagccauuuaucagcugcucccauuuggaguguaaaacuuucuuuuuaacacaaggagcgcugcuaaaugauaagcacucaaacggcaccguuaaggaccgcaguccguaucgagcucucaugagcugcccccugggcgaagccccuucuccauacaauuccaaauucgagucaguggcauggagcgccagugcuugucaugaugggauuggauggcuuacgaucgguauaucuggccccgacaacggggcagucgccgugcugaaguauaaaggaauuaucacuggcaccaucaaguccuggaaaaagcagauuuugcguacacaggaaagcgagugcguauguaugaacgguucgugcuuuacuaucaugaccgaugggccuucuaauggagcugccuccuacaagauuuucaaaauagagaagggcaaaguuacaaagucaauggaacucaacgcgccaaauuuucacuaugaggaauguaguugcuaccccgacaccggcacggugaugugugucugcagagauaacuggcacgggagcaauaggccuuggguguccuucaaccagaaucuggacuaccaaaucggauauauuugcucugguguguuuggcgauaacccacggccgaaagaccgcgaggggagcuguaaucccgucacuguugauggagcaaacggcguggaggguuucucauacaaguaugggaauggcguauggaucggaagaacaaaaaguaacaggauccggaagggcuuugaaaugauuugggacccuaauggguggaccaacacugacuccgauuucagcgugaagcaggacauagucgccaucacaaauuggucuggauacucagguaguuuugugcagcauccagagcugaccggccucgauugcauucgccccuguuucuggguugaauuagugcgagggcugccuagagagaacacgaccaucuggacaagcggauccucuauuucguucugcggcgucaacggugacaucgcuaauuggagcuggccagauggggccgaacuucccuuuacuauagacaaauga

SEQ ID NO: 140055 - RNA, 1413 nt, Artificial Sequence
  derived and/or modified sequence opt3 from neuraminidase__InfluenzaA__ADC45738
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgacaaugggguguggaucggcagaacuaaauccaacaggcugcggaagggauuugagaugauuugggaccccaauggcuggacaaacaccgauagcgacuucucuguaaaacaggauguggucgcuauaacugacuggucaggguauagugguagcuuugugcagcacccugaacucacaggauuagauugcauccgcccauguuucuggguugagcuggugcgaggccuucccagagaaaacaccacgauuuggaccuccgggucuucgaucagcuucugcggagucaauuccgacacagccaacuggucauggccugauggcgcagaguugccauuuacuauugacaaguga

SEQ ID NO: 140056 - RNA, 1413 nt, Artificial Sequence
  derived and/or modified sequence opt3 from neuraminidase__InfluenzaA__ADC45760
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugugaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgccaaagaccgaagcccauaucgugcacucaugucuugcccgcugggcgaggcccccuccccuuacaacucaaaguucgaaagcguggcuuggagugcaucugccugucacgaugggaugggauggcuuacgauugguaucuccggcccagacaacggggcuguugccgugcugaaguauaauggaauaauuacuggcaccaucaaaagcuggaagaaacagaucuugagaacacaggagucggagugcgucuguaugaacgguucuugcuuuacuauuaugaccgaugggcccuccaauaaggcggcaucauacaaaaucuucaagauugaaaagggaaaagugacaaagaguauagagcucaacgccccuaauuuuuauuacgaagaguguagcugcuacccagacaccggcaucguaauguguguuugcagggauaacuggcauggcuccaaucggcccugggugucuuucaaccagaaucuggacuaucaaauuggguacaucugcagcggagucuuuggugauaacccucgcccagaggacggcgaagggucauguaauccggugacgguggauggagcuaacggcgucaaagguuucaguuauaaguacgggaauggcguuuggaucggaagaacuaaauccaacaggcugcggaagggcuuugagaugauuugggaccccaauggguggacaaacaccgacagcgauuucucugugaaacaggacguaguggccauaacugauuggucaggauauagugguagcuuuguccagcacccugaacucacaggcuuagggugcauccgcccauguuucuggguggagcugguucgaggacuucccagagaaaacaccacgauuuggaccuccgguucuucgaucagcuucugcggcgucaauuccgacacagcaaacuggucauggccugauggggcugaguugccauuuacuauugacaaguga

SEQ ID NO: 140057 - RNA, 1413 nt, Artificial Sequence
  derived and/or modified sequence opt3 from neuraminidase__InfluenzaA__ADC45771
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugugaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccagaggacggcgaagggucauguaauccggugacggucgauggagccaacggcguuaaagguuucaguuauaaguacgggaauggcguguggaucggaagaacuaaauccaacaggcugcggaagggcuuugagaugauuugggaccccaauggguggacaaacaccgacagcgauuucucuaugaaacaggacguaguggcuauaacugauuggucaggauauagugguagcuuuguccagcacccugaacucacaggcuuagacugcauccgcccauguuucuggguggagcugguucgagggcuucccagagaaaacaccacgauuuggaccuccggaucuucgaucagcuucugcggcgucaauuccgauacagccaacuggucauggccugacggugcagaguugccauuuacuauugauaaguga

SEQ ID NO: 140058 - RNA, 1413 nt, Artificial Sequence
  derived and/or modified sequence opt3 from neuraminidase__InfluenzaA__ADC45782
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaaucgaaccgugaaagaccguagcccauauagagcccucaugucuugcccgcugggcgaggcacccuccccuuacaacucaaaguucgaaagcguugccuggagugcuucugcaugucacgauggcaugggguggcuuacgauuggaaucuccgguccagacaacggcgccguggcuguccugaaguauaaugggauaauuacuggaaccaucaaaagcuggaagaaacagaucuugaggacacaggagucggagugcguguguguaaacggcucuugcuuuacuauuaugaccgauggucccuccaauaaggccgcgucauacaaaaucuucaagauugaaaaggggaaaguuacaaagaguauagagcucaacgcaccuaauuuuuauuacgaagaguguagcugcuacccagacaccggaaucgugaugugugucugccgggauaacuggcauggcuccaaucgccccugggugucuuucaaccagaaucuggacuaucaaauuggcuacaucugcagcgggguguuuggagauaacccuagaccagaggacggugaaggcucauguaauccggucacgguugauggggccaacggagugaaaggcuucaguuauaaguacgguaaugggguauggaucggcaggacuaaauccaaccggcugcgcaagggauuugagaugauuugggaccccaauggcuggacaaacaccgacagcgauuucucugugaaacaggacgucguggcuauaacugauuggucaggguauaguggauccuuuguucagcacccugaacucacagguuuagacugcauccgaccauguuucuggguggagcuggucagaggccuucccagggaaaacaccacgauuuggaccuccgggucuucgaucagcuucugcggagugaauagcgauacagccaacuggucauggccugacggcgcagaguugccauuuacuauugauaaguga

SEQ ID NO: 140059 - RNA, 1413 nt, Artificial Sequence
  derived and/or modified sequence opt3 from neuraminidase__InfluenzaA__ADC45804
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugugaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaauaacaaagaguaucgagcucaacgcaccuaauuuuuauuacgaagaguguagcugcuacccagacaccggcauuguaauguguguuugcagggauaacuggcauggcuccaaucggcccugggugucuuucaaccagaaucuggacuaucaaaucggguacaucugcagcggagucuuuggugauaacccucgcccagaggacggcgaagggucauguaauccggugacgguggauggagccaacggcgucaaagguuucaguuauaaguacgggaauggcguuuggauuggaagaacuaaauccaacaggcugcggaagggcuuugagaugauaugggaccccaauggguggacaaacaccgacagcgauuucucugugaaacaggacguaguggcuaucacugauuggucaggauauagugguagcuuuguccagcacccugaacucacaggcuuagacugcauucgcccauguuucuggguggagcugguucgagggcuucccagagaaaacaccacgaucuggaccuccggaucuucgauuagcuucugcggcgucaauuccgauacagccaacuggucauggccugacggugcagaguugccauuuacuaucgauaaguga

SEQ ID NO: 140060 - RNA, 1413 nt, Artificial Sequence
  derived and/or modified sequence opt3 from neuraminidase__InfluenzaA__ADC45815
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugugaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccgugaaaagcuggaagaaacagaucuugagaacacaggagucggagugcguauguaugaacgguucuugcuuuacuaucaugaccgaugggcccuccaauaaggccgcgucauacaaaauuuucaagaucgaaaagggaaaaguuacaaagaguauugagcucaacgcaccuaauuuuuauuacgaagaguguagcugcuacccagacaccggcauggugaugugugucugcagggauaacuggcauggcuccaaucggcccugggugucuuucaaccagaaucuggacuaucaaauaggguacaucugcagcggaguguuuggugauaacccucgcccagaggacggcgaagggucauguaauccggucacgguugauggagccaacggcgugaaagguuucaguuauaaguacgggaauggcguauggauuggaagaacuaaauccaacaggcugcggaagggcuuugagaugaucugggaccccaauggguggacaaacaccgacagcgauuucucugugaaacaggacgucguggcuaucacugauuggucaggauauagugguagcuuuguucagcacccugaacucacaggcuuagacugcauucgcccauguuucuggguggagcugguccgagggcuucccagagaaaacaccacgauauggaccuccggaucuucgaucagcuucugcggcgucaauuccgauacagccaacuggucauggccugacggugcagaguugccauuuacuauugauaaguga

SEQ ID NO: 140061 - RNA, 1413 nt, Artificial Sequence; identical to SEQ ID NO: 139477
  derived and/or modified sequence opt3 from neuraminidase__InfluenzaA__ADC45837

SEQ ID NO: 140062 - RNA, 1413 nt, Artificial Sequence; identical to SEQ ID NO: 139477
  derived and/or modified sequence opt3 from neuraminidase__InfluenzaA__ADC45848

SEQ ID NO: 140063 - RNA, 1410 nt, Artificial Sequence; identical to SEQ ID NO: 138754
  derived and/or modified sequence opt3 from neuraminidase__InfluenzaA__ADC53559

SEQ ID NO: 140064 - RNA, 1410 nt, Artificial Sequence; identical to SEQ ID NO: 138754
  derived and/or modified sequence opt3 from neuraminidase__InfluenzaA__ADD14088

SEQ ID NO: 140065 - RNA, 1410 nt, Artificial Sequence; identical to SEQ ID NO: 138754
  derived and/or modified sequence opt3 from neuraminidase__InfluenzaA__ADD14090

SEQ ID NO: 140066 - RNA, 1410 nt, Artificial Sequence; identical to SEQ ID NO: 138754
  derived and/or modified sequence opt3 from neuraminidase__InfluenzaA__ADD14094

SEQ ID NO: 140067 - RNA, 1410 nt, Artificial Sequence; identical to SEQ ID NO: 138754
  derived and/or modified sequence opt3 from neuraminidase__InfluenzaA__ADD14096

SEQ ID NO: 140068 - RNA, 1410 nt, Artificial Sequence; identical to SEQ ID NO: 138754
  derived and/or modified sequence opt3 from neuraminidase__InfluenzaA__ADD14098

SEQ ID NO: 140069 - RNA, 1410 nt, Artificial Sequence; identical to SEQ ID NO: 138754
  derived and/or modified sequence opt3 from neuraminidase__InfluenzaA__ADD14100

SEQ ID NO: 140070 - RNA, 1410 nt, Artificial Sequence; identical to SEQ ID NO: 138754
  derived and/or modified sequence opt3 from neuraminidase__InfluenzaA__ADD14102

SEQ ID NO: 140071 - RNA, 1410 nt, Artificial Sequence; identical to SEQ ID NO: 138754
  derived and/or modified sequence opt3 from neuraminidase__InfluenzaA__ADD14104

SEQ ID NO: 140072 - RNA, 1410 nt, Artificial Sequence; identical to SEQ ID NO: 138754
  derived and/or modified sequence opt3 from neuraminidase__InfluenzaA__ADD14106

SEQ ID NO: 140073 - RNA, 1410 nt, Artificial Sequence; identical to SEQ ID NO: 138754
  derived and/or modified sequence opt3 from neuraminidase__InfluenzaA__ADD14110

SEQ ID NO: 140074 - RNA, 1410 nt, Artificial Sequence; identical to SEQ ID NO: 138754
  derived and/or modified sequence opt3 from neuraminidase__InfluenzaA__ADD14112

SEQ ID NO: 140075 - RNA, 1410 nt, Artificial Sequence; identical to SEQ ID NO: 139724
  derived and/or modified sequence opt3 from neuraminidase__InfluenzaA__ADD14114

SEQ ID NO: 140076 - RNA, 1410 nt, Artificial Sequence; identical to SEQ ID NO: 138754
  derived and/or modified sequence opt3 from neuraminidase__InfluenzaA__ADD14116

SEQ ID NO: 140077 - RNA, 1410 nt, Artificial Sequence; identical to SEQ ID NO: 138754
  derived and/or modified sequence opt3 from neuraminidase__InfluenzaA__ADD14118

SEQ ID NO: 140078 - RNA, 1410 nt, Artificial Sequence; identical to SEQ ID NO: 138754
  derived and/or modified sequence opt3 from neuraminidase__InfluenzaA__ADD14120

SEQ ID NO: 140079 - RNA, 1410 nt, Artificial Sequence; identical to SEQ ID NO: 138754
  derived and/or modified sequence opt3 from neuraminidase__InfluenzaA__ADD14122

SEQ ID NO: 140080 - RNA, 1410 nt, Artificial Sequence; identical to SEQ ID NO: 138754
  derived and/or modified sequence opt3 from neuraminidase__InfluenzaA__ADD14124

SEQ ID NO: 140081 - RNA, 1410 nt, Artificial Sequence; identical to SEQ ID NO: 139813
  derived and/or modified sequence opt3 from neuraminidase__InfluenzaA__ADD14126

SEQ ID NO: 140082 - RNA, 1410 nt, Artificial Sequence; identical to SEQ ID NO: 138754
  derived and/or modified sequence opt3 from neuraminidase__InfluenzaA__ADD14128

SEQ ID NO: 140083 - RNA, 1410 nt, Artificial Sequence; identical to SEQ ID NO: 138754
  derived and/or modified sequence opt3 from neuraminidase__InfluenzaA__ADD14130

SEQ ID NO: 140084 - RNA, 1410 nt, Artificial Sequence; identical to SEQ ID NO: 138754
  derived and/or modified sequence opt3 from neuraminidase__InfluenzaA__ADD14132

SEQ ID NO: 140085 - RNA, 1410 nt, Artificial Sequence; identical to SEQ ID NO: 138754
  derived and/or modified sequence opt3 from neuraminidase__InfluenzaA__ADD14134

SEQ ID NO: 140086 - RNA, 1410 nt, Artificial Sequence; identical to SEQ ID NO: 138754
  derived and/or modified sequence opt3 from neuraminidase__InfluenzaA__ADD14136

SEQ ID NO: 140087 - RNA, 1410 nt, Artificial Sequence; identical to SEQ ID NO: 138754
  derived and/or modified sequence opt3 from neuraminidase__InfluenzaA__ADD14138

SEQ ID NO: 140088 - RNA, 1410 nt, Artificial Sequence; identical to SEQ ID NO: 138754
  derived and/or modified sequence opt3 from neuraminidase__InfluenzaA__ADD14142

SEQ ID NO: 140089 - RNA, 1410 nt, Artificial Sequence; identical to SEQ ID NO: 138754
  derived and/or modified sequence opt3 from neuraminidase__InfluenzaA__ADD14144

SEQ ID NO: 140090 - RNA, 1410 nt, Artificial Sequence; identical to SEQ ID NO: 138754
  derived and/or modified sequence opt3 from neuraminidase__InfluenzaA__ADD14146

SEQ ID NO: 140091 - RNA, 1410 nt, Artificial Sequence; identical to SEQ ID NO: 138754
  derived and/or modified sequence opt3 from neuraminidase__InfluenzaA__ADD14148

SEQ ID NO: 140092 - RNA, 1410 nt, Artificial Sequence
  derived and/or modified sequence opt3 from neuraminidase__InfluenzaA__ADD14150
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacgacaauuuuuccauaaagcaagauaucgucggcauuaacgaauggucuggguacucggggagcuucgugcagcaucccgagcugacuggucuggacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 140093 - RNA, 1410 nt, Artificial Sequence; identical to SEQ ID NO: 138754
  derived and/or modified sequence opt3 from neuraminidase__InfluenzaA__ADD14152

SEQ ID NO: 140094 - RNA, 1410 nt, Artificial Sequence
  derived and/or modified sequence opt3 from neuraminidase__InfluenzaA__ADD14154
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcauaacuaauuucgcugcaggccaguccguagugucugucaaacuggccgggaacucgucauugugcccugugagcggaugggcgauuuacaguaaggacaauuccaucagaauuggcucuaaaggugauguuuuugugaucagggagccauucaucagcuguuccccguuagaaugccggaccuuuuuccugacacagggggcucuacucaacgacaagcauucaaauggaaccauuaaagaucgcagucccuaucgaacucugaugagcuguccuauaggcgaggucccaucucccuacaacucccguuuugaaucaguggccuggagcgcaagugccugccacgacggcaucaacuggcuuacaauugggaucucuggaccugauaauggugcuguagcaguucugaaguauaacggcauaauuaccgacacgaucaaguccuggagaaauaacaucuugaggacucaagagagcgagugugccugcgugaaugggucguguuucaccgucaugacagauggaccaucugacggccaggcuuccuacaaaauuuuucggaucgaaaaggguaaaauugugaagucaguggagaugaacgcccccaauuaucauuacgaagagugcaguuguuacccugauagcuccgagauaacuugcgucugccgcgacaacuggcacgggucuaauagaccauggguuagcuucaaccagaaucucgaauaucagaucggauacauuuguucaggcaucuuuggcgauaacccgaggcccaaugacaaaaccgggaguugcggaccuguguccagcaacggugcgaauggcguaaagggguucucuuuuaaguauggaaacggcguguggaucggucggacaaaaucaauuaguagccgcaacggguucgagaugauaugggauccaaauggcuggaccggaacggacaacaauuuuuccaucaagcaagacauugucggcaucaacgaauggucuggguacucggguagcuucgugcagcaucccgagcugacuggacuggauuguauucgaccuugcuucuggguugaacucaucagaggcaggccaaaagagaauacaauauggaccuccgggucaaguaucucuuuuuguggagugaacagcgacacugucggcugguccuggcccgauggugcagaguuaccguucacaauugacaaguga

SEQ ID NO: 140095 - RNA, 1410 nt, Artificial Sequence; identical to SEQ ID NO: 138754
  derived and/or modified sequence opt3 from neuraminidase__InfluenzaA__ADD14156

SEQ ID NO: 140096 - RNA, 1410 nt, Artificial Sequence; identical to SEQ ID NO: 138754
  derived and/or modified sequence opt3 from neuraminidase__InfluenzaA__ADD14158

SEQ ID NO: 140097 - RNA, 1410 nt, Artificial Sequence; identical to SEQ ID NO: 138754
  derived and/or modified sequence opt3 from neuraminidase__InfluenzaA__ADD14164

SEQ ID NO: 140098 - RNA, 1410 nt, Artificial Sequence; identical to SEQ ID NO: 138754
  derived and/or modified sequence opt3 from neuraminidase__InfluenzaA__ADD14174

SEQ ID NO: 140099 - RNA, 1410 nt, Artificial Sequence; identical to SEQ ID NO: 138754
  derived and/or modified sequence opt3 from neuraminidase__InfluenzaA__ADD14184

SEQ ID NO: 140100 - RNA, 1410 nt, Artificial Sequence; identical to SEQ ID NO: 138754
  derived and/or modified sequence opt3 from neuraminidase__InfluenzaA__ADD14194

SEQ ID NO: 140101 - RNA, 1410 nt, Artificial Sequence; identical to SEQ ID NO: 139108
  derived and/or modified sequence opt3 from neuraminidase__InfluenzaA__ADD14204

SEQ ID NO: 140102 - RNA, 1410 nt, Artificial Sequence
  derived and/or modified sequence opt3 from neuraminidase__InfluenzaA__ADD21449
augaaccccaaucagagaaucauuaccauaggcacagccugccugaucauugggaucgugagccuccuucugcaaauuggaaacaucgucuccuuguggauaucucacucaauccagacuggugagaagaaucauagugaaacguguaacaggaauaccauuacauacgagaacagcacuuggguuaaucagaccuaugugaacaucuccaauauuaacaucgcuggcgggcagggaguagcaucuauaauuuuagccggcaauucgucacugugcccugugaacgguugggcgaucuacagcaaagacaauaguauucggaucggguccaagggagauaucuucgucauucgcgaaccauuuauaucuuguagccaccuagagugccgaacauucuuucucacccaaggcgcucugcuuaacgaccgucauuccaauggcacugugaaagauagaucaccguauaggacacugaugaguugucccaucggggaagccccuagcccauacaacucuaaguucgaguccguugcauggucagccagcgcuugccacgacggaauggguugguugaccauuggcaucagugggcccgauaacggagcaguggccguccucaaauauaauggcauaauuacggacacuaucaagucuuggcggaaccgcauccugagaacccaggaguccgaaugugugugcauuaaugguagcuguuuuacaaucaugacugaugggccuucgaacggacaggcuucuuacaagauuuucaaaauggagaggggcaagauaaucaaauccguagaacuggacgccccaaauuaucauuacgaggagugcucauguuaccccgauaccggcaagguugugugcgucugccgggacaacuggcacgcgaguaaucgcccuugggugagcuuugaucagaaccucgacuaucaaauuggguacaucuccucuggaguguucggugauaauccacgaagcaacgacggcaaagggaauuguggaccggucuuaucaaacggcgcaaaugguguuaaggggcugaguuuuagauauggcaacggaguguggaucggcaggacaaaguccaccaauagccggucuggguucgaaaugauuugggaccccaacggauggacggagacugauucaaacuuuaguaugaaacaggacauaaucgcccuuacagauuggagcgguuacuccggcucuuucguacagcacccugaauugaccgggaugaauugcauucguccauguuuuuggguggagcugauccgcggacagcccaagcaaucgacuauuuggacaagcggcuccucaaucaguuucugcggugucgacucugaaaccgcuagcugguccuggccugauggggccgaccuaccauucacgauagauaaauga

SEQ ID NO: 140103 - RNA, 1413 nt, Artificial Sequence
  derived and/or modified sequence opt3 from neuraminidase__InfluenzaA__ADD21469
augaaccccaaucagaagaucauuaccauaggcagcaucuccauugccaucgggauuaucucucugaugcuccaaauaggaaacaucauuucagugugggcuagucacagcauccagacagguucccagaaucauacuggcauuugcaaccagagaaucauaacguacgaaaauucuaccugggucaaccacacauauguuaauauuaacaauacuaacgugguagcagggaaagacaagaccucggugacacuugccggaaauucaagccuguguaguaucuccggcugggcgauuuacaccaaagauaacucuaucaggaucgguagcaagggggacgucuucgugauucgggagccuuuuauauccugcucacauuuggagugucgcacuuucuuuuuaacacaaggagcucugcuaaaugauaaacacaguaacggcaccguuaaggaccgaagcccauaucgugcccucaugucuugcccgcugggcgaagcacccuccccuuacaauucaaaguucgagagcguggccuggagugcuucugcaugucaugaugggaugggauggcuuacgaucgguauuuccggcccagacaacggggccgucgcugugcugaaauauaacggaaucauaacugaaaccauuaagagcuggaaaaagagaauguugaggacacaggagucggagugcaucuguguaaauggcucuugcuuuacuaucaugaccgauggucccuccaacggggccgcgucauacaaaauuuucaagaucgaaaagggaaaaguuacaaagaguauugagcucaaugcaccuaacuuucacuaugaagaguguagcugcuacccagacaccggcacggugaugugugucugccgggauaauuggcacggcuccaaccgccccugggugucuuucaaucagaaccuggacuaccagauaggguauaucugcagcggaguguuuggugauaauccuagaccaaaagacggcgaggggucauguaacccggucacuguugauggagccgacggcgugaaggguuucaguuacaaauaugggaauggcguauggauuggaaggacaaaguccaaccggcugcgcaaaggcuuugaaaugaucugggaccccaauggguggaccgauacugacagcaacuucucugugaagcaagaugucguggcuaucacagacuggucaggauacagugguagcuuuguucagcauccugagcucaccggcuuagauugcauucgaccauguuucuggguggaacuggucagagggcuucccagggagaauacgaccauauggacauccggaucuucgaucagcuucugcggcgugaacuccgacacugccaacuggucauggccugauggugcagaauugccauuuaccauugacaaguga

SEQ ID NO: 140104 - RNA, 1410 nt, Artificial Sequence; identical to SEQ ID NO: 138754
  derived and/or modified sequence opt3 from neuraminidase__InfluenzaA__ADD21747

SEQ ID NO: 140105 - RNA, 1410 nt, Artificial Sequence
  derived and/or modified sequence opt3 from neuraminidase__InfluenzaA__ADD21767
augaaccccaaucagaagaucauuauaaucggcagcgugugcaugaccauugggauggccaaccugauccuccaaauuggaaauaucauauccaucuggauuucucacucaauccagcuugguaaccagaaucagauugagacauguaaccaaagugucaucacuuacgaaaauaacacguggguuaaucagaccuaugugaacauaagcaauacaaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggucccaucucccuacaacucccguuuugaaucaguggccuggagcgcaagugccugccacgacggcaucaauuggcuuacuauugggaucucuggaccugauaacggugcuguagcaguucugaaguauaauggcauaauuacagacaccaucaaguccuggagaaacaauaucuugaggacgcaagagagcgagugugccugcgugaacgggucguguuucacugucaugaccgauggaccaucugacggccaggcuuccuacaaaauuuuucggaucgaaaaggguaaaauugugaagucaguggagaugaaugcccccaacuaucauuacgaagagugcaguuguuacccugauagcuccgagauaacaugcgucugccgcgacaauuggcacgggucuaacagaccauggguuagcuucaaucagaaccucgaauaucagaucggauacauuuguucaggcaucuuuggcgauaauccgaggcccaacgacaaaacugggaguugcggaccuguguccagcaauggugcgaacggcguaaagggguucucuuuuaaguauggaaacggcguguggaucggucggaccaaaucaauuaguagccgcaauggguucgagaugauaugggauccaaacggcuggacaggaaccgacaauaacuuuuccaucaagcaagacauugucggcaucaaugaauggucuggguacucggggagcuucgugcagcaucccgagcugacgggucuggauuguauucgaccuugcuucuggguugaacucaucagaggcaggccaaaagagaacacuauauggacauccgggucaaguaucucuuuuuguggagugaauagcgacaccgucggcugguccuggcccgauggugcagaguuaccguucacuauugacaaguga

SEQ ID NO: 140106 - RNA, 1410 nt, Artificial Sequence
  derived and/or modified sequence opt3 from neuraminidase__InfluenzaA__ADD21777
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguuaucaaguauaauggcauaauuaccgacacgaucaaguccuggagaaacaauauccugaggacucaagagagcgagugugccugcgugaacgggucguguuucaccgucaugacagauggaccaucugacggccaggcuuccuacaaaauuuuucggaucgaaaaggguaaaauugugaagucaguggagaugaaugcccccaacuaucauuacgaagagugcaguuguuacccugauagcuccgagauaacuugcgucugccgcgacaauuggcacgggucuaacagaccauggguuagcuucaaucagaacuuggaauaucagaucggauacauuuguucaggcaucuuuggcgauaauccgaggcccaacgacaaaaccgggaguugcggaccuguguccagcaauggugcgaacggcguaaagggguucucuuuuaaguauggaaacggcguguggaucggucggacaaaaucaauuaguagccgcaauggguucgagaugauaugggauccaaacggcuggaccggaacggacaauaacuuuuccaucaagcaagacauugucggcaucaaugaauggucuggguacucggggagcuucgugcagcaucccgagcucacuggucuggauuguauucgaccuugcuucuggguugaacugaucagaggcaggccaaaagagaacacaauauggaccuccgggucaaguaucucuuuuuguggagugaauagcgacacugucggcugguccuggcccgauggugcagagcucccguucacaauugacaaguga

SEQ ID NO: 140107 - RNA, 1410 nt, Artificial Sequence; identical to SEQ ID NO: 138754
  derived and/or modified sequence opt3 from neuraminidase__InfluenzaA__ADD21787

SEQ ID NO: 140108 - RNA, 1410 nt, Artificial Sequence; identical to SEQ ID NO: 138754
  derived and/or modified sequence opt3 from neuraminidase__InfluenzaA__ADD21797

SEQ ID NO: 140109 - RNA, 1410 nt, Artificial Sequence; identical to SEQ ID NO: 138754
  derived and/or modified sequence opt3 from neuraminidase__InfluenzaA__ADD21817

SEQ ID NO: 140110 - RNA, 1410 nt, Artificial Sequence; identical to SEQ ID NO: 138754
  derived and/or modified sequence opt3 from neuraminidase__InfluenzaA__ADD21827

SEQ ID NO: 140111 - RNA, 1410 nt, Artificial Sequence; identical to SEQ ID NO: 138754
  derived and/or modified sequence opt3 from neuraminidase__InfluenzaA__ADD21837

SEQ ID NO: 140112 - RNA, 1410 nt, Artificial Sequence; identical to SEQ ID NO: 138754
  derived and/or modified sequence opt3 from neuraminidase__InfluenzaA__ADD21847

SEQ ID NO: 140113 - RNA, 1410 nt, Artificial Sequence; identical to SEQ ID NO: 138754
  derived and/or modified sequence opt3 from neuraminidase__InfluenzaA__ADD21857

SEQ ID NO: 140114 - RNA, 1410 nt, Artificial Sequence; identical to SEQ ID NO: 138754
  derived and/or modified sequence opt3 from neuraminidase__InfluenzaA__ADD21867

SEQ ID NO: 140115 - RNA, 1410 nt, Artificial Sequence; identical to SEQ ID NO: 138754
  derived and/or modified sequence opt3 from neuraminidase__InfluenzaA__ADD21877

SEQ ID NO: 140116 - RNA, 1410 nt, Artificial Sequence; identical to SEQ ID NO: 138754
  derived and/or modified sequence opt3 from neuraminidase__InfluenzaA__ADD21897

SEQ ID NO: 140117 - RNA, 1410 nt, Artificial Sequence; identical to SEQ ID NO: 138754
  derived and/or modified sequence opt3 from neuraminidase__InfluenzaA__ADD22494

SEQ ID NO: 140118 - RNA, 1410 nt, Artificial Sequence; identical to SEQ ID NO: 138754
  derived and/or modified sequence opt3 from neuraminidase__InfluenzaA__ADD22504

SEQ ID NO: 140119 - RNA, 1410 nt, Artificial Sequence; identical to SEQ ID NO: 138754
  derived and/or modified sequence opt3 from neuraminidase__InfluenzaA__ADD22514

SEQ ID NO: 140120 - RNA, 1410 nt, Artificial Sequence; identical to SEQ ID NO: 138754
  derived and/or modified sequence opt3 from neuraminidase__InfluenzaA__ADD22524

SEQ ID NO: 140121 - RNA, 1410 nt, Artificial Sequence
  derived and/or modified sequence opt3 from neuraminidase__InfluenzaA__ADD22534
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaguccgaggcccaaugacaaaaccggguccugcggaccugugagcucuaacggugcgaauggcguaaagggguucucauuuaaguauggaaacggcguguggaucggucggacaaaaaguaucagcucccgcaacggguucgagaugauuugggauccaaauggcuggaccggaacggacaacaauuuuucuauaaagcaagacaucgucggcauuaacgaauggucgggguacagcggauccuucgugcagcaucccgagcugacuggucuggauuguauccgaccuugcuucuggguugaacucauuagaggcaggccaaaagagaauacaaucuggaccucagggaguucuauaucguuuuguggagugaacuccgacacugucggcuggucauggcccgauggugcagaguuaccguucacaaucgacaaguga

SEQ ID NO: 140122 - RNA, 1410 nt, Artificial Sequence; identical to SEQ ID NO: 138754
  derived and/or modified sequence opt3 from neuraminidase__InfluenzaA__ADD22544

SEQ ID NO: 140123 - RNA, 1410 nt, Artificial Sequence; identical to SEQ ID NO: 138754
  derived and/or modified sequence opt3 from neuraminidase__InfluenzaA__ADD22557

SEQ ID NO: 140124 - RNA, 1410 nt, Artificial Sequence; identical to SEQ ID NO: 138754
  derived and/or modified sequence opt3 from neuraminidase__InfluenzaA__ADD22567

SEQ ID NO: 140125 - RNA, 1410 nt, Artificial Sequence; identical to SEQ ID NO: 138754
  derived and/or modified sequence opt3 from neuraminidase__InfluenzaA__ADD22577

SEQ ID NO: 140126 - RNA, 1410 nt, Artificial Sequence; identical to SEQ ID NO: 138754
  derived and/or modified sequence opt3 from neuraminidase__InfluenzaA__ADD22587

SEQ ID NO: 140127 - RNA, 1410 nt, Artificial Sequence; identical to SEQ ID NO: 138754
  derived and/or modified sequence opt3 from neuraminidase__InfluenzaA__ADD22597

SEQ ID NO: 140128 - RNA, 1410 nt, Artificial Sequence; identical to SEQ ID NO: 138754
  derived and/or modified sequence opt3 from neuraminidase__InfluenzaA__ADD22617

SEQ ID NO: 140129 - RNA, 1410 nt, Artificial Sequence; identical to SEQ ID NO: 138754
  derived and/or modified sequence opt3 from neuraminidase__InfluenzaA__ADD22627

SEQ ID NO: 140130 - RNA, 1410 nt, Artificial Sequence; identical to SEQ ID NO: 138754
  derived and/or modified sequence opt3 from neuraminidase__InfluenzaA__ADD22637

SEQ ID NO: 140131 - RNA, 1410 nt, Artificial Sequence; identical to SEQ ID NO: 138754
  derived and/or modified sequence opt3 from neuraminidase__InfluenzaA__ADD22648

SEQ ID NO: 140132 - RNA, 1410 nt, Artificial Sequence; identical to SEQ ID NO: 138754
  derived and/or modified sequence opt3 from neuraminidase__InfluenzaA__ADD22658

SEQ ID NO: 140133 - RNA, 1410 nt, Artificial Sequence; identical to SEQ ID NO: 138754
  derived and/or modified sequence opt3 from neuraminidase__InfluenzaA__ADD22668

SEQ ID NO: 140134 - RNA, 1410 nt, Artificial Sequence
  derived and/or modified sequence opt3 from neuraminidase__InfluenzaA__ADD22688
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggauugaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 140135 - RNA, 1410 nt, Artificial Sequence; identical to SEQ ID NO: 138754
  derived and/or modified sequence opt3 from neuraminidase__InfluenzaA__ADD22698

SEQ ID NO: 140136 - RNA, 1410 nt, Artificial Sequence; identical to SEQ ID NO: 138754
  derived and/or modified sequence opt3 from neuraminidase__InfluenzaA__ADD22725

SEQ ID NO: 140137 - RNA, 1410 nt, Artificial Sequence; identical to SEQ ID NO: 138754
  derived and/or modified sequence opt3 from neuraminidase__InfluenzaA__ADD22735

SEQ ID NO: 140138 - RNA, 1410 nt, Artificial Sequence; identical to SEQ ID NO: 138754
  derived and/or modified sequence opt3 from neuraminidase__InfluenzaA__ADD22745

SEQ ID NO: 140139 - RNA, 1410 nt, Artificial Sequence
  derived and/or modified sequence opt3 from neuraminidase__InfluenzaA__ADD22755
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcaccgugagcggaugggcgauauacaguaaggacaacuccauuagaaucggcucuaaaggugauguuuuugugauuagggagccuuucaucagcuguuccccauuagaaugccggacauuuuuccugacccagggggcucuacucaaugacaagcauucaaacggaacuaucaaagaucgcaguccguaucgaacacugaugagcugucccauuggcgaggucccuucuccauacaacucccguuuugaaucaguggccuggagcgcaagugccugccacgacggcauaaauuggcuuaccaucgggauuucuggacccgauaacggugcuguagcaguucugaaguauaauggcaucauaacggacacuauuaaguccuggagaaacaauaucuugaggacccaagagagcgagugugccugcgugaacgggucguguuucacagucaugacugauggaccuucugacggccaggcuuccuacaaaaucuuucggauugaaaaggguaaaaucgugaagucaguggagaugaaugccccaaacuaucauuacgaagagugcaguuguuaccccgauagcuccgagauuaccugcgucugccgcgacaauuggcacgggucuaacagaccuuggguuagcuucaaucagaaccucgaauaucagauaggauacaucuguucaggcauuuuuggcgauaguccaaggccgaaugacaaaacaggguccugcggacccgugagcucuaacggugcgaauggcguaaagggguucucauuuaaguauggaaacggcguguggaucggucggaccaaaaguaucagcucccgcaacggguucgagaugauuugggauccuaauggcuggacgggaacugacaacaauuuuucuauaaagcaagacaucgucggcauuaacgaauggucgggguacagcggauccuucgugcagcauccagagcugacaggucuggauuguauccgacccugcuucuggguugaacucauuagaggcaggccuaaagagaauaccaucuggacuucagggaguucuauaucguuuuguggagugaacuccgacacagucggcuggucauggccagauggugcagaguuacccuucaccaucgacaaguga

SEQ ID NO: 140140 - RNA, 1410 nt, Artificial Sequence
  derived and/or modified sequence opt3 from neuraminidase__InfluenzaA__ADD22765
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugauuggucuggguacucggggagcuucgugcagcaucccgaacugacuggucuggacuguauccgaccuugcuucuggguugagcucauuagaggcaggccaaaagaaaacacaaucuggaccuccgggucaaguauaucuuuuuguggagugaauagcgauacugucggcugguccuggcccgacggugcagaguuaccguucacaaucgauaaguga

SEQ ID NO: 140141 - RNA, 1410 nt, Artificial Sequence; identical to SEQ ID NO: 138754
  derived and/or modified sequence opt3 from neuraminidase__InfluenzaA__ADD22775

SEQ ID NO: 140142 - RNA, 1410 nt, Artificial Sequence; identical to SEQ ID NO: 138754
  derived and/or modified sequence opt3 from neuraminidase__InfluenzaA__ADD22785

SEQ ID NO: 140143 - RNA, 1410 nt, Artificial Sequence; identical to SEQ ID NO: 138754
  derived and/or modified sequence opt3 from neuraminidase__InfluenzaA__ADD22795

SEQ ID NO: 140144 - RNA, 1410 nt, Artificial Sequence; identical to SEQ ID NO: 138754
  derived and/or modified sequence opt3 from neuraminidase__InfluenzaA__ADD22805

SEQ ID NO: 140145 - RNA, 1410 nt, Artificial Sequence; identical to SEQ ID NO: 138754
  derived and/or modified sequence opt3 from neuraminidase__InfluenzaA__ADD22815

SEQ ID NO: 140146 - RNA, 1410 nt, Artificial Sequence; identical to SEQ ID NO: 138754
  derived and/or modified sequence opt3 from neuraminidase__InfluenzaA__ADD22825

SEQ ID NO: 140147 - RNA, 1410 nt, Artificial Sequence; identical to SEQ ID NO: 138754
  derived and/or modified sequence opt3 from neuraminidase__InfluenzaA__ADD22835

SEQ ID NO: 140148 - RNA, 1410 nt, Artificial Sequence; identical to SEQ ID NO: 138754
  derived and/or modified sequence opt3 from neuraminidase__InfluenzaA__ADD22845

SEQ ID NO: 140149 - RNA, 1410 nt, Artificial Sequence; identical to SEQ ID NO: 138754
  derived and/or modified sequence opt3 from neuraminidase__InfluenzaA__ADD22855

SEQ ID NO: 140150 - RNA, 1410 nt, Artificial Sequence; identical to SEQ ID NO: 138754
  derived and/or modified sequence opt3 from neuraminidase__InfluenzaA__ADD22924

SEQ ID NO: 140151 - RNA, 1410 nt, Artificial Sequence; identical to SEQ ID NO: 138754
  derived and/or modified sequence opt3 from neuraminidase__InfluenzaA__ADD22934

SEQ ID NO: 140152 - RNA, 1410 nt, Artificial Sequence; identical to SEQ ID NO: 138754
  derived and/or modified sequence opt3 from neuraminidase__InfluenzaA__ADD22944

SEQ ID NO: 140153 - RNA, 1410 nt, Artificial Sequence; identical to SEQ ID NO: 138754
  derived and/or modified sequence opt3 from neuraminidase__InfluenzaA__ADD22954

SEQ ID NO: 140154 - RNA, 1410 nt, Artificial Sequence; identical to SEQ ID NO: 138754
  derived and/or modified sequence opt3 from neuraminidase__InfluenzaA__ADD22974

SEQ ID NO: 140155 - RNA, 1410 nt, Artificial Sequence; identical to SEQ ID NO: 138754
  derived and/or modified sequence opt3 from neuraminidase__InfluenzaA__ADD23075

SEQ ID NO: 140156 - RNA, 1410 nt, Artificial Sequence
  derived and/or modified sequence opt3 from neuraminidase__InfluenzaA__ADD23085
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggaguuauucaucagcuguuccccacuggaaugccggaccuuuuuccuaacacagggggcucuccugaaugacaagcauucaaacggaaccaucaaagaucgcaguccguaucgaacucuuaugagcugucccauuggcgaggucccuucuccauacaacucccguuuugaaucaguggccuggagcgcaagugccugccacgacggcauaaauuggcugacaaucgggauuucuggacccgauaacggugcuguagcaguuuugaaguauaauggcaucauaaccgacacgauuaaguccuggagaaacaauauccucaggacucaagagagcgagugugccugcgugaacgggucguguuucaccgucaugacagauggaccuucugacggccaggcuuccuacaaaaucuuucggauugaaaaggguaaaaucgugaagucaguggagaugaaugccccaaacuaucauuacgaagagugcaguuguuaccccgauagcuccgagauuacuugcgucugccgcgacaauuggcacgggucuaacagaccuuggguuagcuucaaucagaaccuggaauaucagauaggauacaucuguucaggcauuuuuggcgauaauccaaggccgaacgacaaaaccgggaguugcggacccguguccagcaauggugcgaacggcguaaagggguucucuuuuaaguauggaaacggcguguggaucggucggacaaaaucaaucaguagccgcaauggguucgagaugauuugggauccuaacggcuggaccggaacggacaauaacuuuuccauaaagcaagacaucgucggcauuaaugaauggucuggguacucggggagcuucgugcagcauccagagcugacuggucucgauuguauccgacccugcuucuggguugaauuaauuagaggcaggccuaaagagaacacaaucuggaccuccgggucaaguauaucuuuuuguggagugaauagcgacacugucggcugguccuggccagauggugcagagcugcccuucacaaucgacaaguga

SEQ ID NO: 140157 - RNA, 1410 nt, Artificial Sequence; identical to SEQ ID NO: 138754
  derived and/or modified sequence opt3 from neuraminidase__InfluenzaA__ADD23095

SEQ ID NO: 140158 - RNA, 1410 nt, Artificial Sequence; identical to SEQ ID NO: 138754
  derived and/or modified sequence opt3 from neuraminidase__InfluenzaA__ADD23105

SEQ ID NO: 140159 - RNA, 1410 nt, Artificial Sequence; identical to SEQ ID NO: 138754
  derived and/or modified sequence opt3 from neuraminidase__InfluenzaA__ADD23115

SEQ ID NO: 140160 - RNA, 1410 nt, Artificial Sequence; identical to SEQ ID NO: 138754
  derived and/or modified sequence opt3 from neuraminidase__InfluenzaA__ADD23125

SEQ ID NO: 140161 - RNA, 1410 nt, Artificial Sequence; identical to SEQ ID NO: 138754
  derived and/or modified sequence opt3 from neuraminidase__InfluenzaA__ADD23135

SEQ ID NO: 140162 - RNA, 1410 nt, Artificial Sequence; identical to SEQ ID NO: 138754
  derived and/or modified sequence opt3 from neuraminidase__InfluenzaA__ADD23145

SEQ ID NO: 140163 - RNA, 1410 nt, Artificial Sequence; identical to SEQ ID NO: 138754
  derived and/or modified sequence opt3 from neuraminidase__InfluenzaA__ADD23155

SEQ ID NO: 140164 - RNA, 1410 nt, Artificial Sequence; identical to SEQ ID NO: 138754
  derived and/or modified sequence opt3 from neuraminidase__InfluenzaA__ADD23165

SEQ ID NO: 140165 - RNA, 1410 nt, Artificial Sequence; identical to SEQ ID NO: 138754
  derived and/or modified sequence opt3 from neuraminidase__InfluenzaA__ADD23175

SEQ ID NO: 140166 - RNA, 1410 nt, Artificial Sequence; identical to SEQ ID NO: 138754
  derived and/or modified sequence opt3 from neuraminidase__InfluenzaA__ADD23185

SEQ ID NO: 140167 - RNA, 1410 nt, Artificial Sequence; identical to SEQ ID NO: 138754
  derived and/or modified sequence opt3 from neuraminidase__InfluenzaA__ADD23195

SEQ ID NO: 140168 - RNA, 1410 nt, Artificial Sequence; identical to SEQ ID NO: 138754
  derived and/or modified sequence opt3 from neuraminidase__InfluenzaA__ADD23223

SEQ ID NO: 140169 - RNA, 1410 nt, Artificial Sequence
  derived and/or modified sequence opt3 from neuraminidase__InfluenzaA__ADD23233
augaaccccaaucagaagaucauuaccauaggcagcgugugcaugacaaucgggauggccaaccugauucuccaaaucggaaauauuaucuccauauggaucggucacucuauucagcuuggcaaccagaaucagaucgagacuuguaaccaaucagucauuacguacgaaaauaacaccuggguuaaucagacauaugugaacaucaguaauacuaacuucgcugcagggcagagcguaguguccgucaaacuggccggaaauucuucguugugcccugugucaggcugggcgauauacagcaaggacaacaguauuagaaucgguuccaaaggggauguuuuugugauuagggagccauucaucucuuguagcccguuagaaugccggaccuuuuuccugacacagggagcucuacucaaugacaagcauuccaacggcaccaucaaagaucgcucacccuaucgaacucugaugaguuguccuauuggcgaggucccaagccccuacaacucucguuuugaauccguggccuggucagcaagcgccugccacgacgggauaaauuggcuuacaaucggaauuagugguccugauaacggcgcuguagcaguucugaaguauaaugggaucauaaccgacacgauuaagucuuggagaaacaauaucuugaggacucaagaguccgagugugccugcgugaacggaagcuguuucaccgucaugacagauggcccaucggacggucaggcuucuuacaaaaucuuucggauugaaaaggggaaaaucgugaaguccguggagaugaaugcccccaacuaucauuacgaagagugcucauguuacccugauaguagcgagauuacuugcgucugccgcgacaauuggcacggauccaacagaccauggguuucuuucaaucagaaccucgaauaucagauaggcuacaucuguagcggcauuuuuggggauaauccgaggcccaacgacaaaaccggaucaugcgguccugugaguuccaauggcgcgaacgggguaaagggauucagcuuuaaguauggcaacgguguguggaucgggcggacaaaaucuaucucaagucgcaauggcuucgagaugauuugggauccaaacggauggaccggcacggacaauaacuuuagcauaaagcaagacaucgucgggauuaaugaaugguccggauacucugguucguucgugcagcaucccgagcugacuggccuggauuguauccgaccuugcuucuggguugaacucauuagagggaggccaaaagagaacacaaucuggaccagcggauccucaauaaguuuuuguggcgucaauucugacacuguggguuggagcuggcccgauggggcagaguuaccguucacaaucgacaaguga

SEQ ID NO: 140170 - RNA, 1410 nt, Artificial Sequence; identical to SEQ ID NO: 138754
  derived and/or modified sequence opt3 from neuraminidase__InfluenzaA__ADD23243

SEQ ID NO: 140171 - RNA, 1410 nt, Artificial Sequence; identical to SEQ ID NO: 140042
  derived and/or modified sequence opt3 from neuraminidase__InfluenzaA__ADD23253

SEQ ID NO: 140172 - RNA, 1410 nt, Artificial Sequence
  derived and/or modified sequence opt3 from neuraminidase__InfluenzaA__ADD23273
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucugagggugauguuuuugugauuagggaaccauucaucagcuguuccccguuagagugccggaccuuuuuccugacacagggggcucuacucaaugacaaacauucaaacggaaccaucaaggaucgcagucccuaucgaacucugaugagcuguccuauuggcgaagucccaucucccuacaacucccguuuugagucaguggccuggagcgcaagugccugccacgacggcauaaauuggcuuacaaucgggauuucuggaccugauaacggugcuguagcaguucugaaauauaauggcaucauaaccgacacgauuaaguccuggagaaacaauaucuugaggacucaagagagcgaaugugccugcgugaacgggucguguuucaccgucaugacagauggaccaucugacggccaggcuuccuacaagaucuuucggauugagaaagguaagaucgugaaaucaguggaaaugaaugcccccaacuaucauuacgaggagugcaguuguuacccugauagcuccgaaauuacuugcgucugccgcgacaauuggcacgggucuaacagaccauggguuagcuucaaucagaaccucgaguaucagauaggauacaucuguucaggcauuuuuggcgauaauccgaggcccaacgacaagaccgggaguugcggaccuguguccagcaauggugcgaacggcguaaaaggguucucuuuuaaguauggaaacggcguguggaucggucggacaaagucaaucaguagccgcaauggguucgaaaugauuugggauccaaacggcuggaccggaacggacaauaacuuuuccauaaaacaagacaucgucggcauuaaugaguggucuggguacucggggagcuucgugcagcaucccgaacugacuggucuggauuguauccgaccuugcuucuggguugagcucauuagaggcaggccaaaggagaacacaaucuggaccuccgggucaaguauaucuuuuuguggagugaauagcgacacugucggcugguccuggcccgauggugcagaauuaccguucacaaucgacaaauga

SEQ ID NO: 140173 - RNA, 1410 nt, Artificial Sequence; identical to SEQ ID NO: 138754
  derived and/or modified sequence opt3 from neuraminidase__InfluenzaA__ADD23283

SEQ ID NO: 140174 - RNA, 1410 nt, Artificial Sequence; identical to SEQ ID NO: 138754
  derived and/or modified sequence opt3 from neuraminidase__InfluenzaA__ADD23293

SEQ ID NO: 140175 - RNA, 1410 nt, Artificial Sequence; identical to SEQ ID NO: 138754
  derived and/or modified sequence opt3 from neuraminidase__InfluenzaA__ADD23303

SEQ ID NO: 140176 - RNA, 1410 nt, Artificial Sequence; identical to SEQ ID NO: 138754
  derived and/or modified sequence opt3 from neuraminidase__InfluenzaA__ADD23313

SEQ ID NO: 140177 - RNA, 1410 nt, Artificial Sequence
  derived and/or modified sequence opt3 from neuraminidase__InfluenzaA__ADD23323
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccguccucacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccuggaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucucgauuguauccgaccuugcuucuggguugaauuaauuagaggcaggccaaaagagaacacaaucuggaccuccgggucaaguauaucuuuuuguggagugaauagcgacacugucggcugguccuggcccgauggugcagagcugccguucacaaucgacaaguga

SEQ ID NO: 140178 - RNA, 1410 nt, Artificial Sequence; identical to SEQ ID NO: 138754
  derived and/or modified sequence opt3 from neuraminidase__InfluenzaA__ADD23333

SEQ ID NO: 140179 - RNA, 1410 nt, Artificial Sequence; identical to SEQ ID NO: 138754
  derived and/or modified sequence opt3 from neuraminidase__InfluenzaA__ADD23358

SEQ ID NO: 140180 - RNA, 1410 nt, Artificial Sequence; identical to SEQ ID NO: 140105
  derived and/or modified sequence opt3 from neuraminidase__InfluenzaA__ADD23368

SEQ ID NO: 140181 - RNA, 1410 nt, Artificial Sequence; identical to SEQ ID NO: 138754
  derived and/or modified sequence opt3 from neuraminidase__InfluenzaA__ADD23378

SEQ ID NO: 140182 - RNA, 1410 nt, Artificial Sequence; identical to SEQ ID NO: 138754
  derived and/or modified sequence opt3 from neuraminidase__InfluenzaA__ADD23388

SEQ ID NO: 140183 - RNA, 1410 nt, Artificial Sequence; identical to SEQ ID NO: 139337
  derived and/or modified sequence opt3 from neuraminidase__InfluenzaA__ADD23398

SEQ ID NO: 140184 - RNA, 1410 nt, Artificial Sequence
  derived and/or modified sequence opt3 from neuraminidase__InfluenzaA__ADD23408
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucaggaucucgaauaucagauaggauacaucuguucaggcauuuuuggcgacaacccgaggcccaaugauaaaaccgggaguugcggaccuguguccagcaacggugcgaauggcguaaagggguucucuuuuaaguauggaaacggcguguggaucggucggacaaaaucaaucaguagccgcaacggguucgagaugauuugggacccaaauggcuggaccggaacggacaacaauuuuuccauaaagcaagauaucgucggcauuaacgaauggucuggguacucggggagcuucgugcagcaucccgagcugacuggucuggacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 140185 - RNA, 1410 nt, Artificial Sequence
  derived and/or modified sequence opt3 from neuraminidase__InfluenzaA__ADD23438
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauuccuuuucuauaaagcaagacaucgucggcauuaacgaauggucgggguacagcggauccuucgugcagcaucccgagcugacuggucuggauuguauccgaccuugcuucuggguugaacucauuagaggcaggccaaaagagaauacaaucuggaccucagggaguucuauaucguuuuguggagugaacuccgacacugucggcuggucauggcccgauggugcagaguuaccguucacaaucgacaaguga

SEQ ID NO: 140186 - RNA, 1410 nt, Artificial Sequence; identical to SEQ ID NO: 138754
  derived and/or modified sequence opt3 from neuraminidase__InfluenzaA__ADD23448

SEQ ID NO: 140187 - RNA, 1410 nt, Artificial Sequence; identical to SEQ ID NO: 138754
  derived and/or modified sequence opt3 from neuraminidase__InfluenzaA__ADD23458

SEQ ID NO: 140188 - RNA, 1410 nt, Artificial Sequence
  derived and/or modified sequence opt3 from neuraminidase__InfluenzaA__ADD23468
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcgugaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 140189 - RNA, 1410 nt, Artificial Sequence; identical to SEQ ID NO: 138754
  derived and/or modified sequence opt3 from neuraminidase__InfluenzaA__ADD23478

SEQ ID NO: 140190 - RNA, 1410 nt, Artificial Sequence; identical to SEQ ID NO: 138754
  derived and/or modified sequence opt3 from neuraminidase__InfluenzaA__ADD23488

SEQ ID NO: 140191 - RNA, 1410 nt, Artificial Sequence
  derived and/or modified sequence opt3 from neuraminidase__InfluenzaA__ADD23498
augaaccccaaucagaagaucauuaccauaggcagcgugugcaugacaaucgggauggccaaccugauucuccaaaucggaaauauuaucuccauauggaucucucacucaauucagcuugguaaccagaaucauaucgagacuuguaaccagagugucauuacguacgaaaauaacaccuggguuaaucaaacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcacucaaacggaaccaucaaagaucgcagucccuaucgaacucugaugagcuguccuauuggcgaggucccaucucccuacaacucccguuuugaaucaguggccuggagcgcaagugccugccaugacggcauaaauuggcuuacaaucgggauuucuggaccugauaacggugcuguagcaguucugaaguauaauggcaucauaaccgacacgauuaaguccuggagaaacaauaucuugaggacucaggagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucacuacgaagagugcaguuguuacccugauagcuccgagauuacuugcgucugccgcgacaauuggcaugggucuaacagaccauggguuagcuucaaucaaaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaggacaucgucggcauuaaugaauggucuggguacucggggagcuucgugcaacaccccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 140192 - RNA, 1410 nt, Artificial Sequence; identical to SEQ ID NO: 138754
  derived and/or modified sequence opt3 from neuraminidase__InfluenzaA__ADD23508

SEQ ID NO: 140193 - RNA, 1410 nt, Artificial Sequence; identical to SEQ ID NO: 138754
  derived and/or modified sequence opt3 from neuraminidase__InfluenzaA__ADD23518

SEQ ID NO: 140194 - RNA, 1410 nt, Artificial Sequence; identical to SEQ ID NO: 138754
  derived and/or modified sequence opt3 from neuraminidase__InfluenzaA__ADD23997

SEQ ID NO: 140195 - RNA, 1410 nt, Artificial Sequence; identical to SEQ ID NO: 138754
  derived and/or modified sequence opt3 from neuraminidase__InfluenzaA__ADD24007

SEQ ID NO: 140196 - RNA, 1410 nt, Artificial Sequence; identical to SEQ ID NO: 138754
  derived and/or modified sequence opt3 from neuraminidase__InfluenzaA__ADD24017

SEQ ID NO: 140197 - RNA, 1410 nt, Artificial Sequence; identical to SEQ ID NO: 138754
  derived and/or modified sequence opt3 from neuraminidase__InfluenzaA__ADD24024

SEQ ID NO: 140198 - RNA, 1410 nt, Artificial Sequence; identical to SEQ ID NO: 138754
  derived and/or modified sequence opt3 from neuraminidase__InfluenzaA__ADD24025

SEQ ID NO: 140199 - RNA, 1410 nt, Artificial Sequence; identical to SEQ ID NO: 138754
  derived and/or modified sequence opt3 from neuraminidase__InfluenzaA__ADD24026

SEQ ID NO: 140200 - RNA, 1410 nt, Artificial Sequence; identical to SEQ ID NO: 138754
  derived and/or modified sequence opt3 from neuraminidase__InfluenzaA__ADD24027

SEQ ID NO: 140201 - RNA, 1410 nt, Artificial Sequence; identical to SEQ ID NO: 138754
  derived and/or modified sequence opt3 from neuraminidase__InfluenzaA__ADD24028

SEQ ID NO: 140202 - RNA, 1410 nt, Artificial Sequence; identical to SEQ ID NO: 138754
  derived and/or modified sequence opt3 from neuraminidase__InfluenzaA__ADD24029

SEQ ID NO: 140203 - RNA, 1410 nt, Artificial Sequence; identical to SEQ ID NO: 138754
  derived and/or modified sequence opt3 from neuraminidase__InfluenzaA__ADD24030

SEQ ID NO: 140204 - RNA, 1410 nt, Artificial Sequence; identical to SEQ ID NO: 138754
  derived and/or modified sequence opt3 from neuraminidase__InfluenzaA__ADD24031

SEQ ID NO: 140205 - RNA, 1410 nt, Artificial Sequence; identical to SEQ ID NO: 138754
  derived and/or modified sequence opt3 from neuraminidase__InfluenzaA__ADD24032

SEQ ID NO: 140206 - RNA, 1410 nt, Artificial Sequence; identical to SEQ ID NO: 138754
  derived and/or modified sequence opt3 from neuraminidase__InfluenzaA__ADD25231

SEQ ID NO: 140207 - RNA, 1410 nt, Artificial Sequence; identical to SEQ ID NO: 138754
  derived and/or modified sequence opt3 from neuraminidase__InfluenzaA__ADD25233

SEQ ID NO: 140208 - RNA, 1410 nt, Artificial Sequence; identical to SEQ ID NO: 138754
  derived and/or modified sequence opt3 from neuraminidase__InfluenzaA__ADD25235

SEQ ID NO: 140209 - RNA, 1410 nt, Artificial Sequence; identical to SEQ ID NO: 138754
  derived and/or modified sequence opt3 from neuraminidase__InfluenzaA__ADD25244

SEQ ID NO: 140210 - RNA, 1410 nt, Artificial Sequence
  derived and/or modified sequence opt3 from neuraminidase__InfluenzaA__ADD25246
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcacaaauuggcuuaccauagggaucucuggaccugauaacggugcuguagcaguucugaaguauaauggcauuaucacggacacuauaaaguccuggagaaacaauauuuugaggacccaagagagcgagugugccugcgugaacgggucguguuucacagucaugacugauggaccaucugacggccaggcuuccuacaaaaucuuucggaucgaaaaggguaaaauugugaagucaguggagaugaaugcccccaacuaucauuacgaagagugcaguuguuacccugauagcuccgagauuaccugcgucugccgcgacaauuggcacgggucuaacagaccauggguuagcuucaaucagaaccucgaauaucagaucggauacauauguucaggcaucuuuggcgauaauccgaggcccaacgacaaaacagggaguugcggaccuguguccagcaauggugcgaacggcguaaagggguucucuuuuaaguauggaaacggcguguggauuggucggaccaaaucaaucaguagccgcaauggguucgagaugaucugggauccaaacggcuggacgggaacugacaauaacuuuuccauuaagcaagacauagucggcaucaaugaauggucuggguacucggggagcuucgugcagcaucccgagcugacaggucuggauuguauucgaccuugcuucuggguugaacucaucagaggcaggccaaaagagaacaccauuuggacuuccgggucaaguaucucuuuuuguggagugaauagcgacacagucggcugguccuggcccgauggugcagaguuaccguucaccauagacaaguga

SEQ ID NO: 140211 - RNA, 1410 nt, Artificial Sequence; identical to SEQ ID NO: 138754
  derived and/or modified sequence opt3 from neuraminidase__InfluenzaA__ADD25248

SEQ ID NO: 140212 - RNA, 1410 nt, Artificial Sequence
  derived and/or modified sequence opt3 from neuraminidase__InfluenzaA__ADD25250
augaaccccaaucagaagaucauuaccauaggcagcgugugcaugacaaucgggauggccaaccugauucuccaaaucggaaauauuaucuccauauggaucucuagaucaauucagcuugguaaccagaaucagaucgagacuuguaaccaaaguauuaucacguacgaaaauaacaccugggucaaucagacauauguuaacauaagcaauacuaacuucgcugcaggccaguccgugguaucugugaaacuggccggaaauucgucauugugcccugucagcgggugggcgauuuacaguaaggacaacuccaucaggauuggcucuaaaggugauguguuuguuauccgggagccauucaucagcuguuccccguuagaaugccgcaccuuuuuccugacacagggggcucuacucaaugacaagcacucaaacggaaccauuaaagaucgaagucccuaucguacucugaugagcuguccuauaggcgaggugccaucucccuacaacuccagauuugaaucagucgccuggagcgcaagugccugccaugacggcaucaauuggcuuacaauugggaucucuggaccugauaacggugcuguggcaguacugaaguauaauggcauaauuaccgacacgaucaaguccuggaggaacaauaucuugcggacucaagagagcgagugugccugcguuaacgggucguguuucaccgugaugacagauggaccaucugacggccaggcuuccuacaaaauuuuucgcaucgaaaaggguaaaauugucaagucaguggagaugaaugcccccaacuaucacuacgaagagugcaguuguuacccugauagcggggagauaacuugcgugugcagagacaauuggcauggauccaacaggccaugggucucuuucaaucagaaccucgaauaucagaucggcuacauuuguagcggcaucuuuggggauaauccgcggcccaacgacaaaaccggaucaugcgguccuguuaguuccaauggcgcgaacggggugaagggauucagcuuuaaguauggcaacgguguauggaucgggcgcacaaaaucuauuucaagucgaaauggcuucgagaugauaugggauccaaacggauggaccggcacggacaauaacuuuagcaucaagcaagacauuguggggaucaaugaaugguccggauacucugguucguucguccagcaccccgagcugacuggccuggauuguauuagaccuugcuucuggguggaacucaucagggggcggccaaaagagaacacaauauggaccagcggauccucaaucaguuuuuguggcguuaauucugacacuauggguuggagcuggcccgauggggcagaguuaccguucacaauugacaaguga

SEQ ID NO: 140213 - RNA, 1410 nt, Artificial Sequence; identical to SEQ ID NO: 138754
  derived and/or modified sequence opt3 from neuraminidase__InfluenzaA__ADD25255

SEQ ID NO: 140214 - RNA, 1410 nt, Artificial Sequence; identical to SEQ ID NO: 138754
  derived and/or modified sequence opt3 from neuraminidase__InfluenzaA__ADD25259

SEQ ID NO: 140215 - RNA, 1410 nt, Artificial Sequence
  derived and/or modified sequence opt3 from neuraminidase__InfluenzaA__ADD25262
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaaggggaguugcggaccuguguccagcaauggugcggauggcguaaagggguucucuuuuaaauauggaaacggcguguggaucggucggaccaagucaaucaguagccgcaacggguucgagaugauuugggacccaaauggcuggacaggaaccgacaacaauuuuuccauaaaacaagauaucgucggcauuaacgaauggucuggguacucggggagcuucgugcagcaucccgagcugacgggucuggacuguauccgaccuugcuucuggguugaacucauuagaggcaggccaaaggagaauacuaucuggacauccgggucaaguauaucuuuuuguggagugaacagcgauaccgucggcugguccuggcccgacggugcagaguuaccguucacuaucgauaaauga

SEQ ID NO: 140216 - RNA, 1410 nt, Artificial Sequence
  derived and/or modified sequence opt3 from neuraminidase__InfluenzaA__ADD25266
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugccugucaaacuggccggaaauucuucguugugcccagugucagggugggcgauauacagcaaggacaacaguauuagaaucggcuccaaaggugauguuuuugugauuagggagccguucaucucuuguagccccuuagaaugccggaccuuuuuccugacacagggggcucuacucaaugacaagcauuccaacggaaccaucaaagaucgcucaccuuaucgaacucugaugaguuguccaauuggcgagguccccagcccuuacaacucucguuuugaauccguggccuggucagcaagcgccugccacgacggcauaaauuggcuuacaaucgggauuaguggaccagauaacggugcuguagcaguucugaaguauaauggcaucauaaccgacacgauuaagucuuggagaaacaauaucuugaggacucaagaguccgagugugccugcgugaacgggagcuguuucaccgucaugacagauggacccucggacggccaggcuucuuacaaaaucuuucggauugaaaaggguaaaaucgugaaguccguggagaugaaugccccuaacuaucauuacgaagagugcucauguuacccagauaguagcgagauuacuugcgucugccgcgacaauuggcacggguccaacagaccguggguuucuuucaaucagaaccucgaauaucagauaggauacaucuguagcggcauuuuuggcgauaaucccaggccuaacgacaaaaccgggucaugcggaccagugaguuccaauggugcgaacggcguaaagggguucagcuuuaaguauggaaacggcguguggaucggucggacaaaaucuaucucaagucgcaauggguucgagaugauuugggaucccaacggcuggaccggaacggacaauaacuuuagcauaaagcaagacaucgucggcauuaaugaaugguccggguacucuggaucguucgugcagcauccugagcugacuggucuggauuguauccgaccaugcuucuggguugaacucauuagaggcaggcccaaagagaacacaaucuggaccagcggguccucaauaaguuuuuguggagucaauucugacacugugggcuggagcuggccggauggugcagaguuaccuuucacaaucgacaaguga

SEQ ID NO: 140217 - RNA, 1410 nt, Artificial Sequence; identical to SEQ ID NO: 138754
  derived and/or modified sequence opt3 from neuraminidase__InfluenzaA__ADD25268

SEQ ID NO: 140218 - RNA, 1410 nt, Artificial Sequence; identical to SEQ ID NO: 138754
  derived and/or modified sequence opt3 from neuraminidase__InfluenzaA__ADD25271

SEQ ID NO: 140219 - RNA, 1410 nt, Artificial Sequence; identical to SEQ ID NO: 138754
  derived and/or modified sequence opt3 from neuraminidase__InfluenzaA__ADD25274

SEQ ID NO: 140220 - RNA, 1410 nt, Artificial Sequence; identical to SEQ ID NO: 138754
  derived and/or modified sequence opt3 from neuraminidase__InfluenzaA__ADD25276

SEQ ID NO: 140221 - RNA, 1410 nt, Artificial Sequence
  derived and/or modified sequence opt3 from neuraminidase__InfluenzaA__ADD25278
augaaccccaaucagaagaucauuaccauaggcagcgugugcaugacaaucgggauggccaaccugauucuccaaaucggaaauauuaucuccauauggaucucuagaucaauucagcuugguaaccagaaucagaucgagacuuguaaccaaaguauuaucacguacgaaaauaacaccugggucaaucagacauauguuaacauaagcaauacuaacuucgcugcaggccaguccgugguaucugugaaacuggccggaaauucgucauugugcccugucagcgggugggcgauuuacaguaaggacaacuccaucaggauuggcucuaaaggugauguguuuguuauccgggagccauucaucagcuguuccccguuagaaugccgcaccuuuuuccugacacagggggcucuacucaaugacaagcacucaaacggaaccauuaaagaucgaagucccuaucguacucugaugagcuguccuauaggcgaggugccaucucccuacaacuccagauuugaaucagucgccuggagcgcaagugccugccaugacggcaucaauuggcuuacaauugggaucucuggaccugauaacggugcuguggcaguacugaaguauaauggcauaauuaccgacacgaucaaguccuggaggaacaauaucuugcggacucaagagagcgagugugccugcguuaacgggucguguuucaccgugaugacagauggaccaucugacggccaggcuuccuacaaaauuuuucgcaucgaaaaggguaaaauugucaagucaguggagaugaaugcccccaacuaucacuacgaagagugcaguuguuacccugauagcggggagauaacuugcgugugcagagacaauuggcauggauccaacaggccaugggucucuuucaaucagaaccucgaauaucagaucggcuacauuuguagcggcaucuuuggggauaauccgcggcccaacgacaaaaccggaucaugcgguccuguuaguuccaauggcgcgaacggggugaagggauucagcuuuaaguauggcaacgguguauggaucgggcgcacaaaaucuauuucaagucgaaauggcuucgagaugauaugggauccaaacggauggaccggcacggacaauaacuuuagcaucaagcaagacauuguggggaucaaugaaugguccggauacucugguucguucguccagcaccccgagcugacuggccuggauuguauuagaccuugcuucuggguggaacucaucagggggcggccaaaagagaacacaauauggaccagcggauccucaaucaguuuuuguggcguuaauucugacacuguggguuggagcuggcccgauggggcagaguuaccguucacaauugacaaguga

SEQ ID NO: 140222 - RNA, 1410 nt, Artificial Sequence; identical to SEQ ID NO: 138754
  derived and/or modified sequence opt3 from neuraminidase__InfluenzaA__ADD25280

SEQ ID NO: 140223 - RNA, 1410 nt, Artificial Sequence; identical to SEQ ID NO: 138754
  derived and/or modified sequence opt3 from neuraminidase__InfluenzaA__ADD25282

SEQ ID NO: 140224 - RNA, 1410 nt, Artificial Sequence; identical to SEQ ID NO: 140042
  derived and/or modified sequence opt3 from neuraminidase__InfluenzaA__ADD25284

SEQ ID NO: 140225 - RNA, 1410 nt, Artificial Sequence; identical to SEQ ID NO: 138754
  derived and/or modified sequence opt3 from neuraminidase__InfluenzaA__ADD25287

SEQ ID NO: 140226 - RNA, 1410 nt, Artificial Sequence; identical to SEQ ID NO: 138754
  derived and/or modified sequence opt3 from neuraminidase__InfluenzaA__ADD25291

SEQ ID NO: 140227 - RNA, 1410 nt, Artificial Sequence; identical to SEQ ID NO: 140042
  derived and/or modified sequence opt3 from neuraminidase__InfluenzaA__ADD25293

SEQ ID NO: 140228 - RNA, 1410 nt, Artificial Sequence; identical to SEQ ID NO: 138754
  derived and/or modified sequence opt3 from neuraminidase__InfluenzaA__ADD25300

SEQ ID NO: 140229 - RNA, 1410 nt, Artificial Sequence
  derived and/or modified sequence opt3 from neuraminidase__InfluenzaA__ADD25304
augaaccccaaucagaagaucauuaccauaggcagcgugugcaugacaaucgggauggccaaccugauucuccaaaucggaaauauugucuccaucuggauaucucacucaauccagcuugguaaccagaaucagauugagacuuguaaccaaaguguuaucacguacgaaaauaacaccugggugaaucagacauauguaaacauuagcaauacuaacuucgcugcaggccaguccguggucucugugaaacuggccggaaauucgucauugugcccuguuagcggaugggcgaucuacaguaaggacaacuccauaagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 140230 - RNA, 1410 nt, Artificial Sequence
  derived and/or modified sequence opt3 from neuraminidase__InfluenzaA__ADD25306
augaaccccaaucagaagaucauuaccauaggcagcgugugcaugacaaucgggauggccaaccugauucuccaaaucggaaauauuaucuccauauggaucucuagaucaauucagcuugguaaccagaaucagaucgagacuuguaaccaaaguauuaucacguacgaaaauaacaccugggucaaucagacauauguuaacauaagcaauacuaacuucgcugcaggccaguccgugguaucugugaaacuggccggaaauucgucauugugcccugucagcgggugggcgauuuacaguaaggacaacuccaucaggauuggcucuaaaggugauguguuuguuauccgggagccauucaucagcuguuccccguuagaaugccgcaccuuuuuccugacacagggggcucuacucaaugacaagcacucaaacggaaccauuaaagaucgaagucccuaucguacucugaugagcuguccuauaggcgaggugccaucucccuacaacuccagauuugaaucagucgccuggagcgcaagugccugccaugacggcaucaauuggcuuacaauugggaucucuggaccugauaacggugcuguggcaguacugaaguauaauggcauaauuaccgacacgaucaaguccuggaggaacaauaucuugcggacucaagagagcgagugugccugcguuaacgggucguguuucaccgugaugacagaugaaccaucugacggacaggcuuccuacaaaauuuuucgcaucgagaagggcaaaauugucaagucaguggaaaugaaugcccccaacuaucacuacgaggagugcaguuguuacccugauagcggugaaauaacuugcgugugcagagacaauuggcauggguccaacaggccaugggucucuuucaaucagaaccucgaguaucagaucggauacauuuguagcggcaucuuuggcgauaauccgcggcccaacgacaaaaccgggucaugcggaccuguuaguuccaauggugcgaacggcgugaagggguucagcuuuaaguauggaaacggcguauggaucggucgcacaaaaucuauuucaagucgaaauggguucgaaaugauaugggauccaaacggcuggaccggaacggacaauaacuuuagcaucaagcaagacauugugggcaucaaugagugguccggguacucuggaucguucguccagcaccccgaacugacuggucuggauuguauuagaccuugcuucuggguggagcucaucaggggccggccaaaagagaacacaauauggaccagcggguccucaaucaguuuuuguggaguuaauucugacacugugggcuggagcuggcccgauggugcagaauuaccguucacaauugacaaguga

SEQ ID NO: 140231 - RNA, 1410 nt, Artificial Sequence; identical to SEQ ID NO: 138754
  derived and/or modified sequence opt3 from neuraminidase__InfluenzaA__ADD25308

SEQ ID NO: 140232 - RNA, 1410 nt, Artificial Sequence; identical to SEQ ID NO: 138754
  derived and/or modified sequence opt3 from neuraminidase__InfluenzaA__ADD25310

SEQ ID NO: 140233 - RNA, 1410 nt, Artificial Sequence; identical to SEQ ID NO: 138754
  derived and/or modified sequence opt3 from neuraminidase__InfluenzaA__ADD25312

SEQ ID NO: 140234 - RNA, 1410 nt, Artificial Sequence; identical to SEQ ID NO: 138754
  derived and/or modified sequence opt3 from neuraminidase__InfluenzaA__ADD25314

SEQ ID NO: 140235 - RNA, 1410 nt, Artificial Sequence; identical to SEQ ID NO: 138754
  derived and/or modified sequence opt3 from neuraminidase__InfluenzaA__ADD25316

SEQ ID NO: 140236 - RNA, 1410 nt, Artificial Sequence; identical to SEQ ID NO: 138754
  derived and/or modified sequence opt3 from neuraminidase__InfluenzaA__ADD29799

SEQ ID NO: 140237 - RNA, 1410 nt, Artificial Sequence; identical to SEQ ID NO: 138754
  derived and/or modified sequence opt3 from neuraminidase__InfluenzaA__ADD29800

SEQ ID NO: 140238 - RNA, 1410 nt, Artificial Sequence; identical to SEQ ID NO: 138754
  derived and/or modified sequence opt3 from neuraminidase__InfluenzaA__ADD29801

SEQ ID NO: 140239 - RNA, 1410 nt, Artificial Sequence; identical to SEQ ID NO: 138754
  derived and/or modified sequence opt3 from neuraminidase__InfluenzaA__ADD29802

SEQ ID NO: 140240 - RNA, 1410 nt, Artificial Sequence; identical to SEQ ID NO: 138754
  derived and/or modified sequence opt3 from neuraminidase__InfluenzaA__ADD29803

SEQ ID NO: 140241 - RNA, 1410 nt, Artificial Sequence; identical to SEQ ID NO: 138754
  derived and/or modified sequence opt3 from neuraminidase__InfluenzaA__ADD29804

SEQ ID NO: 140242 - RNA, 1410 nt, Artificial Sequence; identical to SEQ ID NO: 138754
  derived and/or modified sequence opt3 from neuraminidase__InfluenzaA__ADD29805

SEQ ID NO: 140243 - RNA, 1410 nt, Artificial Sequence; identical to SEQ ID NO: 138754
  derived and/or modified sequence opt3 from neuraminidase__InfluenzaA__ADD29806

SEQ ID NO: 140244 - RNA, 1410 nt, Artificial Sequence; identical to SEQ ID NO: 138754
  derived and/or modified sequence opt3 from neuraminidase__InfluenzaA__ADD29807

SEQ ID NO: 140245 - RNA, 1410 nt, Artificial Sequence; identical to SEQ ID NO: 138754
  derived and/or modified sequence opt3 from neuraminidase__InfluenzaA__ADD29808

SEQ ID NO: 140246 - RNA, 1410 nt, Artificial Sequence; identical to SEQ ID NO: 138754
  derived and/or modified sequence opt3 from neuraminidase__InfluenzaA__ADD52538

SEQ ID NO: 140247 - RNA, 1410 nt, Artificial Sequence; identical to SEQ ID NO: 139977
  derived and/or modified sequence opt3 from neuraminidase__InfluenzaA__ADD74353

SEQ ID NO: 140248 - RNA, 1410 nt, Artificial Sequence; identical to SEQ ID NO: 138754
  derived and/or modified sequence opt3 from neuraminidase__InfluenzaA__ADD74373

SEQ ID NO: 140249 - RNA, 1410 nt, Artificial Sequence; identical to SEQ ID NO: 138754
  derived and/or modified sequence opt3 from neuraminidase__InfluenzaA__ADD74383

SEQ ID NO: 140250 - RNA, 1410 nt, Artificial Sequence; identical to SEQ ID NO: 138754
  derived and/or modified sequence opt3 from neuraminidase__InfluenzaA__ADD74401

SEQ ID NO: 140251 - RNA, 1410 nt, Artificial Sequence
  derived and/or modified sequence opt3 from neuraminidase__InfluenzaA__ADD74411
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacguagcugcaggccaguccguggucucugugaaacuggccggaaauucgucauugugcccuguuagcgggugggcgauauacaguaaggacaacuccauuagaaucggcucuaaaggugauguguucgucauuagggagccauuuaucagcuguuccccguuagaaugccggaccuucuuucugacacagggggcucuacucaaugacaagcauucaaacggaaccaucaaagaucgcagucccuaucgaacucugaugagcuguccuauuggcgaggugccaucucccuacaacucccguuucgaaucaguagccuggagcgcaagugccugccacgacggcauaaauuggcuuacaaucgggauuucuggaccugauaacggugcuguugcagugcugaaguauaauggcaucauaaccgacacgauuaaguccuggagaaacaauaucuugaggacucaagagagcgagugugccugcgucaacgggucguguuuuaccgugaugacagauggaccaucugacggccaggcuuccuacaaaaucuuccggauugaaaaggguaaaaucgugaagucagucgagaugaaugcccccaacuaucauuacgaagagugcaguuguuacccugauagcuccgagauuacuugcguuugccgcgacaauuggcacgggucuaacagaccaugggugagcuuuaaucagaaccucgaauaucagauaggauacaucuguucaggcauuuucggcgauaauccgaggcccaacgacaaaaccgggaguugcggaccuguauccagcaauggugcgaacggcgugaagggguuuucuuucaaguauggaucaggcgucuggaucggucggacaaaaaguaucagcucccgcucuggguuugagaugauuugggauccaaacggcuggaccggaacggacaauaacuucucgauaaagcaagacaucgugggcauuaaugaauggagcggguacuccggaucauuuguucagcaucccgagcugacuggucuggauuguauccgaccuugcuucuggguggaacucauuagaggcaggccaaaagagaacacaaucuggaccagugggucuagcauauccuucuguggagucaauucagacacugugggcuggagcuggcccgauggugcagaguuaccguuuacaaucgacaaguga

SEQ ID NO: 140252 - RNA, 1410 nt, Artificial Sequence; identical to SEQ ID NO: 138754
  derived and/or modified sequence opt3 from neuraminidase__InfluenzaA__ADD74421

SEQ ID NO: 140253 - RNA, 1410 nt, Artificial Sequence; identical to SEQ ID NO: 138754
  derived and/or modified sequence opt3 from neuraminidase__InfluenzaA__ADD74431

SEQ ID NO: 140254 - RNA, 1410 nt, Artificial Sequence
  derived and/or modified sequence opt3 from neuraminidase__InfluenzaA__ADD74441
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauauauuuuccaucaagcaagacauugucggcaucaacgaauggucuggguacucggggagcuucgugcagcaucccgagcugacuggucuggauuguauucgaccuugcuucuggguugaacucaucagaggcaggccaaaagagaauacaauauggaccuccgggucaaguaucucuuuuuguggagugaacagcgacacugucggcugguccuggcccgauggugcagaguuaccguucacaauugacaaguga

SEQ ID NO: 140255 - RNA, 1410 nt, Artificial Sequence; identical to SEQ ID NO: 138754
  derived and/or modified sequence opt3 from neuraminidase__InfluenzaA__ADD74451

SEQ ID NO: 140256 - RNA, 1410 nt, Artificial Sequence; identical to SEQ ID NO: 138754
  derived and/or modified sequence opt3 from neuraminidase__InfluenzaA__ADD74461

SEQ ID NO: 140257 - RNA, 1410 nt, Artificial Sequence; identical to SEQ ID NO: 138754
  derived and/or modified sequence opt3 from neuraminidase__InfluenzaA__ADD74471

SEQ ID NO: 140258 - RNA, 1410 nt, Artificial Sequence; identical to SEQ ID NO: 138754
  derived and/or modified sequence opt3 from neuraminidase__InfluenzaA__ADD74481

SEQ ID NO: 140259 - RNA, 1410 nt, Artificial Sequence; identical to SEQ ID NO: 139771
  derived and/or modified sequence opt3 from neuraminidase__InfluenzaA__ADD74491

SEQ ID NO: 140260 - RNA, 1410 nt, Artificial Sequence; identical to SEQ ID NO: 138754
  derived and/or modified sequence opt3 from neuraminidase__InfluenzaA__ADD74501

SEQ ID NO: 140261 - RNA, 1410 nt, Artificial Sequence; identical to SEQ ID NO: 138754
  derived and/or modified sequence opt3 from neuraminidase__InfluenzaA__ADD74511

SEQ ID NO: 140262 - RNA, 1410 nt, Artificial Sequence; identical to SEQ ID NO: 139772
  derived and/or modified sequence opt3 from neuraminidase__InfluenzaA__ADD74521

SEQ ID NO: 140263 - RNA, 1410 nt, Artificial Sequence; identical to SEQ ID NO: 138754
  derived and/or modified sequence opt3 from neuraminidase__InfluenzaA__ADD74531

SEQ ID NO: 140264 - RNA, 1410 nt, Artificial Sequence
  derived and/or modified sequence opt3 from neuraminidase__InfluenzaA__ADD74551
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauuauggugcuguugcagugcugaaguacaacggcauuaucaccgacacgauaaaguccuggagaaauaacauuuugaggacucaagagagcgagugugccugcgucaaugggucguguuucaccgugaugacagauggaccaucugacggccaggcuuccuauaaaaucuuucggaucgaaaaggguaaaauugugaagucagucgagaugaacgcccccaauuaccauuacgaagagugcaguuguuauccugauagcuccgagaucacuugcguuugccgcgacaacuggcacgggucuaauagaccaugggugagcuucaaccagaaucucgaauaccagauuggauauauauguucaggcaucuuuggcgauaacccgaggcccaaugacaaaaccgggaguugcggaccuguauccagcaacggugcgaauggcgugaagggguucucuuuuaaguacggaaacggcgucuggauuggucggacaaaaucaaucaguagccgcaacggguucgagaugaucugggauccaaauggcuggaccggaacggacaacaauuuuuccauuaagcaagacauagugggcaucaacgaauggucuggguauucggggagcuucguucagcaucccgagcugacuggucuggauuguauucgaccuugcuucuggguggaacucaucagaggcaggccaaaagagaauacaauuuggaccuccgggucaaguaucucuuuuuguggagucaacagcgacacugugggcugguccuggcccgauggugcagaguuaccguucacaauagacaaguga

SEQ ID NO: 140265 - RNA, 1410 nt, Artificial Sequence; identical to SEQ ID NO: 138754
  derived and/or modified sequence opt3 from neuraminidase__InfluenzaA__ADD74561

SEQ ID NO: 140266 - RNA, 1410 nt, Artificial Sequence; identical to SEQ ID NO: 138754
  derived and/or modified sequence opt3 from neuraminidase__InfluenzaA__ADD74571

SEQ ID NO: 140267 - RNA, 1410 nt, Artificial Sequence
  derived and/or modified sequence opt3 from neuraminidase__InfluenzaA__ADD74581
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacgcagucggcugguccuggcccgauggugccgaguuaccguucacuaucgacaaguga

SEQ ID NO: 140268 - RNA, 1410 nt, Artificial Sequence; identical to SEQ ID NO: 138754
  derived and/or modified sequence opt3 from neuraminidase__InfluenzaA__ADD74591

SEQ ID NO: 140269 - RNA, 1410 nt, Artificial Sequence; identical to SEQ ID NO: 138754
  derived and/or modified sequence opt3 from neuraminidase__InfluenzaA__ADD74601

SEQ ID NO: 140270 - RNA, 1410 nt, Artificial Sequence
  derived and/or modified sequence opt3 from neuraminidase__InfluenzaA__ADD74611
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcaucaagggguucucuuuuaaguauggaaacggcguauggaucggucggacaaaaucaauuaguagccgcaauggguucgagaugauaugggauccaaacggcuggaccggaacggacaauaacuuuuccaucaagcaagacauugugggcaucaaugaauggucuggguacucggggagcuucguccagcaucccgagcugacuggucuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 140271 - RNA, 1410 nt, Artificial Sequence; identical to SEQ ID NO: 138754
  derived and/or modified sequence opt3 from neuraminidase__InfluenzaA__ADD74621

SEQ ID NO: 140272 - RNA, 1410 nt, Artificial Sequence; identical to SEQ ID NO: 138754
  derived and/or modified sequence opt3 from neuraminidase__InfluenzaA__ADD74631

SEQ ID NO: 140273 - RNA, 1410 nt, Artificial Sequence; identical to SEQ ID NO: 138754
  derived and/or modified sequence opt3 from neuraminidase__InfluenzaA__ADD74641

SEQ ID NO: 140274 - RNA, 1410 nt, Artificial Sequence; identical to SEQ ID NO: 138754
  derived and/or modified sequence opt3 from neuraminidase__InfluenzaA__ADD74651

SEQ ID NO: 140275 - RNA, 1410 nt, Artificial Sequence; identical to SEQ ID NO: 140105
  derived and/or modified sequence opt3 from neuraminidase__InfluenzaA__ADD74661

SEQ ID NO: 140276 - RNA, 1410 nt, Artificial Sequence; identical to SEQ ID NO: 138754
  derived and/or modified sequence opt3 from neuraminidase__InfluenzaA__ADD74671

SEQ ID NO: 140277 - RNA, 1410 nt, Artificial Sequence; identical to SEQ ID NO: 138754
  derived and/or modified sequence opt3 from neuraminidase__InfluenzaA__ADD74681

SEQ ID NO: 140278 - RNA, 1410 nt, Artificial Sequence
  derived and/or modified sequence opt3 from neuraminidase__InfluenzaA__ADD74691
augaaccccaaucagaagaucauuaccauaggcagcgugugcaugacaaucgggauggccaaccugauucuccaaaucggaaauauuaucuccauauggaucugucacucuauucagcuugguaaccagaaucagaucgagacuugcaaccaaucagucauuacguacgaaaauaacaccuggguuaaucagacauaugugaacaucaguaauacuaacuucgcugcaggccagagcguaguguccgucaaacuggccggaaauucuucguuguguccugugucagggugggcgauauacagcaaggacaacaguauuagaaucggcuccaaaggugauguuuuugugauuagggagccauucaucucuugcagcccguuagaaugucggaccuuuuuccugacacagggggcucuacucaaugacaagcauuccaacggaaccaucaaagaucgcucacccuaucgaacucugaugaguugcccuauuggcgaggucccaagccccuacaacucucguuuugaauccguggccuggucagcaagcgccugucacgacggcauaaauuggcuuacaaucgggauuaguggaccugauaacggugcuguagcaguucugaaguauaauggcaucauaaccgacacgauuaagucuuggagaaacaauaucuugaggacucaagaguccgagugcgccugugugaacgggagcugcuucaccgucaugacagauggaccaucggacggccaggcuucuuacaaaaucuuucggauugaaaaggguaaaaucgugaaguccguggagaugaaugcccccaacuaucauuacgaagaguguucaugcuacccugauaguagcgagauuacuugcgucugucgcgacaauuggcacggguccaacagaccauggguuucuuucaaucagaaccucgaauaucagauaggauacaucugcagcggcauuuuuggcgauaauccgaggcccaacgacaaaaccgggucauguggaccugugaguuccaauggugcgaacggcguaaagggguucagcuuuaaguauggaaacggcguguggaucggucggacaaaaucuaucucaagucgcaauggguucgagaugauuugggauccaaacggcuggaccggaacggacaauaacuuuagcauaaagcaagacaucgucggcauuaaugaaugguccggguacucuggaucguucgugcagcaucccgagcugacuggucuggauugcauccgaccuuguuucuggguugaacucauuagaggcaggccaaaagagaacacaaucuggaccagcggguccucaauaaguuuuugcggagucaauucugacacugugggcuggagcuggcccgauggugcagaguuaccguucacaaucgacaaguga

SEQ ID NO: 140279 - RNA, 1410 nt, Artificial Sequence; identical to SEQ ID NO: 138754
  derived and/or modified sequence opt3 from neuraminidase__InfluenzaA__ADD74701

SEQ ID NO: 140280 - RNA, 1410 nt, Artificial Sequence; identical to SEQ ID NO: 138754
  derived and/or modified sequence opt3 from neuraminidase__InfluenzaA__ADD74711

SEQ ID NO: 140281 - RNA, 1410 nt, Artificial Sequence; identical to SEQ ID NO: 138754
  derived and/or modified sequence opt3 from neuraminidase__InfluenzaA__ADD74721

SEQ ID NO: 140282 - RNA, 1410 nt, Artificial Sequence; identical to SEQ ID NO: 138754
  derived and/or modified sequence opt3 from neuraminidase__InfluenzaA__ADD74731

SEQ ID NO: 140283 - RNA, 1410 nt, Artificial Sequence
  derived and/or modified sequence opt3 from neuraminidase__InfluenzaA__ADD74741
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccgggucgagcucauugugcccugugaguggaugggcgauuuacuccaaggacaauucuaucagaauuggcagcaaaggugauguuuuugugaucagggagccauucaucuccuguucaccguuagaaugccggaccuuuuuccugacacagggggcucuacucaacgacaagcauaguaauggaaccauuaaagaucgcagccccuaucgaacucugaugucuuguccuauaggcgaggucccaucccccuacaacucacguuuugaaagcguggccuggagugcaucugccugccacgacggcaucaacuggcuuacaauugggaucuccggaccugauaauggugcuguagcaguucugaaguauaacggcauaauuaccgacacgaucaagagcuggagaaauaacaucuugaggacucaagagucggagugugccugcgugaaugggucuuguuucaccgucaugacagauggaccauccgacggccaggcuucauacaaaauuuuucggaucgaaaaggguaaaauugugaagaguguggagaugaacgcccccaauuaucauuacgaagagugcagcuguuacccugauuccucugagauaacuugcgucugccgcgacaacuggcacgggagcaauagaccauggguuucauucaaccagaaucucgaauaucagaucggauacauuuguaguggcaucuuuggcgauaacccgaggcccaaugacaaaaagggguccugcggaccugugagcucuaacggugcgaauggcguaaagggguucucauuuaaauauggaaacggcguguggaucggucggaccaagaguauuagcucccgcaacggguucgagaugauaugggauccaaauggcuggacaggaaccgacaacaauuuuucuaucaaacaagacauugucggcaucaacgaauggucgggguacagcggauccuucgugcagcaucccgagcugacgggucuggauuguauucgaccuugcuucuggguugaacucaucagaggcaggccaaaggagaauacuauauggacaucagggaguucuaucagcuuuuguggagugaacuccgacaccgucggcuggucauggcccgauggugcagaguuaccguucacuauugacaaauga

SEQ ID NO: 140284 - RNA, 1410 nt, Artificial Sequence
  derived and/or modified sequence opt3 from neuraminidase__InfluenzaA__ADD74751
augaaccccaaucagaagaucauuaccauaggcagcgugugcaugacaaucgggauggccaaccugauucuccaaaucggaaauauuaucuccauauggaucucucacucaauucagcuugguaacaaaaaucagaucgagacuuguaaccagagugucauuacguacgaaaauaacaccuggguuaaucaaacauaugugaacaucagcaauacuaacuucgcugcaggccaguccguagugucugucaagcuggccggaaauucgucauugugcccugugagcggaugggcgauauacaguaaagacaacuccauuagaaucggcucuaagggugauguuuuugugauuagggagccauucaucagcuguuccccguuagaaugccggaccuuuuuccugacacagggggcucuacucaaugacaaacauucaaacggaaccaucaaggaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaauccuggagaaacaauaucuugaggacucaggagagcgagugugccugcgugaacgggucguguuucaccgucaugacagauggaccaucugacggccaggcuuccuacaagaucuuucggauugaaaaagguaagaucgugaaaucaguggagaugaaugcccccaacuaucauuacgaagagugcaguuguuacccugauagcuccgagauuacuugcgucugccgcgacaauuggcacgggucuaacagaccauggguuagcuucaaucaaaaccucaaguaucagauaggauacaucuguucaggcauuuuuggcgauaauccgaggcccaacgacaagaaagggaguugcggaccuguguccagcaauggugcgaacggcguaaagggguucucuuuuaaauauggaaacggcguguggaucggucggaccaagucaaucaguagccgcaauggguucgaaaugauuugggauccaaacggcuggacaggaaccgacaauaacuuuuccauaaaacaggacaucgucggcaugaaugaguggucuggguacucggggagcuucgugcaacaucccgaacugacgggucuggauuguauucgaccuugcuucuggguugagcucaucagaggcaggccaaaggaaaacacuauuuggacauccgggucaaguaucucuuuuuguggagugaauagcgacaccgucggcugguccuggcccgauggugcagaguuaccguucacuauagacaaauga

SEQ ID NO: 140285 - RNA, 1410 nt, Artificial Sequence
  derived and/or modified sequence opt3 from neuraminidase__InfluenzaA__ADD74761
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggaaucaauagcgacacugugggcugguccuggcccgauggugcagaguuaccguucacaauugacaaguga

SEQ ID NO: 140286 - RNA, 1410 nt, Artificial Sequence; identical to SEQ ID NO: 138754
  derived and/or modified sequence opt3 from neuraminidase__InfluenzaA__ADD74791

SEQ ID NO: 140287 - RNA, 1410 nt, Artificial Sequence; identical to SEQ ID NO: 139337
  derived and/or modified sequence opt3 from neuraminidase__InfluenzaA__ADD74811

SEQ ID NO: 140288 - RNA, 1410 nt, Artificial Sequence; identical to SEQ ID NO: 138754
  derived and/or modified sequence opt3 from neuraminidase__InfluenzaA__ADD74821

SEQ ID NO: 140289 - RNA, 1410 nt, Artificial Sequence
  derived and/or modified sequence opt3 from neuraminidase__InfluenzaA__ADD74831
augaaccccaaucagaagaucauuaccauaggcagcaucugcaugacaauugggauggccaaccugauccuccaaauuggaaauaucauauccaucuggauuucucacucaauccagcuugguaaccagaaucagauugagacuuguaaccaaagugugaucacguacgaaaauaacaccugggucaaucagacauauguuaacauaagcaauacuaacuucgcugcaggccaguccgugguaucugugaaacuggccggaaauucgucauugugcccugucagcggaugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugccucaacgggucguguuucaccguuaugacagauggaccaucugacggccaggcuuccuacaaaauuuuucggaucgaaaaggguaaaauugugaagucagucgagaugaaugcccccaacuaucauuacgaagagugcaguuguuacccugauagcuccgagauaacuugcgugugccgcgacaauuggcacgggucuaacagaccaugggugagcuucaaucagaaccuggaauaucagaucggauacauuuguucaggcaucuuuggcgauaauccgaggcccaacgacaaaaccgggaguugcggaccugucuccagcaauggugcgaacggcguuaagggguucucuuuuaaguauggaaacggcguguggaucggucggacaaaaucaauuaguagccgcaauggguucgagaugauaugggauccaaacggcuggaccggaacggacaauaacuuuuccaucaagcaagacauuguaggcaucaaugaauggucuggguacucggggagcuucgugcagcaucccgagcugacuggucucgauuguauucgaccuugcuucugggucgaauuaaucagaggcaggccaaaagagaacacaauauggaccuccgggucaaguaucucuuuuuguggagugaauagcgacacuguuggcugguccuggcccgauggugcagagcugccguucacaauugacaaguga

SEQ ID NO: 140290 - RNA, 1410 nt, Artificial Sequence; identical to SEQ ID NO: 138754
  derived and/or modified sequence opt3 from neuraminidase__InfluenzaA__ADD74841

SEQ ID NO: 140291 - RNA, 1410 nt, Artificial Sequence; identical to SEQ ID NO: 138754
  derived and/or modified sequence opt3 from neuraminidase__InfluenzaA__ADD74851

SEQ ID NO: 140292 - RNA, 1410 nt, Artificial Sequence; identical to SEQ ID NO: 139861
  derived and/or modified sequence opt3 from neuraminidase__InfluenzaA__ADD74861

SEQ ID NO: 140293 - RNA, 1410 nt, Artificial Sequence; identical to SEQ ID NO: 138754
  derived and/or modified sequence opt3 from neuraminidase__InfluenzaA__ADD74871

SEQ ID NO: 140294 - RNA, 1410 nt, Artificial Sequence; identical to SEQ ID NO: 138754
  derived and/or modified sequence opt3 from neuraminidase__InfluenzaA__ADD74881

SEQ ID NO: 140295 - RNA, 1410 nt, Artificial Sequence; identical to SEQ ID NO: 138754
  derived and/or modified sequence opt3 from neuraminidase__InfluenzaA__ADD74891

SEQ ID NO: 140296 - RNA, 1410 nt, Artificial Sequence; identical to SEQ ID NO: 138754
  derived and/or modified sequence opt3 from neuraminidase__InfluenzaA__ADD74901

SEQ ID NO: 140297 - RNA, 1410 nt, Artificial Sequence; identical to SEQ ID NO: 138754
  derived and/or modified sequence opt3 from neuraminidase__InfluenzaA__ADD74911

SEQ ID NO: 140298 - RNA, 1410 nt, Artificial Sequence; identical to SEQ ID NO: 138754
  derived and/or modified sequence opt3 from neuraminidase__InfluenzaA__ADD74921

SEQ ID NO: 140299 - RNA, 1410 nt, Artificial Sequence; identical to SEQ ID NO: 138754
  derived and/or modified sequence opt3 from neuraminidase__InfluenzaA__ADD74941

SEQ ID NO: 140300 - RNA, 1410 nt, Artificial Sequence
  derived and/or modified sequence opt3 from neuraminidase__InfluenzaA__ADD74961
augaaccccaaucagaagaucauuaccauaggcagcgugugcaugacaaucgggauggccaaccugauucuccaaaucggaaauauuaucuccauauggaucucucacucaauucagcuugguaaccagaaucagaucggcacuuguaaccaaagugucauuacguacgagaauaacaccuggguuaaucauacauaugugaacaucagcaauacuaacuucgcugcagggcaguccguagugucugucaaacuggccggaaauucgucauugugcccugugagcggcugggcgauauacaguaaggacaacuccguuagaauugguucuaaaggggauguguuugucaucagggaaccauucauuagcuguuccccguuagagugccggaccuuuuuccugacacagggagcucuacucaaugacaagcacucaaacggcaccaucaaagaucgcagucccuaucgaacucugaugagcuguccuaucggcgaagugccaucucccuacaacucccguuuugagucaguagccuggagcgcaagugccugccaugacgggauuaauuggcuuacaauaggaaucucugguccugauaacggcgcuguugcagugcugaaguauaaugggauuaucaccgacacgauaaaguccuggagaaacaauauuuugaggacucaggaaagcgagugugccugcgucaacggaucguguuucaccgugaugacagauggcccaucugacggucaggcuuccuacaaaaucuuucggaucgagaaggggaaaauugugaagucagucgaaaugaaugcccccaacuaucacuacgaggaaugcaguuguuacccugauagcuccgagaucacuugcguuugccgcgacaauuggcauggaucuaacagaccaugggugagcuucaaucaaaaccucgaguaucagauuggcuacauauguucaggcaucuuuggggauaauccgaggcccaacgacaaaaccggaaguugcgguccuguauccagcaauggcgcgaacggggugaagggauucucuuuuaaguauggcaacggugucuggauugggcggacaaaaucaaucaguagccgcaauggcuucgaaaugaucugggauccaaacggauggaccggcacggacaauaacuuuuccauuaagcaggacauaguggggaucaaugaguggucuggauacucggguagcuucguucaacaccccgaacugacuggccuggauuguauucgaccuugcuucuggguggagcucaucagagggaggccaaaagaaaacacaauuuggaccuccggaucaaguaucucuuuuuguggcgucaauagcgacacuguggguugguccuggcccgauggggcagaguuaccguucacaauagacaaguga

SEQ ID NO: 140301 - RNA, 1410 nt, Artificial Sequence; identical to SEQ ID NO: 138754
  derived and/or modified sequence opt3 from neuraminidase__InfluenzaA__ADD74971

SEQ ID NO: 140302 - RNA, 1410 nt, Artificial Sequence
  derived and/or modified sequence opt3 from neuraminidase__InfluenzaA__ADD74981
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaaguauuaucacguacgaaaauaacaccugggucaaucagacauauguuaacauaagcaauacuaacuucgcugcaggccaguccgugguaucugugaaacuggccggaaauucgucauugugcccugucagcgggugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcuccggguucgagaugauaugggauccaaauggcuggaccggaacggacaacaauuuuucuaucaagcaagacauugugggcaucaacgaauggucgggguacagcggauccuucguccagcaucccgagcugacuggucuggauuguauucgaccuugcuucuggguggaacucaucagaggcaggccagaggagaauacaauauggaccucagggaguucuaucagcuuuuguggaguuaacuccgacacugugggcuggucauggcccgauggugcagaauuaccguucacaauugacaaauga

SEQ ID NO: 140303 - RNA, 1410 nt, Artificial Sequence; identical to SEQ ID NO: 138754
  derived and/or modified sequence opt3 from neuraminidase__InfluenzaA__ADD74991

SEQ ID NO: 140304 - RNA, 1410 nt, Artificial Sequence; identical to SEQ ID NO: 138754
  derived and/or modified sequence opt3 from neuraminidase__InfluenzaA__ADD75001

SEQ ID NO: 140305 - RNA, 1410 nt, Artificial Sequence
  derived and/or modified sequence opt3 from neuraminidase__InfluenzaA__ADD75011
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcgauccuguguccagcaauggagcgaacgguguaaagggcuucucuuuuaaguaugggaacggaguguggaucggccggacaaaaucaaucaguagccgcaaugguuucgagaugauuugggacccaaacggguggaccggcacggacaauaacuuuuccauaaagcaagauaucgucggaauuaaugaauggucuggcuacucggggagcuucgugcagcaucccgagcugacuggacuggacuguauccgaccuugcuucuggguugaacucauuagagguaggccaaaagagaacacaaucuggaccuccggcucaaguauaucuuuuuguggggugaauagcgauacugucggaugguccuggcccgacggcgcagaguuaccguucacaaucgauaaguga

SEQ ID NO: 140306 - RNA, 1410 nt, Artificial Sequence; identical to SEQ ID NO: 140042
  derived and/or modified sequence opt3 from neuraminidase__InfluenzaA__ADD75031

SEQ ID NO: 140307 - RNA, 1410 nt, Artificial Sequence
  derived and/or modified sequence opt3 from neuraminidase__InfluenzaA__ADD75041
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaaaaccuggguuaaccagacauaugugaauaucagcaacacuaauuucgcugcaggccaguccguagugucugucaagcuggccgggaacucgucauugugcccugugagcggaugggcgauauacaguaaagacaauuccauuagaaucggcucuaagggugauguuuuugugauuagggagccauucaucagcuguuccccguuagaaugccggaccuuuuuccugacacagggggcucuacucaacgacaaacauucaaauggaaccaucaaggaucgcagucccuaucgaacucugaugagcuguccuauuggcgaggucccaucucccuacaacucccguuuugaaucaguggccuggagcgcaagugccugccacgacggcauaaacuggcuuacaaucgggauuucuggaccugauaauggugcuguagcaguucugaaguauaacggcaucauaaccgacacgauuaaauccuggagaaauaacaucuugaggacucaagagagcgagugugccugcgugaaugggucguguuucaccgucaugacagauggaccaucugacggccaggcuuccuacaagaucuuucggauugaaaaagguaagaucgugaaaucaguggagaugaacgcccccaauuaucauuacgaagagugcaguuguuacccugauagcuccgagauuacuugcgucugccgcgacaacuggcacgggucuaauagaccauggguuagcuucaaccagaaucucgaauaucagauaggauacaucuguucaggcauuuuuggcgauaacccgaggcccaaugacaagaccgggaguugcggaccuguguccagcaacggugcgaauggcguaaagggguucucuuuuaaauauggaaacggcguguggaucggucggacaaagucaaucaguagccgcaacggguucgagaugauuugggauccaaauggcuggaccggaacggacaacaauuuuuccauaaaacaagacaucgucggcauuaacgaauggucuggguacucggguagcuucgugcagcaucccgagcugacuggacuggauuguauccgaccuugcuucuggguugaacucauuagaggcaggccaaaggagaauacaaucuggaccuccgggucaaguauaucuuuuuguggagugaacagcgacacugucggcugguccuggcccgauggugcagaguuaccguucacaaucgacaaauga

SEQ ID NO: 140308 - RNA, 1410 nt, Artificial Sequence; identical to SEQ ID NO: 138754
  derived and/or modified sequence opt3 from neuraminidase__InfluenzaA__ADD75051

SEQ ID NO: 140309 - RNA, 1410 nt, Artificial Sequence; identical to SEQ ID NO: 138754
  derived and/or modified sequence opt3 from neuraminidase__InfluenzaA__ADD75061

SEQ ID NO: 140310 - RNA, 1410 nt, Artificial Sequence; identical to SEQ ID NO: 138754
  derived and/or modified sequence opt3 from neuraminidase__InfluenzaA__ADD75071

SEQ ID NO: 140311 - RNA, 1410 nt, Artificial Sequence; identical to SEQ ID NO: 138754
  derived and/or modified sequence opt3 from neuraminidase__InfluenzaA__ADD75081

SEQ ID NO: 140312 - RNA, 1410 nt, Artificial Sequence
  derived and/or modified sequence opt3 from neuraminidase__InfluenzaA__ADD75091
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcuccggguucgagaugauuugggauccaaauggcuggaccggaacggacaacaauuuuucuauaaagcaagacaucgucggcauuaacgaauggucgggguacagcggauccuucgugcagcaucccgagcugacuggucuggauuguauccgaccuugcuucuggguugaacucauuagaggcaggccaaaagagaauacaaucuggaccucagggaguucuauaucguuuuguggagugaacuccgacacugucggcuggucauggcccgauggugcagaguuaccguucacaaucgacaaguga

SEQ ID NO: 140313 - RNA, 1410 nt, Artificial Sequence; identical to SEQ ID NO: 138754
  derived and/or modified sequence opt3 from neuraminidase__InfluenzaA__ADD75101

SEQ ID NO: 140314 - RNA, 1410 nt, Artificial Sequence; identical to SEQ ID NO: 138754
  derived and/or modified sequence opt3 from neuraminidase__InfluenzaA__ADD75111

SEQ ID NO: 140315 - RNA, 1410 nt, Artificial Sequence; identical to SEQ ID NO: 138754
  derived and/or modified sequence opt3 from neuraminidase__InfluenzaA__ADD75121

SEQ ID NO: 140316 - RNA, 1410 nt, Artificial Sequence; identical to SEQ ID NO: 138754
  derived and/or modified sequence opt3 from neuraminidase__InfluenzaA__ADD75131

SEQ ID NO: 140317 - RNA, 1410 nt, Artificial Sequence; identical to SEQ ID NO: 138754
  derived and/or modified sequence opt3 from neuraminidase__InfluenzaA__ADD75141

SEQ ID NO: 140318 - RNA, 1410 nt, Artificial Sequence
  derived and/or modified sequence opt3 from neuraminidase__InfluenzaA__ADD75161
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcaguagcuaucgaacucugaugucuugucccauuggcgaggucccuuccccauacaacucacguuuugaaagcguggccuggagugcaucugccugccacgacggcauaaauuggcuuacaaucgggauuuccggacccgauaacggugcuguagcaguucugaaguauaauggcaucauaaccgacacgauuaagagcuggagaaacaauaucuugaggacucaagagucggagugugccugcgugaacgggucuuguuucaccgucaugacagauggaccuuccgacggccaggcuucauacaaaaucuuucggauugaaaaggguaaaaucgugaagaguguggagaugaaugccccaaacuaucauuacgaagagugcagcuguuaccccgauuccucugagauuacuugcgucugccgcgacaauuggcacgggagcaacagaccuuggguuucauucaaucagaaccucgaauauaaaauaggauacaucuguaguggcauuuuuggcgauaauccaaggccgaacgacaagaccggguccugcggacccgugagcucuaauggugcgaacggcguaaagggguucucauuuaaauauggaaacggcguguggaucggucggacaaagaguaucagcucccgcaauggguucgagaugauuugggauccuaacggcuggaccggaacggacaauaacuuuucuauaaaacaggacaucgucggcauuaaugaauggucgggguacagcggauccuucgugcaacauccagagcugacuggucuggauuguauccgacccugcuucuggguugaacucauuagaggcaggccuaaggagaacacaaucuggaccucagggaguucuauaucguuuuguggagucaauuccgacacugugggcuggucauggccagauggugcagaguuacccuucacaaucgaccgguga

SEQ ID NO: 140319 - RNA, 1410 nt, Artificial Sequence
  derived and/or modified sequence opt3 from neuraminidase__InfluenzaA__ADD84500
augaaccccaaucagaacaucauuaccauaggcagcgugugcaugacaaucgggauggccaaucugauucuccaaaucggaaacauuaucuccauauggaucucucacucaauucagcuugguaaucagaaccagaucgagacuuguaaucaaagugucauuacguacgaaaacaauaccuggguuaaccagacauaugugaauaucagcaacacuaauuucgcugcaggccaguccguagugucugucaagcuggccgggaacucgucauugugcccugugagcggaugggcgauauacaguaaagacaauuccauuagaaucggcucuaagggugauguuuuugugauuagggagccauucaucagcuguuccccguuagaaugccggaccuuuuuccugacacagggggcucuacucaacgacaaacauucaaacggaaccaucaaggaucgcagucccuaucgaacucugaugagcuguccuauuggcgaggucccaucucccuacaauucccguuuugaaucaguggccuggagcgcaagugccugccacgacggcauaaacuggcuuacaaucgggauuucuggaccugauaauggugcuguagcaguucugaaauauaacggcaucauaaccgacacgauuaaguccuggagaaauaacaucuugaggacucaagagagcgagugugccugcgugaaugggucguguuucaucgucaugaccgauggaccaucugacggccaggcuuccuacaagauuuuucggaucgaaaaagguaagauugugaaaucaguggagaugaacgcccccaauuaucauuacgaagagugcaguuguuacccugauagcuccgagauaacaugcgucugccgcgacaacuggcacgggucuaauagaccauggguuagcuucaaccagaaucucgaauaucagaucggauacauuuguucaggcaucuuuggcgauaacccgaggcccaaugacaagacugggaguugcggaccuguguccagcaacggugcgaacggcguaaaaggguucucuuuuaaguauggaaauggcguguggaucggucggaccaagucaauuaguagccgcaacggguucgagaugauaugggauccaaauggcuggacaggaaccgacaacaauuuuuccaucaaacaagacauugucggcaucaacgaauggucuggguacucggguagcuucgugcagcaucccgagcugacgggacuggauuguauucgaccuugcuucuggguugaacucaucagaggcaggccaaaggagaauacuauauggacauccgggucaaguaucucuuuuuguggagugaacagcgacaccgucggcugguccuggcccgauggugcagaguuaccguucacuauugacaaauga

SEQ ID NO: 140320 - RNA, 1410 nt, Artificial Sequence
  derived and/or modified sequence opt3 from neuraminidase__InfluenzaA__ADD84502
augaaccccaaucagaacaucauuaccauaggcagcgugugcaugacaaucgggauggccaaucugauucuccaaaucggaaacauuaucuccauauggaucucucacucaauucagcuugguaaucagaaccagaucgagacuuguaaucaaagugucauuacguacgaaaacaauaccuggguuaaccagacauaugugaauaucagcaacacuaauuucgcugcaggccaguccguagugucugucaagcuggccgggaacucgucauugugcccugugagcggaugggcgauauacaguaaagacaauuccauuagaaucggcucuaagggugauguuuuugugauuagggagccauucaucagcuguuccccguuagaaugccggaccuuuuuccugacacagggggcucuacucaacgacaaacauucaaacggaaccaucaaggaucgcagucccuaucgaacucugaugagcuguccuauuggcgaggucccaucucccuacaauucccguuuugaaucaguggccuggagcgcaagugccugccacgacggcauaaacuggcuuacaaucgggauuucuggaccugauaauggugcuguagcaguucugaaauauaacggcaucauaaccgacacgauuaaguccuggagaaauaacaucuugaggacucaagagagcgagugugccugcgugaaugggucguguuucaccgucaugacagauggaccaucugacggccaggcuuccuacaagaucuuucggauugaaaaagguaagaucgugaaaucaguggagaugaacgcccccaauuaucauuacgaagagugcaguuguuacccugauagcuccgagauuacuugcgucugccgcgacaacuggcacgggucuaauagaccauggguuagcuucaaccagaaucucgaauaucagauaggauacaucuguucaggcauuuuuggcgauaacccgaggcccaaugacaagaccgggaguugcggaccuguguccagcaacggugcgaacggcguaaaaggguucucuuuuaaguauggaaauggcguguggaucggucggacaaagucaaucaguagccgcaacggguucgagaugauuugggauccaaauggcuggaccggaacggacaacaauuuuuccauaaaacaagacaucgucggcauuaacgaauggucuggguacucggguagcuucgugcagcaucccgagcugacuggacuggauuguauccgaccuugcuucuggguugaacucauuagaggcaggccaaaggagaauacaaucuggaccuccgggucaaguauaucuuuuuguggagugaacagcgacacugucggcugguccuggcccgauggugcagaguuaccguucacaaucgacaaauga

SEQ ID NO: 140321 - RNA, 1410 nt, Artificial Sequence; identical to SEQ ID NO: 140320
  derived and/or modified sequence opt3 from neuraminidase__InfluenzaA__ADD84503

SEQ ID NO: 140322 - RNA, 1410 nt, Artificial Sequence
  derived and/or modified sequence opt3 from neuraminidase__InfluenzaA__ADD84504
augaaccccaaucagaacaucauuaccauaggcagcgugugcaugacaaucgggauggccaaucugauucuccaaaucggaaacauuaucuccauauggaucucucacucaauucagcuugguaaucagaaccagaucgagacuuguaaucaaagugucauuacguacgaaaacaauaccuggguuaaccagacauaugugaauaucagcaacacuaauuucgcugcaggccaguccguagugucugucaagcuggccgggaacuuuucguugugcccugugucaggaugggcgauauacagcaaagacaauaguauuagaaucggcuccaagggugauguuuucgugauuagggagccauuuaucucuuguagcccguuagaaugccggaccuucuuucugacacagggggcucuacucaacgacaaacauuccaacggaaccaucaaggaucgcucacccuaucgaacucugaugaguuguccuauuggcgaggucccaagccccuacaauucucguuucgaauccguggccuggucagcaagcgccugccacgacggcauaaacuggcuuacaaucgggauuaguggaccugauaauggugcuguagcaguucugaaauauaacggcaucauaaccgacacgauuaagucuuggagaaauaacaucuugaggacucaagaguccgagugugccugcgugaaugggagcuguuuuaccgucaugacagauggaccaucggacggccaggcuucuuacaagaucuuccggauugaaaaagguaagaucgugaaauccguggagaugaacgcccccaauuaucauuacgaagagugcucauguuacccugauaguagcgagauuacuugcgucugccgcgacaacuggcacggguccaauagaccauggguuucuuuuaaccagaaucucgaauaucagauaggauacaucuguagcggcauuuucggcgauaacccgaggcccaaugacaagaccgggucaugcggaccugugaguuccaacggugcgaacggcguaaaaggguuuagcuucaaguauggaaauggcguguggaucggucggacaaagucuaucucaagucgcaacggguuugagaugauuugggauccaaauggcuggaccggaacggacaacaauuucagcauaaaacaagacaucgucggcauuaacgaaugguccggguacucuggaucguucgugcagcaucccgagcugacuggucuggauuguauccgaccuugcuuuuggguugaacucauuagaggcaggccaaaggagaauacaaucuggaccagcggguccucaauaaguuucuguggagugaacucugacacugucggcuggagcuggcccgauggugcagaguuaccguuuacaaucgacaaauga

SEQ ID NO: 140323 - RNA, 1410 nt, Artificial Sequence; identical to SEQ ID NO: 140320
  derived and/or modified sequence opt3 from neuraminidase__InfluenzaA__ADD84505

SEQ ID NO: 140324 - RNA, 1410 nt, Artificial Sequence; identical to SEQ ID NO: 140320
  derived and/or modified sequence opt3 from neuraminidase__InfluenzaA__ADD84506

SEQ ID NO: 140325 - RNA, 1410 nt, Artificial Sequence
  derived and/or modified sequence opt3 from neuraminidase__InfluenzaA__ADD92528
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucugggcauucgggaagcuccgugcagcaccccgagcugacuggucuggauuguauccgaccuugcuucuggguugaacucauuagaggcaggccaaaagagaacacaaucuggaccucagggaguucuauaucguucuguggagucaauuccgacacugugggcuggucauggcccgauggugcagaguuaccguuuacaaucgacaaguga

SEQ ID NO: 140326 - RNA, 1410 nt, Artificial Sequence; identical to SEQ ID NO: 139977
  derived and/or modified sequence opt3 from neuraminidase__InfluenzaA__ADD96769

SEQ ID NO: 140327 - RNA, 1410 nt, Artificial Sequence; identical to SEQ ID NO: 139977
  derived and/or modified sequence opt3 from neuraminidase__InfluenzaA__ADD96779

SEQ ID NO: 140328 - RNA, 1410 nt, Artificial Sequence; identical to SEQ ID NO: 139977
  derived and/or modified sequence opt3 from neuraminidase__InfluenzaA__ADD96789

SEQ ID NO: 140329 - RNA, 1410 nt, Artificial Sequence; identical to SEQ ID NO: 140105
  derived and/or modified sequence opt3 from neuraminidase__InfluenzaA__ADD96799

SEQ ID NO: 140330 - RNA, 1410 nt, Artificial Sequence; identical to SEQ ID NO: 138754
  derived and/or modified sequence opt3 from neuraminidase__InfluenzaA__ADD96809

SEQ ID NO: 140331 - RNA, 1410 nt, Artificial Sequence
  derived and/or modified sequence opt3 from neuraminidase__InfluenzaA__ADD96819
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggucgagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccgucaugacagauggaccauccgacggccaggcuucauacaaaaucuuucggauugaaaaggguaaaaucgugaagaguguggagaugaacgcccccaauuaucauuacgaagagugcagcuguuacccugauuccucugagauuacuugcgucugccgcgacaacuggcacgggagcaauagaccauggguuucauucaaccagaaucucgaauaucagauaggauacaucuguaguggcauuuuuggcgauaacccgaggcccaaugacaaaaagggguccugcggaccugugagcucuaacggugcgaauggcguaaagggguucucauuuaaauauggaaacggcguguggaucggucggaccaagaguaucagcucccgcaacggguucgagaugauuugggauccaaauggcuggacaggaaccgacaacaauuuuucuauaaaacaagacaucgucggcauuaacgaauggucgggguacagcggauccuucgugcagcaucccgagcugacgggucuggauuguauccgaccuugcuucuggguugaacucauuagaggcaggccaaaggagaauacuaucuggacaucagggaguucuauaucauuuuguggagugaacuccgacaccgucggcuggucauggcccgauggugcagaguuaccguucacuaucgacaaauga

SEQ ID NO: 140332 - RNA, 1410 nt, Artificial Sequence; identical to SEQ ID NO: 138754
  derived and/or modified sequence opt3 from neuraminidase__InfluenzaA__ADD96829

SEQ ID NO: 140333 - RNA, 1410 nt, Artificial Sequence; identical to SEQ ID NO: 138754
  derived and/or modified sequence opt3 from neuraminidase__InfluenzaA__ADD96839

SEQ ID NO: 140334 - RNA, 1410 nt, Artificial Sequence; identical to SEQ ID NO: 138754
  derived and/or modified sequence opt3 from neuraminidase__InfluenzaA__ADD96849

SEQ ID NO: 140335 - RNA, 1410 nt, Artificial Sequence; identical to SEQ ID NO: 138754
  derived and/or modified sequence opt3 from neuraminidase__InfluenzaA__ADD96859

SEQ ID NO: 140336 - RNA, 1410 nt, Artificial Sequence
  derived and/or modified sequence opt3 from neuraminidase__InfluenzaA__ADD96869
augaaccccaaucagaagaucauuaccauaggcagcgugugcaugacaaucgggauggccaaccugauucuccaaaucggaaauauuaucuccauauggaucucucacccuauucagcuugguaaccagaaucagaucgagacuuguaaccaaucagucauuacguacgaaaauaacaccuggguuaaucagacauaugugaacaucaguaauacuaacuucgcugcaggccagagcguaguguccgucaaacuggccggaaauucuucguugugcccagugucagggugggcgauauacagcaaggacaacaguauuagaaucggcuccaaaggugauguuuuugugauuagggagccguucaucucuuguagccccuuagaaugccggaccuuuuuccugacacagggggcucuacucaaugacaagcauuccaacggaaccaucaaagaucgcucaccuuaucgaacucugaugaguuguccaauuggcgagguccccagcccuuacaacucucguuuugaauccguggccuggucagcaagcgccugccacgacggcauaaauuggcuuacaaucgggauuaguggaccagauaacggugcuguagcaguucugaaguauaauggcaucauaaccgacacgauuaagucuuggaaaaacaauaucuugagaacucaagaguccgagugugccugcgugaacgggagcuguuucaccgucaugacagauggacccucggacggccaggcuucuuacaagaucuuuaggauugaaaaagguaagaucgugaaauccguggagaugaaugccccuaacuaucauuacgaagagugcucauguuacccagauaguagcgagauuacuugcgucugccgggacaauuggcacggguccaaccgcccguggguuucuuucaaucagaaccucgaauaucagauaggauacaucuguagcggcauuuuuggcgauaaucccagaccuaacgacaagaccgggucaugcggaccagugaguuccaauggugcgaacggcguaaagggguucagcuuuaaauauggaaacggcguguggaucgguaggacaaagucuaucucaagucggaauggguucgagaugauuugggaucccaacggcuggaccggaacggacaauaacuuuagcauaaaacaagacaucgucggcauuaaugaaugguccggguacucuggaucguucgugcagcauccugagcugacuggucuggauuguauccgcccaugcuucuggguugaacucauucgaggcagacccaaggagaacacaaucuggaccagcggguccucaauaaguuuuuguggagucaauucugacacugugggcuggagcuggccggauggugcagaguuaccuuucacaaucgacaaauga

SEQ ID NO: 140337 - RNA, 1410 nt, Artificial Sequence
  derived and/or modified sequence opt3 from neuraminidase__InfluenzaA__ADD96879
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagggugccggaccuuuuuccugacacagggagcucuacucaaugacaagcauucaaacggcaccaucaaagaucgcagucccuaucgaacucugaugagcuguccuauuggcgaagucccaucucccuacaacucccguuuugagucaguggccuggagcgcaagugccugccacgacgggauaaauuggcuuacaaucggaauuucugguccugauaacggcgcuguagcaguucugaaguauaaugggaucauaaccgacacgauuaaguccuggagaaacaauaucuugaggacucaagaaagcgagugugccugcgugaacggaucguguuucaccgucaugacagauggcccaucugacggucaggcuuccuacaaaaucuuucggauugagaaggggaaaaucgugaagucaguggaaaugaaugcccccaacuaucauuacgaggaaugcaguuguuacccugauagcuccgagauuacuugcgucugccgcgacaauuggcacggaucuaacagaccauggguuagcuucaaucagaaccucgaguaucagauaggcuacaucuguucaggcauuuuuggggauaauccgaggcccaacgacaaaaccggaaguugcgguccuguguccagcaauggcgcgaacgggguaaagggauucucuuuuaaguauggcaacgguguguggaucgggcggacaaaaucaaucaguagccgcaauggcuucgaaaugauuugggauccaaacggauggaccggcacggacaauaacuuuuccauaaagcaagacaucgucgggauuaaugaguggucuggauacucggguagcuucgugcagcaucccgaacugacuggccuggauuguauccgaccuugcuucuggguugagcucauuagagggaggccaaaagaaaacacaaucuggaccuccggaucaaguauaucuuuuuguggcgugaauagcgacacugucgguugguccuggcccgauggggcagaguuaccguucacaaucgacaaguga

SEQ ID NO: 140338 - RNA, 1410 nt, Artificial Sequence; identical to SEQ ID NO: 138754
  derived and/or modified sequence opt3 from neuraminidase__InfluenzaA__ADD96889

SEQ ID NO: 140339 - RNA, 1410 nt, Artificial Sequence; identical to SEQ ID NO: 139337
  derived and/or modified sequence opt3 from neuraminidase__InfluenzaA__ADD96899

SEQ ID NO: 140340 - RNA, 1410 nt, Artificial Sequence; identical to SEQ ID NO: 138754
  derived and/or modified sequence opt3 from neuraminidase__InfluenzaA__ADD96909

SEQ ID NO: 140341 - RNA, 1410 nt, Artificial Sequence; identical to SEQ ID NO: 138754
  derived and/or modified sequence opt3 from neuraminidase__InfluenzaA__ADD96919

SEQ ID NO: 140342 - RNA, 1410 nt, Artificial Sequence; identical to SEQ ID NO: 138754
  derived and/or modified sequence opt3 from neuraminidase__InfluenzaA__ADD96929

SEQ ID NO: 140343 - RNA, 1410 nt, Artificial Sequence; identical to SEQ ID NO: 138754
  derived and/or modified sequence opt3 from neuraminidase__InfluenzaA__ADD96939

SEQ ID NO: 140344 - RNA, 1410 nt, Artificial Sequence; identical to SEQ ID NO: 138754
  derived and/or modified sequence opt3 from neuraminidase__InfluenzaA__ADD96959

SEQ ID NO: 140345 - RNA, 1410 nt, Artificial Sequence; identical to SEQ ID NO: 138754
  derived and/or modified sequence opt3 from neuraminidase__InfluenzaA__ADD96969

SEQ ID NO: 140346 - RNA, 1410 nt, Artificial Sequence
  derived and/or modified sequence opt3 from neuraminidase__InfluenzaA__ADD96989
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcaguagcuaucgaacucugaugucuugucccauuggcgaggucccuuccccauacaacucacguuuugaaagcguggccuggagugcaucugccugccacgacggcauaaauuggcuuacaaucgggauuuccggacccgauaacggugcuguagcaguucugaaguauaauggcaucauaaccgacacgauuaagagcuggagaaacaauaucuugaggacucaagagucggagugugccugcgugaacgggucuuguuucaccgucaugacagauggaccuuccgacggccaggcuucauacaaaaucuuucggauugaaaaggguaaaaucgugaagaguguggagaugaaugccccaaacuaucauuacgaagagugcagcuguuaccccgauuccucugagauuacuugcgucugccgcgacaauuggcacgggagcaacagaccuuggguuucauucaaucagaaccucgaauaucagauaggauacaucuguaguggcauuuuuggcgauaauccaaggccgaacgacaaaaccggguccugcggacccgugagcucuaauggugcgaacggcguaaagggguucucauuuaaguauggaaacggcguguggaucggucggacaaaaaguaucagcucccgcaauggguucgagaugauuugggauccuaacggcuggaccggaacggacaauaacuuuucuauaaagcaagacaucgucggcauuaaugaauggucgggguacagcggauccuucgugcagcauccagagcugacuggucuggauuguauccgacccugcuucuggguugaacucauuagaggcaggccuaaagagaacacaaucuggaccucagggaguucuauaucguuuuguggagucaauuccgacacugugggcuggucauggccagauggugcagaguuacccuucacaaucgacaaguga

SEQ ID NO: 140347 - RNA, 1410 nt, Artificial Sequence
  derived and/or modified sequence opt3 from neuraminidase__InfluenzaA__ADD97038
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggauaggaaccgacaauaacuuuuccaucaagcaagacauugucggcaucaaugaauggucuggguacucggggagcuucgugcagcaucccgagcugacgggucuggauuguauucgaccuugcuucuggguugaacucaucagaggcaggccaaaagagaacacuauauggacauccgggucaaguaucucuuuuuguggagugaauagcgacaccggcgguugguccuggcccgauggggcagaguuaccguucacuauugacaaguga

SEQ ID NO: 140348 - RNA, 1410 nt, Artificial Sequence; identical to SEQ ID NO: 138754
  derived and/or modified sequence opt3 from neuraminidase__InfluenzaA__ADD97048

SEQ ID NO: 140349 - RNA, 1410 nt, Artificial Sequence; identical to SEQ ID NO: 138754
  derived and/or modified sequence opt3 from neuraminidase__InfluenzaA__ADD97058

SEQ ID NO: 140350 - RNA, 1410 nt, Artificial Sequence; identical to SEQ ID NO: 138754
  derived and/or modified sequence opt3 from neuraminidase__InfluenzaA__ADD97069

SEQ ID NO: 140351 - RNA, 1410 nt, Artificial Sequence; identical to SEQ ID NO: 138754
  derived and/or modified sequence opt3 from neuraminidase__InfluenzaA__ADD97126

SEQ ID NO: 140352 - RNA, 1410 nt, Artificial Sequence; identical to SEQ ID NO: 138754
  derived and/or modified sequence opt3 from neuraminidase__InfluenzaA__ADD97164

SEQ ID NO: 140353 - RNA, 1410 nt, Artificial Sequence; identical to SEQ ID NO: 138754
  derived and/or modified sequence opt3 from neuraminidase__InfluenzaA__ADD97174

SEQ ID NO: 140354 - RNA, 1410 nt, Artificial Sequence; identical to SEQ ID NO: 138754
  derived and/or modified sequence opt3 from neuraminidase__InfluenzaA__ADD97184

SEQ ID NO: 140355 - RNA, 1410 nt, Artificial Sequence
  derived and/or modified sequence opt3 from neuraminidase__InfluenzaA__ADD97194
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaaugcuaacuucgcagccggccaguccguagugucugucaaacuggcgggaaauucgucauugugcccugugagcggaugggcuauauacaguaaggacaacuccauuagaaucggcucuaaaggugauguuuuugugauuagggagccauucaucagcuguuccccguuagaaugccggaccuuuuuccugacucagggggcccuacucaaugacaagcauucaaacggaacaaucaaagaucgcagucccuaucgaacccugaugagcuguccuauuggcgaggucccaucucccuacaacucccguuuugaaucaguggcauggagcgccagugcuugccacgacggcauaaauuggcuuacuaucgggauuucuggaccugauaacggugcaguagccguucugaaguauaauggcaucauaacagacaccauuaaguccuggagaaacaauaucuugaggacgcaagagagcgagugugcuugcgugaacgggucguguuucacugucaugaccgauggaccaucugacggccaggccuccuacaaaaucuuucggauugaaaaggguaaaaucgugaagucaguggagaugaaugcgcccaacuaucauuacgaagagugcaguuguuacccugauagcuccgagauuacaugcgucugccgcgacaauuggcacgggucuaacagaccauggguuagcuucaaucagaaccucgaauaucagauaggauacaucuguucaggcauuuuuggcgauaauccgaggcccaacgacaaaacugggaguugcggaccuguguccagcaauggugcaaacggcguaaagggguucucuuuuaaguauggaaacggcguguggaucggucggaccaaaucaaucaguagccgcaauggguucgagaugauuugggauccaaacggcuggacaggaaccgacaauaacuuuuccauaaagcaagacaucgucggcauuaaugaauggucuggguacucggggagcuucgugcagcaucccgagcugacgggucuggauuguauccgaccuugcuucuggguugaacucauuagaggcaggccaaaagagaacacuaucuggacauccgggucaaguauaucuuuuuguggagugaauagcgacaccgucggcugguccuggcccgauggugccgaguuaccguucacuaucgacaaguga

SEQ ID NO: 140356 - RNA, 1410 nt, Artificial Sequence; identical to SEQ ID NO: 140346
  derived and/or modified sequence opt3 from neuraminidase__InfluenzaA__ADD97204

SEQ ID NO: 140357 - RNA, 1410 nt, Artificial Sequence; identical to SEQ ID NO: 138754
  derived and/or modified sequence opt3 from neuraminidase__InfluenzaA__ADD97214

SEQ ID NO: 140358 - RNA, 1410 nt, Artificial Sequence; identical to SEQ ID NO: 138754
  derived and/or modified sequence opt3 from neuraminidase__InfluenzaA__ADD97224

SEQ ID NO: 140359 - RNA, 1410 nt, Artificial Sequence; identical to SEQ ID NO: 138754
  derived and/or modified sequence opt3 from neuraminidase__InfluenzaA__ADD97234

SEQ ID NO: 140360 - RNA, 1410 nt, Artificial Sequence; identical to SEQ ID NO: 138754
  derived and/or modified sequence opt3 from neuraminidase__InfluenzaA__ADD97244

SEQ ID NO: 140361 - RNA, 1410 nt, Artificial Sequence; identical to SEQ ID NO: 138754
  derived and/or modified sequence opt3 from neuraminidase__InfluenzaA__ADD97254

SEQ ID NO: 140362 - RNA, 1410 nt, Artificial Sequence; identical to SEQ ID NO: 138754
  derived and/or modified sequence opt3 from neuraminidase__InfluenzaA__ADD97264

SEQ ID NO: 140363 - RNA, 1410 nt, Artificial Sequence; identical to SEQ ID NO: 138754
  derived and/or modified sequence opt3 from neuraminidase__InfluenzaA__ADD97274

SEQ ID NO: 140364 - RNA, 1410 nt, Artificial Sequence
  derived and/or modified sequence opt3 from neuraminidase__InfluenzaA__ADD97284
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucugcaauacuaacuucgcugcaggccagagcguaguguccgucaaacuggccggaaauucuucguuguguccugugucagggugggcgauauacagcaaggacaacaguauuagaaucggcuccaaaggugauguuuuugugauuagggagccauucaucucuugcagcccguuagaaugucggaccuuuuuccugacacagggggcucuacucaaugacaagcauuccaacggaaccaucaaagaucgcucacccuaucgaacucugaugaguugcccuauuggcgaggucccaagccccuacaacucucguuuugaauccguggccuggucagcaagcgccugucacgacggcauaaauuggcuuacaaucgggauuaguggaccugauaacggugcuguagcaguucugaaguauaauggcaucauaaccgacacgauuaagucuuggagaaacaauaucuugaggacucaagaguccgagugcgccugugugaacgggagcugcuucaccgucaugacagauggaccaucggacggccaggcuucuuacaaaaucuuucggauugaaaaggguaaaaucgugaaguccguggagaugaaugcccccaacuaucauuacgaagaguguucaugcuacccugauaguagcgagauuacuugcgucugucgcgacaauuggcacggguccaacagaccauggguuucuuucaaucagaaccucgaauaucagauaggauacaucugcagcggcauuuuuggcgauaauccgaggcccaacgacaaaaccgggucauguggaccugugaguuccaauggugcgaacggcguaaagggguucagcuuuaaguauggaaacggcguguggaucggucggacaaaaucuaucucaagucgcaauggguucgagaugauuugggauccaaacggcuggaccggaacggacaauaacuuuagcauaaagcaagacaucgucggcauuaaugaaugguccggguacucuggaucguucgugcagcaucccgagcugacuggucuggauugcauccgaccuuguuucuggguugaacucauuagaggcaggccaaaagagaacacaaucuggaccagcggguccucaauaaguuuuugcggagucaauucugacacugugggcuggagcuggcccgauggugcagaguuaccguucacaaucgacaaguga

SEQ ID NO: 140365 - RNA, 1410 nt, Artificial Sequence; identical to SEQ ID NO: 138754
  derived and/or modified sequence opt3 from neuraminidase__InfluenzaA__ADD97294

SEQ ID NO: 140366 - RNA, 1410 nt, Artificial Sequence
  derived and/or modified sequence opt3 from neuraminidase__InfluenzaA__ADD97314
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcacuaaugaauggucuggguacucggggagcuucgugcagcaucccgagcugacaggucuggauuguauucgaccuugcuucuggguugaacucaucagaggcaggccaaaagagaacaccauuuggacuuccgggucaaguaucucuuuuuguggagugaauagcgacacagucggcugguccuggcccgauggugcagaguuaccguucaccauagacaaguga

SEQ ID NO: 140367 - RNA, 1410 nt, Artificial Sequence; identical to SEQ ID NO: 138754
  derived and/or modified sequence opt3 from neuraminidase__InfluenzaA__ADD97334

SEQ ID NO: 140368 - RNA, 1410 nt, Artificial Sequence; identical to SEQ ID NO: 138754
  derived and/or modified sequence opt3 from neuraminidase__InfluenzaA__ADD97344

SEQ ID NO: 140369 - RNA, 1410 nt, Artificial Sequence; identical to SEQ ID NO: 138754
  derived and/or modified sequence opt3 from neuraminidase__InfluenzaA__ADD97354

SEQ ID NO: 140370 - RNA, 1410 nt, Artificial Sequence
  derived and/or modified sequence opt3 from neuraminidase__InfluenzaA__ADD97384
augaaccccaaucagaagaucauuaccauaggcagcgugugcaugacaaucgggauggccaaccugauucuccaaaucggaaauauuaucuccauauggaucucucacacuauucagcuugguaaccagaaucagaucgagacguguaaccaaucagucauuaccuacgaaaauaacacauggguuaaucagacuuaugugaacaucaguaauaccaacuucgcugcaggccagagcguaguguccgucaaacuggccggaaauucuucguugugcccugugucagggugggcgauauacagcaaggacaacaguauuagaaucggcuccaaaggugauguuuuugugauuagggagccauucaucucuuguagcccguuagaaugccggacauuuuuccugacccagggggcucuacucaaugacaagcauuccaacggaacuaucaaagaucgcucacccuaucgaacacugaugaguuguccuauuggcgaggucccaagccccuacaacucucguuuugaauccguggccuggucagcaagcgccugccacgacggcauaaauuggcuuaccaucgggauuaguggaccugauaacggugcuguagcaguucugaaguauaauggcaucauaacggacacuauuaagucuuggagaaacaauaucuugaggacccaagaguccgagugugccugcgugaacgggagcuguuucacagucaugacugauggaccaucggacggccaggcuucuuacaaaaucuuucggauugaaaaggguaaaaucgugaaguccguggagaugaaugcccccaacuaucauuacgaagagugcucauguuacccugauaguagcgagauuaccugcgucugccgcgacaauuggcacggguccaacagaccauggguuucuuucaaucagaaccucgaauaucagauaggauacaucuguagcggcauuuuuggcgauaauccgaggcccaacgacaaaacagggucaugcggaccugugaguuccaauggugcgaacggcguaaagggguucagcuuuaaguauggaaacggcguguggaucggucggaccaaaucuaucucaagucgcaauggguucgagaugauuugggauccaaacggcuggacgggaacugacaauaacuuuagcauaaagcaagacaucgucggcauuaaugaaugguccggguacucuggaucguucgugcagcaucccgagcugacaggucuggauuguauccgaccuugcuucuggguugaacucauuagaggcaggccaaaagagaacaccaucuggacuagcggguccucaauaaguuuuuguggagucaauucugacacagugggcuggagcuggcccgauggugcagaguuaccguucaccaucgacaaguga

SEQ ID NO: 140371 - RNA, 1410 nt, Artificial Sequence
  derived and/or modified sequence opt3 from neuraminidase__InfluenzaA__ADD97394
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccagccuguaguguccgucaaacuggccggaaauucuucguugugcccagugaacgggugggcgauauacucaaaggacaauagcauuagaaucggcaguaaaggugauguuuuugugauuagggagccguucaucuccuguucucccuuagaaugccggaccuuuuuccugacacagggggcucuacucaacgacaagcauagcaacggaaccaucaaagaucgcuccccuuaucgaacucugaugucauguccaauuggcgagguccccaguccuuacaauagccguuuugaaucuguggccugguccgcaucagccugccacgacggcauaaacuggcuuacaaucgggauuagcggaccagauaauggugcuguagcaguucugaaguauaacggcaucauaaccgacacgauuaagaguuggagaaauaacaucuugaggacucaagagucugagugugccugcgugaauggguccuguuucaccgucaugacagauggacccagcgacggccaggcuucguacaaaaucuuucggauugaaaaggguaaaaucgugaagucuguggagaugaacgccccuaauuaucauuacgaagagugcuccuguuacccagauucaagugagauuacuugcgucugccgcgacaacuggcacgggagcaauagaccguggguuuccuucaaccagaaucucgaauaucagauaggauacaucuguucuggcauuuuuggcgauaaccccaggccuaaugacaaaaccgggagcugcggaccagugucaaguaacggugcgaacggcguaaagggguucuccuuuaaguauggaaauggcguguggaucggucggacaaaaagcaucucuucacgcaacggguucgagaugauuugggaucccaauggcuggaccggaacggacaacaauuuuaguauaaagcaagacaucgucggcauuaacgaauggagcggguacuccggaucuuucgugcagcauccugagcugacuggucuggauuguauccgaccaugcuucuggguugaacucauuagaggcaggcccaaagagaauacaaucuggaccucggggagcuccauaucauuuuguggagugaacagugacacugucggcuggucuuggccggauggugcagaguuaccuuucacaaucgacaaguga

SEQ ID NO: 140372 - RNA, 1410 nt, Artificial Sequence; identical to SEQ ID NO: 138754
  derived and/or modified sequence opt3 from neuraminidase__InfluenzaA__ADD97404

SEQ ID NO: 140373 - RNA, 1410 nt, Artificial Sequence; identical to SEQ ID NO: 138754
  derived and/or modified sequence opt3 from neuraminidase__InfluenzaA__ADD97424

SEQ ID NO: 140374 - RNA, 1410 nt, Artificial Sequence; identical to SEQ ID NO: 138754
  derived and/or modified sequence opt3 from neuraminidase__InfluenzaA__ADD97434

SEQ ID NO: 140375 - RNA, 1410 nt, Artificial Sequence; identical to SEQ ID NO: 138754
  derived and/or modified sequence opt3 from neuraminidase__InfluenzaA__ADD97444

SEQ ID NO: 140376 - RNA, 1410 nt, Artificial Sequence
  derived and/or modified sequence opt3 from neuraminidase__InfluenzaA__ADD97454
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccuauaagcgggugggcgauuuacaguaaggacaacuccaucagaauuggcucuaaaggugauguguuuguuaucagggagccauucaucagcuguuccccguuagaaugccggaccuuuuuccugacacagggggcucuacucucagacaagcauaguaauggaaccauuaaagaucgcagccccuaucgaacucugaugucuuguccuauaggcgaggugccaucccccuacaacucacguuuugaaagcgucgccuggagugcaucugccugccacgacggcaucaacuggcuuacaauugggaucuccggaccugauaauggugcuguggcaguacugaaguauaacggcauaauuaccgacacgaucaagagcuggagaaauaacaucuugaggacucaagagucggagugugccugcguuaaugggucuuguuucaccgugaugacagauggaccauccgacggccaggcuucauacaaaauuuuucggaucgaaaaggguaaaauugucaagaguguggagaugaacgcccccaauuaucauuacgaagagugcagcuguuacccugauuccucugagauaacuugcgugugccgcgacaacuggcacgggagcaauagaccaugggucucauucaaccagaaucucgaauaucagaucggauacauuuguaguggcaucuuuggcgauaacccgaggcccaaugacaaaaccggguccugcggaccuguuagcucuaacggugcgaauggcgugaagggguucucauuuaaguauggaaacggcguauggaucggucggacaaaaaguauuagcucccgcaacggguucgagaugauaugggauccaaauggcuggaccggaacggacaacaauuuuucuaucaagcaagacauugugggcaucaacgaauggucgggguacagcggauccuucguccagcaucccgagcugacuggucuggauuguauucgaccuugcuucuggguggaacucaucagaggcaggccaaaagagaauacaauauggaccucagggaguucuaucagcuuuuguggaguuaacuccgacacugugggcuggucauggcccgauggugcagaguuaccguucacaauugacaaguga

SEQ ID NO: 140377 - RNA, 1410 nt, Artificial Sequence
  derived and/or modified sequence opt3 from neuraminidase__InfluenzaA__ADD97464
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccacuaagcaagacauagucggcaucaaugaauggucuggguacucggggagcuucgugcagcaucccgagcugacaggucuggauuguauucgaccuugcuucuggguugaacucaucagaggcaggccaaaagagaacaccauuuggacuuccgggucaaguaucucuuuuuguggagugaauagcgacacagucggcugguccuggcccgauggugcagaguuaccguucaccauagacaaguga

SEQ ID NO: 140378 - RNA, 1410 nt, Artificial Sequence; identical to SEQ ID NO: 138754
  derived and/or modified sequence opt3 from neuraminidase__InfluenzaA__ADD97474

SEQ ID NO: 140379 - RNA, 1410 nt, Artificial Sequence; identical to SEQ ID NO: 138754
  derived and/or modified sequence opt3 from neuraminidase__InfluenzaA__ADD97484

SEQ ID NO: 140380 - RNA, 1410 nt, Artificial Sequence
  derived and/or modified sequence opt3 from neuraminidase__InfluenzaA__ADD97494
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccgucagaaugccggaccuuuuucuuaacacagggggcucugcuaaaugacaagcauaguaacggaaccaucaaagaucgcagccccuaucgaacucucaugucuuguccuauuggcgaggucccaucccccuacaacucacguuuugaaagcguggccuggagugcaucugccugccacgacggcauaaauuggcugacaaucgggauuuccggaccugauaacggugcuguagcaguucuuaaguauaauggcaucauaaccgacacgauuaagagcuggagaaacaauauccugaggacucaagagucggagugugccugcgugaacgggucuuguuucaccgucaugacagauggaccauccgacggccaggcuucauacaaaaucuuucggauugaaaaggguaaaaucgugaagaguguggagaugaaugcccccaacuaucauuacgaagagugcagcuguuacccugauuccucugagauuacuugcgucugccgcgacaauuggcacgggagcaacagaccauggguuucauucaaucagaacuuggaauaucagauaggauacaucuguaguggcauuuuuggcgauaauccgaggcccaacgacaaaaccggguccugcggaccugugagcucuaauggugcgaacggcguaaagggguucucauuuaaguauggaaacggcguguggaucggucggacaaaaaguaucagcucccgcaauggguucgagaugauuugggauccaaacggcuggaccggaacggacaauaacuuuucuauaaagcaagacaucgucggcauuaaugaauggucgggguacagcggauccuucgugcagcaucccgagcucacuggucuggauuguauccgaccuugcuucuggguugaacugauuagaggcaggccaaaagagaacacaaucuggaccucagggaguucuauaucguuuuguggagucaauuccgacacugugggcuggucauggcccgauggugcagagcucccguucacaaucgacaaguga

SEQ ID NO: 140381 - RNA, 1410 nt, Artificial Sequence; identical to SEQ ID NO: 138754
  derived and/or modified sequence opt3 from neuraminidase__InfluenzaA__ADD97504

SEQ ID NO: 140382 - RNA, 1410 nt, Artificial Sequence; identical to SEQ ID NO: 138754
  derived and/or modified sequence opt3 from neuraminidase__InfluenzaA__ADD97514

SEQ ID NO: 140383 - RNA, 1410 nt, Artificial Sequence; identical to SEQ ID NO: 140366
  derived and/or modified sequence opt3 from neuraminidase__InfluenzaA__ADD97534

SEQ ID NO: 140384 - RNA, 1410 nt, Artificial Sequence; identical to SEQ ID NO: 138754
  derived and/or modified sequence opt3 from neuraminidase__InfluenzaA__ADD97544

SEQ ID NO: 140385 - RNA, 1410 nt, Artificial Sequence; identical to SEQ ID NO: 138754
  derived and/or modified sequence opt3 from neuraminidase__InfluenzaA__ADD97554

SEQ ID NO: 140386 - RNA, 1410 nt, Artificial Sequence; identical to SEQ ID NO: 140370
  derived and/or modified sequence opt3 from neuraminidase__InfluenzaA__ADD97564

SEQ ID NO: 140387 - RNA, 1410 nt, Artificial Sequence; identical to SEQ ID NO: 138754
  derived and/or modified sequence opt3 from neuraminidase__InfluenzaA__ADD97574

SEQ ID NO: 140388 - RNA, 1410 nt, Artificial Sequence; identical to SEQ ID NO: 138754
  derived and/or modified sequence opt3 from neuraminidase__InfluenzaA__ADD97584

SEQ ID NO: 140389 - RNA, 1410 nt, Artificial Sequence
  derived and/or modified sequence opt3 from neuraminidase__InfluenzaA__ADD97681
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagauuaaugcccccaacuaucauuacgaagagugcaguuguuacccugauagcuccgagauaacuugcgucugccgcgacaauuggcacgggucuaacagaccauggguuagcuucaaucagaaccucgaauaucagaucggauacauuuguucaggcaucuuuggcgauaauccgaggcccaacgacaaaaccgggaguugcggaccuguguccagcaauggugcgaacggcguaaagggguucucuuuuaaguauggaaacggcguguggaucggucggacaaaaucaauuaguagccgcaauggguucgagaugauaugggauccaaacggcuggaccggaacggacaauaacuuuuccaucaagcaagacauugucggcaucaaugaauggucuggguacucggggagcuucgugcagcaucccgagcugacuggucuggauuguauucgaccuugcuucuggguugaacucaucagaggcaggccaaaagagaacacaauauggaccuccgggucaaguaucucuuuuuguggaauuaauagcgacacugugggcugguccuggcccgauggugcagaguuaccguucacaaucgacaaguga

SEQ ID NO: 140390 - RNA, 1410 nt, Artificial Sequence; identical to SEQ ID NO: 140346
  derived and/or modified sequence opt3 from neuraminidase__InfluenzaA__ADD97691

SEQ ID NO: 140391 - RNA, 1410 nt, Artificial Sequence; identical to SEQ ID NO: 139891
  derived and/or modified sequence opt3 from neuraminidase__InfluenzaA__ADD97701

SEQ ID NO: 140392 - RNA, 1410 nt, Artificial Sequence; identical to SEQ ID NO: 138754
  derived and/or modified sequence opt3 from neuraminidase__InfluenzaA__ADD97891

SEQ ID NO: 140393 - RNA, 1410 nt, Artificial Sequence; identical to SEQ ID NO: 138754
  derived and/or modified sequence opt3 from neuraminidase__InfluenzaA__ADD97901

SEQ ID NO: 140394 - RNA, 1410 nt, Artificial Sequence; identical to SEQ ID NO: 138754
  derived and/or modified sequence opt3 from neuraminidase__InfluenzaA__ADD97911

SEQ ID NO: 140395 - RNA, 1410 nt, Artificial Sequence; identical to SEQ ID NO: 138754
  derived and/or modified sequence opt3 from neuraminidase__InfluenzaA__ADD97921

SEQ ID NO: 140396 - RNA, 1410 nt, Artificial Sequence; identical to SEQ ID NO: 138754
  derived and/or modified sequence opt3 from neuraminidase__InfluenzaA__ADD97931

SEQ ID NO: 140397 - RNA, 1410 nt, Artificial Sequence; identical to SEQ ID NO: 139521
  derived and/or modified sequence opt3 from neuraminidase__InfluenzaA__ADD97941

SEQ ID NO: 140398 - RNA, 1410 nt, Artificial Sequence
  derived and/or modified sequence opt3 from neuraminidase__InfluenzaA__ADD97951
augaaccccaaucagaagaucauuaccauaagcuccgugugcaugacaaucggcauggccaaccugauucuccaaaucgggaauauuaucucuauauggaucucacacaguauucagcuuggaaaccagaaucagaucgagacuuguaaccaaagcgucauuacguacgaaaauaacaccuggguuaaucagacauaugugaacaucuccaauacuaacuucgcugcaggucagucuguagugucggucaaacuggccggcaauagcagcuugugcccugugagugggugggcgauauacuccaaggacaacucuauuagaaucggaagcaaaggcgauguuuuugugauuagggagccauucaucuccuguucaccguuagaaugccggaccuuuuuccugacacagggugcucuacucaaugacaagcauaguaacgggaccaucaaagaucgcagccccuaucgaacucugaugucuuguccuauuggagaggucccaucccccuacaacucacguuuugaaagcguggccuggagugcaucugccugccacgacggcauaaauuggcuuacaaucggcauuuccgggccugauaacggagcuguagcaguucugaaguauaaugguaucauaaccgacacgauuaagagcuggagaaacaauaucuugaggacucaagagucggagugugccugcgugaacggcucuuguuucaccgucaugacagaugggccauccgacggacaggcuucauacaaaaucuuucggauugaaaagggcaaaaucgugaagaguguggagaugaaugcccccaacuaucauuacgaagagugcagcuguuacccugauuccucugagauuacuugcgucugccgcgacaauuggcacgguagcaacagaccauggguuucauucaaucagaaccucgaauaucagauaggguacaucuguaguggaauuuuuggcgauaauccgaggcccaacgacaaaaccggcuccugcgggccugugagcucuaauggagcgaacgguguaaagggcuucucauuuaaguaugggaacggaguguggaucggccggacaaaaaguaucagcucccgcaaugguuucgagaugauuugggauccaaacggguggaccggcacggacaauaacuuuucuauaaagcaagacaucgucggaauuaaugaauggucgggcuacagcggguccuucgugcagcaucccgagcugacuggacuggauuguauccgaccuugcuucuggguugaacucauuagagguaggccaaaagagaacacaaucuggaccucaggcaguucuauaucauuuuguggggucaauuccgacacugugggauggucauggcccgauggcgcagaguuaccguucacaaucgacaaguga

SEQ ID NO: 140399 - RNA, 1410 nt, Artificial Sequence
  derived and/or modified sequence opt3 from neuraminidase__InfluenzaA__ADD97961
augaaccccaaucagaagaucauuaccauaggcagcgugugcaugacaaucgggauggucaaccugauucuccaaaucggaaauauuaucuccauauggaucucucacucaauucagcuugguaaccagaaucagaucgagacuuguaaccaaaguguuauuacguacgaaaauaacaccugggugaaucagacauauguaaacaucagcaauacuaacuucgccgcuggccaguccguggucucugugaaacuggcagggaaugccucguugugcccuguuucaggaugggcgauauacagcaaggacaacaguauuagaaucggcuccaaaggugauguguuugucauuagggagccauucaucucuuguagcccguuagaaugccggaccuuuuuccugacacagggggcucuacucaaugacaagcauuccaacggaaccaucaaagaucgcucacccuaucgaacucugaugaguuguccuauuggcgaggugccaagccccuacaacucucguuuugaauccguagccuggucagcaagcgccugccacgacggcauaaauuggcuuacaaucgggauuaguggaccugauaacggugcuguugcagugcugaaguauaauggcaucauaaccgacacgauuaagucuuggagaaacaauaucuugaggacucaagaguccgagugugccugcgucaacgggagcuguuucaccgugaugacagauggaccaucggacggccaggcuucuuacaaaaucuuucggauugaaaaggguaaaaucgugaaguccgucgagaugaaugcccccaacuaucauuacgaagagugcucauguuacccugauaguagcgagauuacuugcguuugccgcgacaauuggcacggguccaacagaccaugggugucuuucaaucagaaccucgaauaucagauaggauacaucuguagcggcauuuuuggcgauaauccgaggcccaacgacaaaaccgggucaugcggaccuguaaguuccaauggugcgaacggcgugaagggguucagcuuuaaguauggaaacggcgucuggaucggucggacaaaaucuaucucaagucgcaauggguucgagaugauuugggauccaaacggcuggaccggaacggacaauaacuuuagcauaaagcaagacaucgugggcauuaaugaaugguccggguacucuggaucguucguucagcaucccgagcugacuggucuggauuguauccgaccuugcuucuggguggaacucauuagaggcaggccaaaagagaacacaaucuggaccagcggguccucaauaaguuuuuguggagucaauucugacacugugggcuggagcuggcccgauggugcagaguuaccguucacaaucgacaaguga

SEQ ID NO: 140400 - RNA, 1410 nt, Artificial Sequence; identical to SEQ ID NO: 140346
  derived and/or modified sequence opt3 from neuraminidase__InfluenzaA__ADD97971

SEQ ID NO: 140401 - RNA, 1410 nt, Artificial Sequence; identical to SEQ ID NO: 138754
  derived and/or modified sequence opt3 from neuraminidase__InfluenzaA__ADD97981

SEQ ID NO: 140402 - RNA, 1410 nt, Artificial Sequence
  derived and/or modified sequence opt3 from neuraminidase__InfluenzaA__ADD97991
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggauaggaaccgacaauaacuuuuccaucaagcaagacauugucggcaucaaugaauggucuggguacucggggagcuucgugcagcaucccgagcugacgggucuggauuguauucgaccuugcuucuggguugaacucaucagaggcaggccaaaagagaacacuauauggacauccgggucaaguaucucuuuuuguggagugaauagcgacaccgucggcugguccuggcccgauggugcagaguuaccguucacuauugacaaguga

SEQ ID NO: 140403 - RNA, 1410 nt, Artificial Sequence
  derived and/or modified sequence opt3 from neuraminidase__InfluenzaA__ADD98001
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacggugaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 140404 - RNA, 1410 nt, Artificial Sequence; identical to SEQ ID NO: 138754
  derived and/or modified sequence opt3 from neuraminidase__InfluenzaA__ADD98011

SEQ ID NO: 140405 - RNA, 1410 nt, Artificial Sequence; identical to SEQ ID NO: 138754
  derived and/or modified sequence opt3 from neuraminidase__InfluenzaA__ADD98031

SEQ ID NO: 140406 - RNA, 1410 nt, Artificial Sequence; identical to SEQ ID NO: 140403
  derived and/or modified sequence opt3 from neuraminidase__InfluenzaA__ADD98041

SEQ ID NO: 140407 - RNA, 1410 nt, Artificial Sequence; identical to SEQ ID NO: 138754
  derived and/or modified sequence opt3 from neuraminidase__InfluenzaA__ADD98051

SEQ ID NO: 140408 - RNA, 1410 nt, Artificial Sequence; identical to SEQ ID NO: 138754
  derived and/or modified sequence opt3 from neuraminidase__InfluenzaA__ADD98061

SEQ ID NO: 140409 - RNA, 1410 nt, Artificial Sequence; identical to SEQ ID NO: 138754
  derived and/or modified sequence opt3 from neuraminidase__InfluenzaA__ADD98071

SEQ ID NO: 140410 - RNA, 1410 nt, Artificial Sequence; identical to SEQ ID NO: 138754
  derived and/or modified sequence opt3 from neuraminidase__InfluenzaA__ADD98081

SEQ ID NO: 140411 - RNA, 1410 nt, Artificial Sequence; identical to SEQ ID NO: 138754
  derived and/or modified sequence opt3 from neuraminidase__InfluenzaA__ADD98091

SEQ ID NO: 140412 - RNA, 1410 nt, Artificial Sequence; identical to SEQ ID NO: 139580
  derived and/or modified sequence opt3 from neuraminidase__InfluenzaA__ADD98101

SEQ ID NO: 140413 - RNA, 1410 nt, Artificial Sequence
  derived and/or modified sequence opt3 from neuraminidase__InfluenzaA__ADD98111
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauucugggcgauaauccgaggcccaacgacaaaaccgggaguugcggaccuguguccagcaauggugcgaacggcguaaagggguuuucuuucaaguauggaaacggcguguggaucggucggacaaaaucaaucaguagccgcaauggguuugagaugauuugggauccaaacggcuggaccggaacggacaauaacuucuccauaaagcaagacaucgucggcauuaaugaauggucuggguacucggggagcuuugugcagcaucccgagcugacuggucucgauuguauccgaccuugcuucuggguugaauuaauuagaggcaggccaaaagagaacacaaucuggaccuccgggucaaguauaucuuucuguggagugaauagcgacacugucggcugguccuggcccgauggugcagagcugccguuuacaaucgacaaguga

SEQ ID NO: 140414 - RNA, 1410 nt, Artificial Sequence; identical to SEQ ID NO: 138754
  derived and/or modified sequence opt3 from neuraminidase__InfluenzaA__ADD98121

SEQ ID NO: 140415 - RNA, 1410 nt, Artificial Sequence; identical to SEQ ID NO: 138754
  derived and/or modified sequence opt3 from neuraminidase__InfluenzaA__ADD98131

SEQ ID NO: 140416 - RNA, 1410 nt, Artificial Sequence; identical to SEQ ID NO: 138754
  derived and/or modified sequence opt3 from neuraminidase__InfluenzaA__ADD98141

SEQ ID NO: 140417 - RNA, 1410 nt, Artificial Sequence; identical to SEQ ID NO: 138754
  derived and/or modified sequence opt3 from neuraminidase__InfluenzaA__ADD98151

SEQ ID NO: 140418 - RNA, 1410 nt, Artificial Sequence
  derived and/or modified sequence opt3 from neuraminidase__InfluenzaA__ADD98161
augaaccccaaucagaagaucauuaccauaggcagcgugugcaugacaaucgggauggccaaccugauucuccaaaucggaaauauuaucuccauauggaucucucacacuauucagcuugguaaccagaaucagaucgagacguguaaccaaucagucauuaccuacgaaaauaacacauggguuaaucagacuuaugugaacaucaguaauaccaacuucgcugcaggccagagcguaguguccgucaaacuggccggaaauucuucguugugcccugugucagggugggcgauauacagcaaggacaacaguauuagaaucggcuccaaaggugauguuuuugugauuagggagccauucaucucuuguagcccguuagaaugccggacauuuuuccugacccagggggcucuacucaaugacaagcauuccaacggaacuaucaaagaucgcucacccuaucgaacacugaugaguuguccuauuggcgaggucccaagccccuacaacucucguuuugaauccguggccuggucagcaagcgccugccacgacggcauaaauuggcuuaccaucgggauuaguggaccugauaacggugcuguagcaguucugaaguauaauggcaucauaacggacacuauuaagucuuggagaaacaauaucuugaggacccaagaguccgagugugccugcgugaacgggagcuguuucacagucaugacugauggaccaucggacggccaggcuucuuacaaaaucuuucggauugaaaaggguaaaaucgugaaguccguggagaugaaugcccccaacuaucauuacgaagagugcucauguuacccugauaguagcgagauuaccugcgucugccgcgacaauuggcacggguccaacagaccauggguuucuuucaaucagaaccucgaauaucagauaggauacaucuguagcggcauuuuuggcgauaauccgaggcccaacgacaaaacagggucaugcggaccugugaguuccaauggugcgaacggcguaaagggguucagcuuuaaguauggaaacggcguguggaucggucggaccaaaucuaucucaagucgcaauggguucgagaugauuugggauccaaacggcuggacgcgaacugacaauaacuuuagcauaaagcaagacaucgucggaauuaaugaaugguccggcuacucugggucguucgugcagcaucccgagcugacaggacuggauuguaucagaccuugcuucuggguugaacucauuaggggucggccaaaagagaacaccaucuggacuagcggcuccucaauaaguuuuuguggggucaauucugacacagugggauggagcuggcccgauggcgcagaguuaccguucaccaucgacaaguga

SEQ ID NO: 140419 - RNA, 1410 nt, Artificial Sequence
  derived and/or modified sequence opt3 from neuraminidase__InfluenzaA__ADD98171
augaaccccaaucagaagaucauuauaaucggcagcgugugcaugaccauugggauggccaaccugauccuccaaauuggaaauaucauauccaucuggauuucucacucaauccagcuugguaaccagaaucagauugagacauguaaccaaagugucaucacuuacgaaaauaacacguggguuaaucagaccuaugugaacauaagcaauacaaacuucgcugcaggccagacuguaguguccgucaaacuggccggaaauucuucguugugcccugugucaggaugggcgauuuacagcaaggacaacaguaucagaauuggcuccaaaggugauguuuuugugaucagggagccauucaucucuuguagcccguuagaaugccggaccuuuuuccugacacagggggcucuacucaaugacaagcauuccaacggaaccauuaaagaucgcucacccuaucgaacucugaugaguuguccuauaggcgaggucccaagccccuacaacucucguuuugaauccguggccuggucagcaagcgccugccacgacggcaucaauuggcuuacaauugggaucaguggaccugauaacggugcuguagcaguucugaaguauaauggcauaauuaccgacacgaucaagucuuggagaaacaauaucuugaggacucaagaguccgagugugccugcgugaacgggagcuguuucaccgucaugacagauggaccaucggacggccaggcuucuuacaaaauuuuucggaucgaaaaggguaaaauugugaaguccguggagaugaaugcccccaacuaucauuacgaagagugcucauguuacccugauaguagcgagauaacuugcgucugccgcgacaauuggcacggguccaacagaccauggguuucuuucaaucagaaccucgaauaucagaucggauacauuuguagcggcaucuuuggcgauaauccgaggucaaacgacaaaaccgggaguugcggacccguguccagcaauggugcgaacggcguaaagggguucucuuuuaaguauggaaacggcguguggaucggucggacaaaaucaauuaguagccgcaauggguucgagaugauaugggauccuaacggcuggaccggaacggacaauaacuuuuccaucaagcaagacauugucggcaucaaugaauggucuggguacucggggagcuucgugcagcauccagagcugacuggucuggauuguauucgacccugcuucuggguugaacucaucagaggcaggccuaaagagaacacaauauggaccuccgggucaaguaucucuuuuuguggagugaauagcgacacugucggcugguccuggccagauggugcagaguuacccuucacaauugacaaguga

SEQ ID NO: 140420 - RNA, 1410 nt, Artificial Sequence
  derived and/or modified sequence opt3 from neuraminidase__InfluenzaA__ADD98181
augaaccccaaucagaagaucauuaccauaggcagcgugugcaugacaaucgggauggccaaccugauucuccaaaucggaaauaugauuuccaucuggauaucucacucaauccagcuugagaaccagaaucagauugaaacuuguaaccaaagugucaucacguacgagaauaacaccuggguuaaucagacauaugugaacauuagcaauacuaacuucgcugcaggucaguccguagugucugucaaacuggccggcaauucgucauugugcccugugagcgggugggcgaucuacaguaaggacaacuccauaagaauuggaucuaaaggcgauguuuuugugaucagggaaccauucauuagcuguuccccguuagagugccggaccuuuuuccugacacagggugcucuacucaaugacaagcauucaaacgggaccaucaaagaucgcagucccuaucgaacucugaugagcuguccuaucggagaagucccaucucccuacaacucccguuuugagucaguggccuggagcgcaagugccugccacgacggcauuaauuggcuuacaauaggcaucucugggccugauaacggagcuguagcaguucugaaguauaaugguauuaucaccgacacgauaaaguccuggagaaacaauauuuugaggacucaagagagcgaaugugccugcgugaacggcucguguuucaccgucaugacagaugggccaucugacggacaggcuuccuacaaaaucuuucggaucgagaagggcaaaauugugaagucaguggaaaugaaugcccccaacuaucauuacgaggagugcaguuguuacccugauagcuccgaaaucacuugcgucugccgcgacaauuggcacgguucuaacagaccauggguuagcuucaaucagaaccucgaguaucagauuggguacauauguucaggaaucuuuggcgauaauccgaggcccaacgacaaaaccggcaguugcgggccuguguccagcaauggagcgaacgguguaaagggcuucucuuuuaaguaugggaacggaguguggauuggccggacaaaaucaaucaguagccgcaaugguuucgaaaugaucugggauccaaacggguggaccggcacggacaauaacuuuuccauuaagcaagacauagucggaaucaaugaguggucuggcuacucggggagcuucgugcagcaucccgaacugacuggacuggauuguauucgaccuugcuucuggguugagcucaucagagguaggccaaaagagaacacaauuuggaccuccggcucaaguaucucuuuuuguggggugaauagcgacacugucggaugguccuggcccgauggcgcagaauuaccguucacaauagacaaguga

SEQ ID NO: 140421 - RNA, 1410 nt, Artificial Sequence; identical to SEQ ID NO: 138754
  derived and/or modified sequence opt3 from neuraminidase__InfluenzaA__ADD98201

SEQ ID NO: 140422 - RNA, 1410 nt, Artificial Sequence; identical to SEQ ID NO: 138754
  derived and/or modified sequence opt3 from neuraminidase__InfluenzaA__ADD98211

SEQ ID NO: 140423 - RNA, 1410 nt, Artificial Sequence; identical to SEQ ID NO: 139977
  derived and/or modified sequence opt3 from neuraminidase__InfluenzaA__ADE20324

SEQ ID NO: 140424 - RNA, 1410 nt, Artificial Sequence; identical to SEQ ID NO: 139977
  derived and/or modified sequence opt3 from neuraminidase__InfluenzaA__ADE20334

SEQ ID NO: 140425 - RNA, 1410 nt, Artificial Sequence; identical to SEQ ID NO: 139977
  derived and/or modified sequence opt3 from neuraminidase__InfluenzaA__ADE20344

SEQ ID NO: 140426 - RNA, 1410 nt, Artificial Sequence; identical to SEQ ID NO: 139977
  derived and/or modified sequence opt3 from neuraminidase__InfluenzaA__ADE20354

SEQ ID NO: 140427 - RNA, 1410 nt, Artificial Sequence; identical to SEQ ID NO: 139977
  derived and/or modified sequence opt3 from neuraminidase__InfluenzaA__ADE20378

SEQ ID NO: 140428 - RNA, 1410 nt, Artificial Sequence; identical to SEQ ID NO: 139977
  derived and/or modified sequence opt3 from neuraminidase__InfluenzaA__ADE20391

SEQ ID NO: 140429 - RNA, 1410 nt, Artificial Sequence; identical to SEQ ID NO: 139977
  derived and/or modified sequence opt3 from neuraminidase__InfluenzaA__ADE20631

SEQ ID NO: 140430 - RNA, 1410 nt, Artificial Sequence; identical to SEQ ID NO: 139977
  derived and/or modified sequence opt3 from neuraminidase__InfluenzaA__ADE20641

SEQ ID NO: 140431 - RNA, 1410 nt, Artificial Sequence
  derived and/or modified sequence opt3 from neuraminidase__InfluenzaA__ADE20651
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggugggaaauucgucauugugcccuguuagcggaugggccauauacaguaaggacaacuccgugagaauuggcucuaaaggugaugucuuugugaucagggagccauucauuagcuguuccccguuagaaugccggaccuuuuuccugacacagggggcgcuacucaaugacaagcauucaaacggaaccaucaaagaucgcagucccuaucgaacucugaugagcuguccuaucggcgagguaccaucucccuacaacucccguuuugaaucaguugcuuggagcgccagugcaugccacgacggcauuaauuggcuuacaauagggaucucuggaccugauaacggugccguggcuguccugaaguauaauggcauuaucaccgacacgauaaaguccuggagaaacaauauuuugaggacucaagagagcgagugugcaugcgugaacgggucguguuucaccgugaugacagauggaccaucugacggccaggccuccuacaaaaucuuucggaucgaaaaggguaaaauugucaagucaguugagaugaaugcucccaacuaucauuacgaagagugcaguuguuacccugauagcuccgagaucacuugcgugugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugccaacggcgucaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauaguuggcaucaaugaauggucuggguacucggggagcuucgugcagcaucccgagcugacuggucuggauuguauucgaccuugcuucugggucgaacucaucagaggcaggccaaaagagaacacaauuuggaccuccgggucaaguaucucuuuuuguggagugaauagcgacacuguaggcugguccuggcccgauggugcggaguuaccguucacaauagacaaguga

SEQ ID NO: 140432 - RNA, 1410 nt, Artificial Sequence; identical to SEQ ID NO: 139977
  derived and/or modified sequence opt3 from neuraminidase__InfluenzaA__ADE20661

SEQ ID NO: 140433 - RNA, 1410 nt, Artificial Sequence; identical to SEQ ID NO: 139977
  derived and/or modified sequence opt3 from neuraminidase__InfluenzaA__ADE20671

SEQ ID NO: 140434 - RNA, 1410 nt, Artificial Sequence; identical to SEQ ID NO: 139977
  derived and/or modified sequence opt3 from neuraminidase__InfluenzaA__ADE20681

SEQ ID NO: 140435 - RNA, 1410 nt, Artificial Sequence
  derived and/or modified sequence opt3 from neuraminidase__InfluenzaA__ADE20701
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcgucauuaccgacacgaucaaguccuggagaaacaauauauugaggacucaagagagcgagugugccugcgugaacgggucguguuucaccgugaugacagauggaccaucuaauggccaggcuuccuacaaaauuuuucggaucgaaaaggguaaaaucgucaagucaguugagaugaacgcccccaauuaucauuacgaagagugcaguuguuacccugacagcuccgagauuacuugcgugugccgcgauaacuggcacgggucuaauagaccaugggugagcuucaaccagaaucucgaauaucagaucggauacauuuguucaggcauauuuggcgacaacccgaggcccaaugauaaaaccgggaguugcggaccuguauccagcaacggugcgaacggcgucaagggguucucuuuuaaguauggaaauggcguguggaucggucggacaaaaucaauuaguagccgcaacggguucgagaugaucugggacccaaauggcuggaccggaacggauaacaauuuuuccaucaagcaagacauuguuggcauaaacgaauggucuggguacucggggagcuucgugcagcaucccgagcugacuggucuggacuguauccgaccuugcuucugggucgaacucauuagaggcaggccaaaagagaauacaaucuggaccuccgggucaaguauuucuuuuuguggagugaacagcgauacuguaggcugguccuggcccgacggugcagaguuaccguucacaaucgauaaguga

SEQ ID NO: 140436 - RNA, 1410 nt, Artificial Sequence; identical to SEQ ID NO: 139977
  derived and/or modified sequence opt3 from neuraminidase__InfluenzaA__ADE20711

SEQ ID NO: 140437 - RNA, 1410 nt, Artificial Sequence
  derived and/or modified sequence opt3 from neuraminidase__InfluenzaA__ADE20721
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggugggaaauucgucauugugcccuguuagcggaugggccauauacaguaaggacaacuccgugagaauuggcucuaaaggugaugucuuugugaucagggagccauucauuagcuguuccccguuagaaugccggaccuuuuuccugacacagggggcgcuacucaaugacaagcauucaaacggaaccaucaaagaucgcagucccuaucgaacucugaugagcuguccuaucggcgagguaccaucucccuacaacucccguuuugaaucaguugcuuggagcgccagugcaugccacgacggcauuaauuggcuuacaauagggaucucuggaccugauaacggugccguggcuguccugaaguauaauggcauuaucaccgacacgauaaaguccuggagaaacaauauuuugaggacucaagagagcgagugugcaugcgugaacgggucguguuucaccgugaugacagauggaccaucuaauggccaggccuccuacaaaaucuuucggaucgaaaaggguaaaauugucaagucaguugagaugaacgcucccaauuaucauuacgaagagugcaguuguuacccugacagcuccgagaucacuugcgugugccgcgauaacuggcacgggucuaauagaccaugggugagcuucaaccagaaucucgaauaucagauuggauacauauguucaggcaucuuuggcgacaacccgaggcccaaugauaaaaccgggaguugcggaccuguauccagcaacggugccaacggcgucaagggguucucuuuuaaguauggaaauggcguguggauuggucggacaaaaucaaucaguagccgcaacggguucgagaugaucugggacccaaauggcuggaccggaacggauaacaauuuuuccauuaagcaagacauaguuggcaucaacgaauggucuggguacucggggagcuucgugcagcaucccgagcugacuggucuggacuguauucgaccuugcuucugggucgaacucaucagaggcaggccaaaagagaauacaauuuggaccuccgggucaaguaucucuuuuuguggagugaacagcgauacuguaggcugguccuggcccgacggugcggaguuaccguucacaauagaucgguga

SEQ ID NO: 140438 - RNA, 1410 nt, Artificial Sequence; identical to SEQ ID NO: 140435
  derived and/or modified sequence opt3 from neuraminidase__InfluenzaA__ADE20731

SEQ ID NO: 140439 - RNA, 1410 nt, Artificial Sequence; identical to SEQ ID NO: 139977
  derived and/or modified sequence opt3 from neuraminidase__InfluenzaA__ADE20741

SEQ ID NO: 140440 - RNA, 1410 nt, Artificial Sequence; identical to SEQ ID NO: 139977
  derived and/or modified sequence opt3 from neuraminidase__InfluenzaA__ADE20751

SEQ ID NO: 140441 - RNA, 1410 nt, Artificial Sequence; identical to SEQ ID NO: 140435
  derived and/or modified sequence opt3 from neuraminidase__InfluenzaA__ADE20761

SEQ ID NO: 140442 - RNA, 1410 nt, Artificial Sequence; identical to SEQ ID NO: 140435
  derived and/or modified sequence opt3 from neuraminidase__InfluenzaA__ADE20781

SEQ ID NO: 140443 - RNA, 1410 nt, Artificial Sequence; identical to SEQ ID NO: 138754
  derived and/or modified sequence opt3 from neuraminidase__InfluenzaA__ADE20791

SEQ ID NO: 140444 - RNA, 1410 nt, Artificial Sequence; identical to SEQ ID NO: 138754
  derived and/or modified sequence opt3 from neuraminidase__InfluenzaA__ADE20801

SEQ ID NO: 140445 - RNA, 1410 nt, Artificial Sequence; identical to SEQ ID NO: 138754
  derived and/or modified sequence opt3 from neuraminidase__InfluenzaA__ADE20811

SEQ ID NO: 140446 - RNA, 1410 nt, Artificial Sequence; identical to SEQ ID NO: 138754
  derived and/or modified sequence opt3 from neuraminidase__InfluenzaA__ADE20821

SEQ ID NO: 140447 - RNA, 1410 nt, Artificial Sequence; identical to SEQ ID NO: 138754
  derived and/or modified sequence opt3 from neuraminidase__InfluenzaA__ADE20831

SEQ ID NO: 140448 - RNA, 1410 nt, Artificial Sequence; identical to SEQ ID NO: 138754
  derived and/or modified sequence opt3 from neuraminidase__InfluenzaA__ADE20841

SEQ ID NO: 140449 - RNA, 1410 nt, Artificial Sequence; identical to SEQ ID NO: 138754
  derived and/or modified sequence opt3 from neuraminidase__InfluenzaA__ADE20851

SEQ ID NO: 140450 - RNA, 1410 nt, Artificial Sequence; identical to SEQ ID NO: 140370
  derived and/or modified sequence opt3 from neuraminidase__InfluenzaA__ADE20861

SEQ ID NO: 140451 - RNA, 1410 nt, Artificial Sequence; identical to SEQ ID NO: 138754
  derived and/or modified sequence opt3 from neuraminidase__InfluenzaA__ADE20871

SEQ ID NO: 140452 - RNA, 1410 nt, Artificial Sequence; identical to SEQ ID NO: 140366
  derived and/or modified sequence opt3 from neuraminidase__InfluenzaA__ADE20881

SEQ ID NO: 140453 - RNA, 1410 nt, Artificial Sequence; identical to SEQ ID NO: 138754
  derived and/or modified sequence opt3 from neuraminidase__InfluenzaA__ADE20891

SEQ ID NO: 140454 - RNA, 1410 nt, Artificial Sequence; identical to SEQ ID NO: 138754
  derived and/or modified sequence opt3 from neuraminidase__InfluenzaA__ADE20901

SEQ ID NO: 140455 - RNA, 1410 nt, Artificial Sequence; identical to SEQ ID NO: 138754
  derived and/or modified sequence opt3 from neuraminidase__InfluenzaA__ADE20911

SEQ ID NO: 140456 - RNA, 1410 nt, Artificial Sequence; identical to SEQ ID NO: 138754
  derived and/or modified sequence opt3 from neuraminidase__InfluenzaA__ADE20921

SEQ ID NO: 140457 - RNA, 1410 nt, Artificial Sequence
  derived and/or modified sequence opt3 from neuraminidase__InfluenzaA__ADE20931
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccugugcuguccaauggugcgaacggcguaaagggguucagcuuuaaguauggaaacggcguguggaucggucggacaaaaucuaucgggucacgcaauggcuucgagaugauuugggauccaaacggauggaccggcacggacaauaacuuuaguauaaagcaagacaucgucgggauuaaugaauggagcggauacuccgguucuuucgugcagcaucccgagcugacuggccucgauuguauccgaccuugcuucuggguugaauuaauuagagggaggccaaaagagaacacaaucuggaccucgggaagcuccauaucauuuuguggcgugaauagugacacugucgguuggucuuggcccgauggggcagagcugccguucacaaucgacaaguga

SEQ ID NO: 140458 - RNA, 1410 nt, Artificial Sequence; identical to SEQ ID NO: 138754
  derived and/or modified sequence opt3 from neuraminidase__InfluenzaA__ADE20941

SEQ ID NO: 140459 - RNA, 1410 nt, Artificial Sequence
  derived and/or modified sequence opt3 from neuraminidase__InfluenzaA__ADE20951
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacgucgugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 140460 - RNA, 1410 nt, Artificial Sequence
  derived and/or modified sequence opt3 from neuraminidase__InfluenzaA__ADE20961
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaaugacaucauaaccgauacgauuaaguccuggagaaacaauaucuugaggacucaagagagcgagugugccugcgugaacggcucguguuucaccgucaugacagacgggccaucugauggacaggcuuccuacaaaaucuuucggauugaaaagggcaaaaucgugaagucaguggagaugaaugcccccaacuaucauuacgaagagugcaguuguuacccugacagcuccgagauuacuugcgucugccgcgauaauuggcacgguucuaacagaccauggguuagcuucaaucagaaccucgaauaucagauaggguacaucuguucaggaauuuuuggcgacaauccgaggcccaacgauaaaaccggcaguugcgggccuguguccagcaauggagcgaacgguguaaagggcuucucuuuuaaguaugggaacggaguguggaucggccggacaaaaucaaucaguagccgcaaugguuucgagaugauuugggacccaaacggguggaccggcacggacaauaacuuuuccauaaagcaagauaucgucggaauuaaugaauggucuggcuacucggggagcuucgugcagcaucccgagcugacuggacuggacuguauccgaccuugcuucuggguugaacucauuagagguaggccaaaagagaacacaaucuggaccuccggcucaaguauaucuuuuuguggggugaauagcgauacugucggaugguccuggcccgacggcgcagaguuaccguucacaaucgauaaguga

SEQ ID NO: 140461 - RNA, 1410 nt, Artificial Sequence; identical to SEQ ID NO: 138754
  derived and/or modified sequence opt3 from neuraminidase__InfluenzaA__ADE20971

SEQ ID NO: 140462 - RNA, 1410 nt, Artificial Sequence; identical to SEQ ID NO: 140370
  derived and/or modified sequence opt3 from neuraminidase__InfluenzaA__ADE20981

SEQ ID NO: 140463 - RNA, 1410 nt, Artificial Sequence; identical to SEQ ID NO: 138754
  derived and/or modified sequence opt3 from neuraminidase__InfluenzaA__ADE20991

SEQ ID NO: 140464 - RNA, 1410 nt, Artificial Sequence
  derived and/or modified sequence opt3 from neuraminidase__InfluenzaA__ADE21001
augaaccccaaucagaagaucauuaccauaggcagcgugugcaugacaaucgggauggccaaccugauucuccaaaucggaaauauuaucuccauauggaucucucacacuauucagcuugguaaccagaaucagaucgagacguguaaccaaucagucauuaccuacgaaaauaacacauggguuaaucagacuuaugugaacaucaguaauaccaacuucgcugcaggccagagcguaguguccgucaaacuggccggaaauucuucguugugcccugugucagggugggcgauauacagcaaggacaacaguauuagaaucggcuccaaaggugauguuuuuauuaucagggagccauucaucucuuguagcccguuagaaugccggacauuuuuccugacccagggggcucuacucaaugacaagcauuccaacggaacuauuaaagaucgcucacccuaucgaacacugaugaguuguccuauaggcgaggugccaagccccuacaacucucguuuugaauccgucgccuggucagcaagcgccugccacgacggcaucaauuggcuuaccauugggaucaguggaccugauaacggugcuguggcaguacugaaguauaauggcauaauuacggacacuaucaagucuuggagaaacaauaucuugaggacccaagaguccgagugugccugcguuaacgggagcuguuucacagugaugacugauggaccaucggacggccaggcuucuuacaaaauuuuucggaucgaaaaggguaaaauugucaaguccguggagaugaaugcccccaacuaucauuacgaagagugcucauguuacccugauaguagcgagauaaccugcgugugccgcgacaauuggcacggguccaacagaccaugggucucuuucaaucagaaccucgaauaucagaucggauacauuuguagcggcaucuuuggcgauaauccgaggcccaacgacaaaacagggucaugcggaccuguuaguuccaauggugcgaacggcgugaagggguucagcuuuaaguauggaaacggcguauggaucggucggaccaaaucuauuucaagucgcaauggguucgagaugauaugggauccaaacggcuggacgggaacugacaauaacuuuagcaucaagcaagacauugugggcaucaaugaaugguccggguacucuggaucguucguccagcaucccgagcugacaggucuggauuguauucgaccuugcuucuggguggaacucaucagaggcaggccaaaagagaacaccauauggacuagcggguccucaaucaguuuuuguggaguuaauucugacacagugggcuggagcuggcccgauggugcagaguuaccguucaccauugacaaguga

SEQ ID NO: 140465 - RNA, 1410 nt, Artificial Sequence; identical to SEQ ID NO: 138754
  derived and/or modified sequence opt3 from neuraminidase__InfluenzaA__ADE21011

SEQ ID NO: 140466 - RNA, 1410 nt, Artificial Sequence; identical to SEQ ID NO: 138754
  derived and/or modified sequence opt3 from neuraminidase__InfluenzaA__ADE21021

SEQ ID NO: 140467 - RNA, 1410 nt, Artificial Sequence; identical to SEQ ID NO: 140403
  derived and/or modified sequence opt3 from neuraminidase__InfluenzaA__ADE21031

SEQ ID NO: 140468 - RNA, 1410 nt, Artificial Sequence
  derived and/or modified sequence opt3 from neuraminidase__InfluenzaA__ADE21041
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaauugagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaauggguucgagaugauaugggauccaaacggcuggaccggaacggacaauaacuuuuccaucaagcaagacauugugggcaucaaugaauggucuggguacucggggagcuucguccagcaucccgagcugacuggucuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 140469 - RNA, 1410 nt, Artificial Sequence; identical to SEQ ID NO: 138754
  derived and/or modified sequence opt3 from neuraminidase__InfluenzaA__ADE21051

SEQ ID NO: 140470 - RNA, 1410 nt, Artificial Sequence
  derived and/or modified sequence opt3 from neuraminidase__InfluenzaA__ADE21071
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugaacgggugggcgauauacagcaaggacaauaguauuagaaucggcuccaaaggugauguuuuugugauuagggagccauucaucucuuguagcccguuagaaugccggaccuuuuuccugacacagggggcucuacucaacgacaagcauuccaacggaaccaucaaagaucgcucacccuaucgaacucugaugaguuguccuauuggcgaggucccaagccccuacaauucucguuuugaauccguggccuggucagcaagcgccugccacgacggcauaaacuggcuuacaaucgggauuaguggaccugauaauggugcuguagcaguucugaaguauaacggcaucauaaccgacacgauuaagucuuggagaaauaacaucuugaggacucaagaguccgagugugccugcgugaaugggagcuguuucaccgucaugacagauggaccaucggacggccaggcuucuuacaaaaucuuucggauugaaaaggguaaaaucgugaaguccguggagaugaacgcccccaauuaucauuacgaagagugcucauguuacccugauaguagcgagauuacuugcgucugccgcgacaacuggcacggguccaauagaccauggguuucuuucaaccagaaucucgaauaucagauaggauacaucuguagcggcauuuuuggcgauaacccgaggcccaaugacaaaaccgggucaugcggaccugugaguuccaacggugcgaacggcguaaagggguucagcuuuaaguauggaaauggcguguggaucggucggacaaaaucuaucucaagucgcaacggguucgagaugauuugggauccaaauggcuggaccggaacggacaacaaguuuagcauaaaacaagacaucgucggcauuaaugaaugguccggguacucuggaucguucgugcagcaucccgagcugacuggucuggauuguauccgaccuugcuucuggguugaacucauuagaggcaggccaaaggagaacacaaucuggaccagcggguccucaauaaguuuuuguggagucaauucugacacugugggcuggagcuggcccgauggugcagaguuaccguucacaaucgacaaauga

SEQ ID NO: 140471 - RNA, 1413 nt, Artificial Sequence; identical to SEQ ID NO: 138648
  derived and/or modified sequence opt3 from neuraminidase__InfluenzaA__ADE28752

SEQ ID NO: 140472 - RNA, 1413 nt, Artificial Sequence; identical to SEQ ID NO: 139477
  derived and/or modified sequence opt3 from neuraminidase__InfluenzaA__ADE28763

SEQ ID NO: 140473 - RNA, 1410 nt, Artificial Sequence; identical to SEQ ID NO: 139977
  derived and/or modified sequence opt3 from neuraminidase__InfluenzaA__ADE28773

SEQ ID NO: 140474 - RNA, 1410 nt, Artificial Sequence; identical to SEQ ID NO: 139977
  derived and/or modified sequence opt3 from neuraminidase__InfluenzaA__ADE28783

SEQ ID NO: 140475 - RNA, 1410 nt, Artificial Sequence; identical to SEQ ID NO: 140435
  derived and/or modified sequence opt3 from neuraminidase__InfluenzaA__ADE28803

SEQ ID NO: 140476 - RNA, 1410 nt, Artificial Sequence; identical to SEQ ID NO: 138754
  derived and/or modified sequence opt3 from neuraminidase__InfluenzaA__ADE28813

SEQ ID NO: 140477 - RNA, 1410 nt, Artificial Sequence; identical to SEQ ID NO: 138754
  derived and/or modified sequence opt3 from neuraminidase__InfluenzaA__ADE28823

SEQ ID NO: 140478 - RNA, 1410 nt, Artificial Sequence
  derived and/or modified sequence opt3 from neuraminidase__InfluenzaA__ADE28843
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccugugggcgagguaccaucucccuacaacucccguuuugaaucaguugccuggagcgcaagugccugccacgacggcaucaauuggcuuacaauugggauaucuggaccugauaacggugcuguggcaguccugaaguauaauggcaucauuaccgacacgaucaaguccuggagaaacaauauauugaggacucaagagagcgagugugccugcgugaacgggucguguuucaccgugaugacagauggaccaucuaauggccaggcuuccuacaaaauuuuucggaucgaaaaggguaaaaucgucaagucaguugagaugaacgcccccaauuaucauuacgaagagugcaguuguuacccugacagcuccgagauuacuugcgugugccgcgauaacuggcacgggucuaauagaccaugggugagcuucaaccagaaucucgaauaucagaucggauacauuuguucaggcauauuuggcgacaacccgaggcccaaugauaaaaccgggaguugcggaccuguauccagcaacggugcgaacggcgucaagggguucucuuuuaaguauggaaauggcguguggaucggucggacaaaaucaauuaguagccgcaacggguucgagaugaucugggacccaaauggcuggaccggaacggauaacaauuuuuccaucaagcaagacauuguuggcauaaacgaauggucuggguacucggggagcuucgugcagcaucccgagcugacuggucuggacuguauccgaccuugcuucugggucgaacucauuagaggcaggccaaaagagaauacaaucuggaccuccgggucaaguauuucuuuuuguggagugaacagcgauacuguaggcugguccuggcccgacggugcagaguuaccguucacaaucgauaaguga

SEQ ID NO: 140479 - RNA, 1410 nt, Artificial Sequence
  derived and/or modified sequence opt3 from neuraminidase__InfluenzaA__ADE28853
augaaccccaaucagaagaucauuaccauagugagcgucugcaugacaaucggcauggccaaccugauucuccaaaucgggaauauuaucuccauauggaucucucacucaauucagcuuggaaaccagaaucagaucgagacuuguaaccaaaguguuauuacguacgaaaauaacaccugggugaaucagacauauguaaacaucagcaauacuaacuucgcugcaggucaguccguggucucugugaaacuggccggcaauucgucauugugcccuguuagcgggugggcgauauacaguaaggacaacuccgugagaauuggaucuaaaggcgaugucuuugugaucagggagccauucauuagcuguuccccguuagaaugccggaccuuuuuccugacacagggugcucuacucaaugacaagcauucaaacgggaccaucaaagaucgcagucccuaucgaacucugaugagcuguccuaucggagagguaccaucucccuacaacucccguuuugaaucaguugccuggagcgcaagugccugccacgacggcauuaauuggcuuacaauaggcaucucugggccugauaacggagcuguggcaguccugaaguauaaugguauuaucaccgacacgauaaaguccuggagaaacaauauuuugaggacucaagagagcgagugugccugcgugaacggcucguguuucaccgugaugacagaugggccaucuaauggacaggcuuccuacaaaaucuuucggaucgaaaagggcaaaauugucaagucaguugagaugaacgcccccaauuaucauuacgaagagugcaguuguuacccugacagcuccgagaucacuugcgugugccgcgauaacuggcacgguucuaauagaccaugggugagcuucaaccagaaucucgaauaucagauuggguacauauguucaggaaucuuuggcgacaacccgaggcccaaugauaaaaccggcaguugcgggccuguauccagcaacggagcgaacggugucaagggcuucucuuuuaaguaugggaauggaguguggauuggccggacaaaaucaaucaguagccgcaacgguuucgagaugaucugggacccaaauggguggaccggcacggauaacaauuuuuccauuaagcaagacauaguuggaaucaacgaauggucuggcuacucggggagcuucgugcagcaucccgagcugacuggacuggacuguauucgaccuugcuucugggucgaacucaucagagguaggccaaaagagaauacaauuuggaccuccggcucaaguaucucuuuuuguggggugaacagcgauacuguaggaugguccuggcccgacggcgcagaguuaccguucacaauagauaaguga

SEQ ID NO: 140480 - RNA, 1410 nt, Artificial Sequence; identical to SEQ ID NO: 140478
  derived and/or modified sequence opt3 from neuraminidase__InfluenzaA__ADE28884

SEQ ID NO: 140481 - RNA, 1410 nt, Artificial Sequence
  derived and/or modified sequence opt3 from neuraminidase__InfluenzaA__ADE28894
augaaccccaaucagaagaucauuaccauaggcagcgugugcaugacaaucgggauggccaaccugauucuccaaaucggaaauauuaucuccauauggaucucucacucaguccagcuugguaaccagaaucagauugagacuuguaaccaaaguguuaucacguacgaaaauaacaccugggugaaucagacauauguaaacauuagcaauacuaacuucgcugcaggccaguccguggucucugugaaacuggccggaaauucgucauugugcccuguuagcggaugggcgaucuacaguaaggacaacuccgugagaauaggcucuaaaggugaugucuuugugauuagggagccauucaucagcuguuccccguuagaaugccggaccuuuuuccugacacagggggcucuacucaaugacaagcauucaaacggaaccauuaaagaucgcagucccuaucgaacucugaugagcuguccuaucggcgagguaccaucucccuacaacucccguuuugaaucaguugccuggagcgcaagugccugccacgacggcaucaauuggcuuacaauugggauaucuggaccugauaacggugcuguggcaguccugaaguauaauggcaucauuaccgacacgaucaaguccuggagaaacaauauauugaggacucaagagagcgagugugccugcgugaacgggucguguuucaccgugaugacagauggaccaucuaauggccaggcuuccuacaaaauuuuucggaucgaaaaggguaaaaucgucaagucaguugagaugaacgcccccaauuaucauuacgaagagugcaguuguuacccugacagcuccgagauuacuugcgugugccgcgauaacuggcacgggucuaauagaccaugggugagcuucaaccagaaucucgaauaucagaucggauacauuuguucaggcauauuuggcgacaacccgaggcccaaugauaaaaccgggaguugcggaccuguauccagcaacggugcgaacggcgucaagggguucucuuuuaaguauggaaauggcguguggaucggucggacaaaaucaauuaguagccgcaacggguucgagaugaucugggacccaaauggcuggaccggaacggauaacaauuuuuccaucaagcaagacauuguuggcauaaacgaauggucuggguacucggggagcuucgugcagcaucccgagcugacuggucuggacuguauccgaccuugcuucugggucgaacucauuagaggcaggccaaaagagaauacaaucuggaccuccgggucaaguauuucuuuuuguggagugaacagcgauacuguaggcugguccuggcccgacggugcagaguuaccguucacaaucgauaaguga

SEQ ID NO: 140482 - RNA, 1410 nt, Artificial Sequence; identical to SEQ ID NO: 140402
  derived and/or modified sequence opt3 from neuraminidase__InfluenzaA__ADE28904

SEQ ID NO: 140483 - RNA, 1410 nt, Artificial Sequence; identical to SEQ ID NO: 138754
  derived and/or modified sequence opt3 from neuraminidase__InfluenzaA__ADE28914

SEQ ID NO: 140484 - RNA, 1410 nt, Artificial Sequence; identical to SEQ ID NO: 138754
  derived and/or modified sequence opt3 from neuraminidase__InfluenzaA__ADE28924

SEQ ID NO: 140485 - RNA, 1410 nt, Artificial Sequence
  derived and/or modified sequence opt3 from neuraminidase__InfluenzaA__ADE28934
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcaucaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaauggguucgagaugauaugggauccaaacggcuggaccggaacggacaauaacuuuuccaucaagcaagacauugugggcaucaaugaauggucuggguacucggggagcuucguccagcaucccgagcugacuggucuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 140486 - RNA, 1410 nt, Artificial Sequence; identical to SEQ ID NO: 138754
  derived and/or modified sequence opt3 from neuraminidase__InfluenzaA__ADE28954

SEQ ID NO: 140487 - RNA, 1410 nt, Artificial Sequence
  derived and/or modified sequence opt3 from neuraminidase__InfluenzaA__ADE28964
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauauaaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggucccaucucccuacaacucccguuuugaaucaguggccuggagcgcaagugccugccacgacggcaucaauuggcuuacuauugggaucucuggaccugauaacggugcuguagcaguucugaaguauaauggcauaauuacagacaccaucaaguccuggagaaacaauaucuugaggacgcaagagagcgagugugccugcgugaacgggucguguuucacugucaugaccgauggaccaucugacggccaggcuuccuacaaaauuuuucggaucgaaaaggguaaaauugugaagucaguggagaugaaugcccccaacuaucauuacgaagagugcaguuguuacccugauagcuccgagauaacaugcgucugccgcgacaauuggcacgggucuaacagaccauggguuagcuucaaucagaaccucgaauaucagaucggauacauuuguucaggcaucuuuggcgauaauccgaggcccaacgacaaaacugggaguugcggaccuguguccagcaauggugcgaacggcguaaagggguucucuuuuaaguauggaaacggcguguggaucggucggaccaaaucaauuaguagccgcaauggguucgagaugauaugggauccaaacggcuggacaggaaccgacaauaacuuuuccaucaagcaagacauugucggcaucaaugaauggucuggguacucggggagcuucgugcagcaucccgagcugacgggucuggauuguauucgaccuugcuucuggguugaacucaucagaggcaggccaaaagagaacacuauauggacauccgggucaaguaucucuuuuuguggagugaauagcgacaccgucggcugguccuggcccgauggugcagaguuaccguucacuauugacaaguga

SEQ ID NO: 140488 - RNA, 1410 nt, Artificial Sequence; identical to SEQ ID NO: 138754
  derived and/or modified sequence opt3 from neuraminidase__InfluenzaA__ADE28974

SEQ ID NO: 140489 - RNA, 1410 nt, Artificial Sequence
  derived and/or modified sequence opt3 from neuraminidase__InfluenzaA__ADE29004
augaaccccaaucagaagaucauuaccauaggcagcgugugcaugacaaucgggcuggccaaccucauucuucaaaucggaaauauuaucuccauauggaucucucacucaauucagcuggguaaccagaaucagaucgagacuuguaaccaaagugucauuacguacgaaaauaacaccuggguuaaucagacauaugugaacaucagcaauacuaacuucgcugcaggccaguccguagugucugucaaauuggccggaaauucgucauuaugcccugugagcggaugggcgauauacaguaaggacaacuccguuagaauuggcucuaaaggugauguguuugucaucagggagccauucauuagcuguuccccgcuggaaugccggaccuuuuuccuaacacagggggcucuccugaaugacaagcauucaaacggaaccaucaaagaucgcagucccuaucgaacucuuaugagcuguccuaucggcgaggugccaucucccuacaacucccguuuugaaucaguagccuggagcgcaagugccugccacgacggcauuaauuggcugacaauagggaucucuggaccugauaacggugcuguugcaguguugaaguauaauggcauuaucaccgacacgauaaaguccuggagaaacaauauucucaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccuggaauauaggauuggauacauauguucaggcaucuuuggcgauaauccgcggcccaacgacaaaaccgggaguugcggaccuguauccagcaauggugcgaacggcgugaagggguucucuuuuaaguauggaaacggcgucuggauuggucgcacaaaaucaaucaguagccgaaauggguucgagaugaucugggauccaaacggcuggaccggaacggacaagaauuuuuccauuaaacaggacauagugggcaucaacgaauggucuggguacucggggagcuucguucaacaucccgagcugacuggucucgauuguauuagaccuugcuucuggguggaauuaaucaggggccggccaaaggagaauacaauuuggaccuccgggucaaguaucucuuuuuguggagucaacagcgacacugugggcugguccuggcccgauggugcagagcugccguucacaauagacaaauga

SEQ ID NO: 140490 - RNA, 1410 nt, Artificial Sequence; identical to SEQ ID NO: 138754
  derived and/or modified sequence opt3 from neuraminidase__InfluenzaA__ADE29014

SEQ ID NO: 140491 - RNA, 1410 nt, Artificial Sequence
  derived and/or modified sequence opt3 from neuraminidase__InfluenzaA__ADE29024
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggaaaaacaauaucuugagaacucaagagagcgagugugccugcgugaacgggucguguuucaccgucaugacagauggaccaucugacggccaggcuuccuacaagaucuuuaggauugaaaaagguaagaucgugaaaucaguggagaugaaugcccccaacuaucauuacgaagagugcaguuguuacccugauagcuccgagauuacuugcgucugccgggacaauuggcacgggucuaaccgcccauggguuagcuucaaucagaaccucgaauaucagauaggauacaucuguucaggcauuuuuggcgauaauccgagacccaacgacaagaccgggaguugcggaccuguguccagcaauggugcgaacggcguaaagggguucucuuuuaaauauggaaacggcguguggaucgguaggacaaagucaaucaguagccggaauggguucgagaugauuugggauccaaacggcuggaauggaaccgacaacaauuuuuccauaaaacaagacaucgucggcauuaacgaauggucuggguacucggggagcuucgugcagcaucccgagcugacgggucuggauuguauccgcccuugcuucuggguugaacucauucgaggcagaccaaaggagaauacuaucuggacauccgggucaaguauaucuuuuuguggagugaacagcgacaccgucggcugguccuggcccgauggugcagaguuaccguucacuaucgacaaauga

SEQ ID NO: 140492 - RNA, 1410 nt, Artificial Sequence; identical to SEQ ID NO: 138754
  derived and/or modified sequence opt3 from neuraminidase__InfluenzaA__ADE29034

SEQ ID NO: 140493 - RNA, 1410 nt, Artificial Sequence; identical to SEQ ID NO: 138754
  derived and/or modified sequence opt3 from neuraminidase__InfluenzaA__ADE29044

SEQ ID NO: 140494 - RNA, 1410 nt, Artificial Sequence; identical to SEQ ID NO: 138754
  derived and/or modified sequence opt3 from neuraminidase__InfluenzaA__ADE29054

SEQ ID NO: 140495 - RNA, 1410 nt, Artificial Sequence; identical to SEQ ID NO: 140042
  derived and/or modified sequence opt3 from neuraminidase__InfluenzaA__ADE29064

SEQ ID NO: 140496 - RNA, 1410 nt, Artificial Sequence
  derived and/or modified sequence opt3 from neuraminidase__InfluenzaA__ADE29087
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugcaagaccuuuuuccugacacagggggcucuacucaaugacaaacauucaaacggaaccaucaaggaucggagucccuaucgcacucugaugagcuguccuaucggcgaggugccaucucccuacaacucccgauuugaaucaguagccuggagcgcaagugccugccacgacggcauuaauuggcuuacaauagggaucucuggaccugauaacggugcuguugcagugcugaaguauaauggcauuaucaccgacacgauaaaauccuggcguaacaauauuuugagaacucaagagagcgagugugccugcgucaacgggucguguuucaccgugaugacagauggaccaucuaauggccaggcuuccuacaagaucuuuaggaucgaaaaagguaagauugugaaaucagucgagaugaacgcccccaauuaucauuacgaagagugcaguuguuacccugacagcuccgagaucacuugcguuugccgggauaacuggcacgggucuaaucgcccaugggugagcuucaaccagaaucucgaauaucagauuggauacauauguucaggcaucuuuggcgacaacccgagacccaaugauaagaccgggaguugcggaccuguauccagcaacggugcgaacggcgugaagggguucucuuuuaaauauggaaauggcgucuggauugguaggacaaagucaaucaguagccggaacggguucgagaugaucugggacccaaauggcuggaccggaacggauaacaauuuuuccauuaaacaagacauagugggcaucaacgaauggucuggguacucggggagcuucguucagcaucccgagcugacuggucuggacuguauucgcccuugcuucuggguggaacucauccgaggcagaccaaaggagaauacaauuuggaccuccgggucaaguaucucuuuuuguggagucaacagcgauacugugggcugguccuggcccgacggugcagaguuaccguucacaauagauaaauga

SEQ ID NO: 140497 - RNA, 1410 nt, Artificial Sequence; identical to SEQ ID NO: 138744
  derived and/or modified sequence opt3 from neuraminidase__InfluenzaA__ADE29097

SEQ ID NO: 140498 - RNA, 1410 nt, Artificial Sequence; identical to SEQ ID NO: 139621
  derived and/or modified sequence opt3 from neuraminidase__InfluenzaA__ADE34194

SEQ ID NO: 140499 - RNA, 1410 nt, Artificial Sequence; identical to SEQ ID NO: 138615
  derived and/or modified sequence opt3 from neuraminidase__InfluenzaA__ADE34205

SEQ ID NO: 140500 - RNA, 1410 nt, Artificial Sequence
  derived and/or modified sequence opt3 from neuraminidase__InfluenzaA__ADE34216
augaaccccaaucagaagaucauuaccauaggcagcgugucccugacaaucucuacuauuugcuucuuuaugcaaaucgccauucucgucacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcaucgcuuggagcaguuccucuugucaugacgguaaagccuggcuccacgugugcauuacaggggaugacaagaacgcaaccgccagcuucaucuacaauggaaggcugguagauuccguugugucauggaguaaagacauccugcggacgcaggagagcgaaugugucugcauuaacggcacuuguacaguggugaugaccgauggcucugcuuccgggaaggcagacacuaaaauacucuuuaucgaggagggaaagauuguccauacaucaaccuuaagcgguagugcccaacacguugaagagugcucuugcuauccucgcuacccaggcgugagauguguaugcagggauaacuggaagggguccaaucggccgaucguggacauaaacauuaaagaccacagcaucgucucgucuuacguguguuccggacugguuggcgauacgccccgcaagaaugacucaaguagcuccucucauugccuugauccuaacaaugaagagggugggcacggagugaaaggcugggcuuucgacgauggcaacgacgucuggauggggcgaaccaucagcgaaaagucaagauugggauaugagacauuuaaagugauugaggguuggaguaauccaaaguccaaacugcagaucaacaggcagguaauuguugaucggggcaaucguagcggguacucuggaauauucucaguggaaggcaagaguuguaucaaccgcugcuuuuaugucgagcuaauuagagguaggaaggaagagacugaagugcucuggaccagcaauuccaucgucguguucugugggacaucuggcacuuacggaaccggcucguggcccgacggggccaacaucaaucugaugccuauuuga

SEQ ID NO: 140501 - RNA, 1410 nt, Artificial Sequence; identical to SEQ ID NO: 139621
  derived and/or modified sequence opt3 from neuraminidase__InfluenzaA__ADE34227

SEQ ID NO: 140502 - RNA, 1410 nt, Artificial Sequence; identical to SEQ ID NO: 139621
  derived and/or modified sequence opt3 from neuraminidase__InfluenzaA__ADE34238

SEQ ID NO: 140503 - RNA, 1410 nt, Artificial Sequence
  derived and/or modified sequence opt3 from neuraminidase__InfluenzaA__ADE34260
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaauccaaaguccaaacugcagauuaacaggcaagugauaguagaccggggcaaucguagcggguacucuggaaucuucucaguugagggcaagaguuguauuaaccgcugcuuuuauguggaacuaaucagagguaggaaggaggaaacugagguccucuggaccagcaauuccaucguggucuucugugggacaucuggcacuuacggaaccggcucguggcccgauggggccgacauuaaccugaugagcauauga

SEQ ID NO: 140504 - RNA, 1410 nt, Artificial Sequence; identical to SEQ ID NO: 139621
  derived and/or modified sequence opt3 from neuraminidase__InfluenzaA__ADE34271

SEQ ID NO: 140505 - RNA, 1410 nt, Artificial Sequence; identical to SEQ ID NO: 138754
  derived and/or modified sequence opt3 from neuraminidase__InfluenzaA__ADE45502

SEQ ID NO: 140506 - RNA, 1410 nt, Artificial Sequence; identical to SEQ ID NO: 138754
  derived and/or modified sequence opt3 from neuraminidase__InfluenzaA__ADE45504

SEQ ID NO: 140507 - RNA, 1410 nt, Artificial Sequence; identical to SEQ ID NO: 138754
  derived and/or modified sequence opt3 from neuraminidase__InfluenzaA__ADE45506

SEQ ID NO: 140508 - RNA, 1410 nt, Artificial Sequence; identical to SEQ ID NO: 138754
  derived and/or modified sequence opt3 from neuraminidase__InfluenzaA__ADE45508

SEQ ID NO: 140509 - RNA, 1410 nt, Artificial Sequence; identical to SEQ ID NO: 138754
  derived and/or modified sequence opt3 from neuraminidase__InfluenzaA__ADE45510

SEQ ID NO: 140510 - RNA, 1410 nt, Artificial Sequence; identical to SEQ ID NO: 138754
  derived and/or modified sequence opt3 from neuraminidase__InfluenzaA__ADE45512

SEQ ID NO: 140511 - RNA, 1410 nt, Artificial Sequence
  derived and/or modified sequence opt3 from neuraminidase__InfluenzaA__ADE45514
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaaguauuaucacguacgaaaauaacaccugggucaaucagacauauguuaacauaagcaauacuaacuucgcugcaggccaguccgugguaucugugaaacuggccggaaauucgucauugugcccugucagcggaugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuucaauauggaaacggcguauggaucggucggacaaagucaauuaguagccgcaauggguucgagaugauaugggauccaaacggcuggaccggaacggacaauaacuuuuccaucaaacaggacauugugggcaucaaugaauggucuggguacucggggagcuucguccagcaucccgagcugacuggucuggauuguauucgaccuugcuucuggguggaacucaucagaggcaggccaaaggagaacacaauauggaccuccgggucaaguaucucuuuuuguggaguuaauagcgacacugugggcugguccuggcccgauggugcagaguuaccguucacaauugacaaauga

SEQ ID NO: 140512 - RNA, 1410 nt, Artificial Sequence
  derived and/or modified sequence opt3 from neuraminidase__InfluenzaA__ADE45516
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucagucugcgcaauggguucgagaugauuugggauccaaacggcuggaccggaacggacaauaacuuuagcauaaagcaagacaucgucggcauuaaugaaugguccggguacucuggaucguucgugcagcaucccgagcugacuggucucgauuguauccgaccuugcuucuggguugaauuaauuagaggcaggccaaaagagaacacaaucuggaccagcggguccucaauaaguuuuuguggagucaauucugacacugugggcuggagcuggcccgauggugcagagcugccguucacaaucgacaaguga

SEQ ID NO: 140513 - RNA, 1410 nt, Artificial Sequence
  derived and/or modified sequence opt3 from neuraminidase__InfluenzaA__ADF10069
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacaggggacccuacucaaugacaagcauucaaacggaacuaucaaagaucgcagucccuaucgaacacugaugagcuguccuauuggcgaggucccaucucccuacaacucccguuuugaaucaguggcuuggagcgccagugcaugccacgacggcauaaauuggcuuaccaucgggauuucuggaccugauaacggugccguagcuguucugaaguauaauggcaucauaacggacacuauuaaguccuggagaaacaauaucuugaggacccaagagagcgagugugcaugcgugaacgggucguguuucacagucaugacugauggaccaucugacggccaggccuccuacaaaaucuuucggauugaaaaggguaaaaucgugaagucaguggagaugaaugcucccaacuaucauuacgaagagugcaguuguuacccugauagcuccgagauuaccugcgucugccgcgacaauuggcacgggucuaacagaccauggguuagcuucaaucagaaccucgaauaucagauaggauacaucuguucaggcauuuuuggcgauaauccgaggcccaacgacaaaacagggaguugcggaccuguguccagcaauggugccaacggcguaaagggguucucuuuuaaguauggaaacggcguguggaucggucggaccaaaucaaucaguagccgcaauggguucgagaugauuugggauccaaacggcuggacgggaacugacaauaacuuuuccauaaagcaagacaucgucggcauuaaugaauggucuggguacucggggagcuucgugcagcaucccgagcugacaggucuggauuguauccgaccuugcuucuggguugaacucauuagaggcaggccaaaagagaacaccaucuggacuuccgggucaaguauaucuuuuuguggagugaauagcgacacagucggcugguccuggcccgauggugcggaguuaccguucaccaucgacaaguga

SEQ ID NO: 140514 - RNA, 1410 nt, Artificial Sequence; identical to SEQ ID NO: 138754
  derived and/or modified sequence opt3 from neuraminidase__InfluenzaA__ADF10079

SEQ ID NO: 140515 - RNA, 1410 nt, Artificial Sequence; identical to SEQ ID NO: 138754
  derived and/or modified sequence opt3 from neuraminidase__InfluenzaA__ADF10089

SEQ ID NO: 140516 - RNA, 1410 nt, Artificial Sequence; identical to SEQ ID NO: 138754
  derived and/or modified sequence opt3 from neuraminidase__InfluenzaA__ADF10099

SEQ ID NO: 140517 - RNA, 1410 nt, Artificial Sequence
  derived and/or modified sequence opt3 from neuraminidase__InfluenzaA__ADF10109
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuauuacuacgaagagugcaguuguuauccugauagcuccgagauuacuugcgucugccgcgacaauuggcaugggucuaacagaccauggguuagcuucaaucagaaccucgaauaccagauaggauauaucuguucaggcauuuuuggcgauaauccgaggcccaacgacaaaaccgggaauugcggaccugugaguuccaacggugcgaacggcguaaagggguucagcuuuaaguacggaaauggcguguggaucggucggacaaaaucuaucucaagucgcaacggguucgagaugauuugggauccaaauggcuggaccggaacggacaacaauuuuagcauaaagcaagacaucgucggcauuaacgaaugguccggguauucuggaucguucgugcagcaccccgagcugacuggucuggauuguauccgaccuugcuucuggguugaacucauuagaggcaggccaaaagagaauacaaucuggaccagcggguccucaauaaguuuuuguggagugaacucugacacugucggcuggagcuggcccgauggugcagaguuaccguucacaaucgacaaguga

SEQ ID NO: 140518 - RNA, 1410 nt, Artificial Sequence; identical to SEQ ID NO: 138754
  derived and/or modified sequence opt3 from neuraminidase__InfluenzaA__ADF10129

SEQ ID NO: 140519 - RNA, 1410 nt, Artificial Sequence; identical to SEQ ID NO: 140184
  derived and/or modified sequence opt3 from neuraminidase__InfluenzaA__ADF10146

SEQ ID NO: 140520 - RNA, 1410 nt, Artificial Sequence
  derived and/or modified sequence opt3 from neuraminidase__InfluenzaA__ADF10166
augaaccccaaucagaagaucauuaccauaggcagcgugugcaugaucauugggauggccaaccugauccuccaaauuggaaauaucauauccaucuggauuucucacucaauccagcuugguaaccagaaucagauugagacauguaaccaaagugucaucacuuacgaaaauaacacguggguuaaucagaccuaugugaacauaagcaauacaaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggucccaucucccuacaacucccguuuugaaucaguggccuggagcgcaagugccugccacgacggcaucaauuggcuuacuauugggaucucuggaccugauaacggugcuguagcaguucugaaguauaauggcauaauuacagacaccaucaaguccuggagaaacaauaucuugaggacgcaagagagcgagugugccugcgugaacgggucguguuucacugucaugaccgauggaccaucugacggccaggcuuccuacaaaauuuuucggaucgaaaaggguaaaauugugaagucaguggagaugaaugcccccaacuaucauuacgaagagugcaguuguuacccugauagcuccgagauaacaugcgucugccgcgacaauuggcacgggucuaacagaccauggguuagcuucaaucagaaccucgaauaucagaucggauacauuuguucaggcaucuuuggcgauaauccgaggcccaacgacaaaacugggaguugcggaccuguguccagcaauggugcgaacggcguaaagggguucucuuuuaaguauggaaacggcguguggaucggucggaccaaaucaauuaguagccgcaagggguucgagaugauaugggauccaaauggcuggacaggaaccgacaacaauuuuuccaucaaacaagacauugucggcaucaacgaauggucuggguacucggggagcuucgugcagcaucccgagcugacgggucuggauuguauucgaccuugcuucuggguugaacucaucagaggcaggccaaaggagaauacuauauggacauccgggucaaguaucucuuuuuguggagugaacagcgacaccgucggcugguccuggcccgauggugcagaguuaccguucacuauugacaaauga

SEQ ID NO: 140521 - RNA, 1410 nt, Artificial Sequence; identical to SEQ ID NO: 140520
  derived and/or modified sequence opt3 from neuraminidase__InfluenzaA__ADF10176

SEQ ID NO: 140522 - RNA, 1410 nt, Artificial Sequence; identical to SEQ ID NO: 140520
  derived and/or modified sequence opt3 from neuraminidase__InfluenzaA__ADF10192

SEQ ID NO: 140523 - RNA, 1410 nt, Artificial Sequence; identical to SEQ ID NO: 138754
  derived and/or modified sequence opt3 from neuraminidase__InfluenzaA__ADF10247

SEQ ID NO: 140524 - RNA, 1410 nt, Artificial Sequence; identical to SEQ ID NO: 140520
  derived and/or modified sequence opt3 from neuraminidase__InfluenzaA__ADF10290

SEQ ID NO: 140525 - RNA, 1410 nt, Artificial Sequence
  derived and/or modified sequence opt3 from neuraminidase__InfluenzaA__ADF10304
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcaggguuaccguucacaaucgacaaguga

SEQ ID NO: 140526 - RNA, 1410 nt, Artificial Sequence; identical to SEQ ID NO: 138754
  derived and/or modified sequence opt3 from neuraminidase__InfluenzaA__ADF10340

SEQ ID NO: 140527 - RNA, 1410 nt, Artificial Sequence; identical to SEQ ID NO: 138754
  derived and/or modified sequence opt3 from neuraminidase__InfluenzaA__ADF10361

SEQ ID NO: 140528 - RNA, 1410 nt, Artificial Sequence; identical to SEQ ID NO: 140520
  derived and/or modified sequence opt3 from neuraminidase__InfluenzaA__ADF10371

SEQ ID NO: 140529 - RNA, 1410 nt, Artificial Sequence; identical to SEQ ID NO: 140520
  derived and/or modified sequence opt3 from neuraminidase__InfluenzaA__ADF10407

SEQ ID NO: 140530 - RNA, 1410 nt, Artificial Sequence; identical to SEQ ID NO: 138754
  derived and/or modified sequence opt3 from neuraminidase__InfluenzaA__ADF10472

SEQ ID NO: 140531 - RNA, 1410 nt, Artificial Sequence; identical to SEQ ID NO: 140520
  derived and/or modified sequence opt3 from neuraminidase__InfluenzaA__ADF10616

SEQ ID NO: 140532 - RNA, 1410 nt, Artificial Sequence; identical to SEQ ID NO: 140520
  derived and/or modified sequence opt3 from neuraminidase__InfluenzaA__ADF10688

SEQ ID NO: 140533 - RNA, 1410 nt, Artificial Sequence; identical to SEQ ID NO: 140520
  derived and/or modified sequence opt3 from neuraminidase__InfluenzaA__ADF10726

SEQ ID NO: 140534 - RNA, 1410 nt, Artificial Sequence; identical to SEQ ID NO: 138754
  derived and/or modified sequence opt3 from neuraminidase__InfluenzaA__ADF10773

SEQ ID NO: 140535 - RNA, 1410 nt, Artificial Sequence
  derived and/or modified sequence opt3 from neuraminidase__InfluenzaA__ADF10837
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggaaaaacaauaucuugagaacucaagagagcgagugugccugcgugaacgggucguguuucaccgucaugacagauggaccaucugacggccaggcuuccuacaagaucuuuaggauugaaaaagguaagaucgugaaaucaguggagaugaaugcccccaacuaucauuacgaagagugcaguuguuacccugauagcuccgagauuacuugcgucugccgggacaauuggcacgggucuaaccgcccauggguuagcuucaaucagaaccucgaauaucagauaggauacaucuguucaggcauuuuuggcgauaauccgagacccaacgacaagaccgggaguugcggaccuguguccagcaauggugcgaacggcguaaagggguucucuuuuaaauauggaaacggcguguggaucgguaggacaaagucaaucaguagccggaauggguucgagaugauuugggauccaaacggcuggaccggaacggacaauaacuuuuccauaaaacaagacaucgucggcauuaaugaauggucuggguacucggggagcuucgugcagcaucccgagcugacuggucuggauuguauccgcccuugcuucuggguugaacucauucgaggcagaccaaaggagaacacaaucuggaccuccgggucaaguauaucuuuuuguggagugaauagcgacacugucggcugguccuggcccgauggugcagaguuaccguucacaaucgacaaauga

SEQ ID NO: 140536 - RNA, 1410 nt, Artificial Sequence; identical to SEQ ID NO: 138754
  derived and/or modified sequence opt3 from neuraminidase__InfluenzaA__ADF10889

SEQ ID NO: 140537 - RNA, 1410 nt, Artificial Sequence; identical to SEQ ID NO: 138754
  derived and/or modified sequence opt3 from neuraminidase__InfluenzaA__ADF10947

SEQ ID NO: 140538 - RNA, 1410 nt, Artificial Sequence; identical to SEQ ID NO: 138754
  derived and/or modified sequence opt3 from neuraminidase__InfluenzaA__ADF11010

SEQ ID NO: 140539 - RNA, 1410 nt, Artificial Sequence
  derived and/or modified sequence opt3 from neuraminidase__InfluenzaA__ADF27355
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaugggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucuggauuguauucgaccuugcuucuggguugaacucaucagaggcaggccaaaagagaacacaauuuggaccuccgggucaaguaucucuuuuuguggagugaauagcgacacugucggcugguccuggcccgauggugcagaguuaccguucacaauagacaaguga

SEQ ID NO: 140540 - RNA, 1410 nt, Artificial Sequence
  derived and/or modified sequence opt3 from neuraminidase__InfluenzaA__ADF27356
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaaaugucauuacguacgaaaacaauaccuggguuaaccagacauaugugaauaucaguaacacuaauuucgcugcaggccagagcguaguguccgucaaacuggccgggaacucuucguugugcccugugucaggaugggcgauauacagcaaggacaauaguauuagaaucggcuccaaaggugauguuuuugugauuagggagccauucaucucuuguagcccguuagaaugccggaccuuuuuccugacacagggggcucuacucaacgacaagcauuccaacggaaccaucaaagaucgcucacccuaucgaacucugaugaguuguccuauuggcgaggucccaagccccuacaauucucguuuugaauccguggccuggucagcaagcgccugccacgacggcauaaacuggcuuacaaucgggauuaguggaccugauaauggugcuguagcaguucugaaguauaacggcaucauaaccgacacgauuaagucuuggagaaauaacaucuugaggacucaagaguccgagugugccugcgugaaugggagcuguuucaccgucaugacagauggaccaucggacggccaggcuucuuacaaaaucuuucggauugaaaaggguaaaaucgugaaguccguggagaugaacgcccccaauuauuacuacgaagagugcucauguuauccugauaguagcgagauuacuugcgucugccgcgacaacuggcauggguccaauagaccauggguuucuuucaaccagaaucucgaauaccagauaggauauaucuguagcggcauuuuuggcgauaacccgaggcccaaugacaaaaccgggucaugcggaccugugaguuccaacggugcgaacggcguaaagggguucagcuuuaaguacggaaauggcguguggaucggucggacaaaaucuaucucaagucgcaacggguucgagaugauuugggauccaaauggcuggaccggaacggacaacaauuuuagcauaaagcaagacaucgucggcauuaacgaaugguccggguauucuggaucguucgugcagcaccccgagcugacuggucuggauuguauccgaccuugcuucuggguugaacucauuagaggcaggccaaaagagaauacaaucuggaccagcggguccucaauaaguuuuuguggagugaacucugacacugucggcuggagcuggcccgauggugcagaguuaccguucacaaucgacaaguga

SEQ ID NO: 140541 - RNA, 1410 nt, Artificial Sequence; identical to SEQ ID NO: 139108
  derived and/or modified sequence opt3 from neuraminidase__InfluenzaA__ADF27357

SEQ ID NO: 140542 - RNA, 1410 nt, Artificial Sequence; identical to SEQ ID NO: 139108
  derived and/or modified sequence opt3 from neuraminidase__InfluenzaA__ADF27358

SEQ ID NO: 140543 - RNA, 1410 nt, Artificial Sequence; identical to SEQ ID NO: 139108
  derived and/or modified sequence opt3 from neuraminidase__InfluenzaA__ADF27360

SEQ ID NO: 140544 - RNA, 1410 nt, Artificial Sequence; identical to SEQ ID NO: 138754
  derived and/or modified sequence opt3 from neuraminidase__InfluenzaA__ADF27361

SEQ ID NO: 140545 - RNA, 1410 nt, Artificial Sequence; identical to SEQ ID NO: 138754
  derived and/or modified sequence opt3 from neuraminidase__InfluenzaA__ADF27362

SEQ ID NO: 140546 - RNA, 1410 nt, Artificial Sequence; identical to SEQ ID NO: 138754
  derived and/or modified sequence opt3 from neuraminidase__InfluenzaA__ADF27363

SEQ ID NO: 140547 - RNA, 1410 nt, Artificial Sequence; identical to SEQ ID NO: 139108
  derived and/or modified sequence opt3 from neuraminidase__InfluenzaA__ADF27364

SEQ ID NO: 140548 - RNA, 1410 nt, Artificial Sequence; identical to SEQ ID NO: 138754
  derived and/or modified sequence opt3 from neuraminidase__InfluenzaA__ADF27365

SEQ ID NO: 140549 - RNA, 1410 nt, Artificial Sequence; identical to SEQ ID NO: 139108
  derived and/or modified sequence opt3 from neuraminidase__InfluenzaA__ADF27366

SEQ ID NO: 140550 - RNA, 1410 nt, Artificial Sequence; identical to SEQ ID NO: 138754
  derived and/or modified sequence opt3 from neuraminidase__InfluenzaA__ADF27382

SEQ ID NO: 140551 - RNA, 1410 nt, Artificial Sequence; identical to SEQ ID NO: 138754
  derived and/or modified sequence opt3 from neuraminidase__InfluenzaA__ADF27392

SEQ ID NO: 140552 - RNA, 1410 nt, Artificial Sequence; identical to SEQ ID NO: 138754
  derived and/or modified sequence opt3 from neuraminidase__InfluenzaA__ADF27402

SEQ ID NO: 140553 - RNA, 1410 nt, Artificial Sequence; identical to SEQ ID NO: 140535
  derived and/or modified sequence opt3 from neuraminidase__InfluenzaA__ADF27422

SEQ ID NO: 140554 - RNA, 1410 nt, Artificial Sequence
  derived and/or modified sequence opt3 from neuraminidase__InfluenzaA__ADF27432
augaaccccaaucagaagaucauuaccauaggcagcgugugcgucacaaucgggauggccaaccugauucuccaaaucggaaauauuaucuccauauggaucucucacucaauucagcuugguaaccagaaucagaucgagacuuguaaccaaaguguuauuacguacgaaaauaacaccugggugaaucagacauauguaaacaucagcaauacuaacuucgcugcaggccaguccguggucucugugaaacuggccggaaauucgucauugugcccuguuagcggaugggcgauauacaguaaggacaacuccauuagaaucggcucuaaaggugauguguuugucauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggugccaucucccuacaacucccguuuugaaucaguagccuggagcgcaagugccugccacgacggcauaaauuggcuuacaaucgggauuucuggaccugauaacggugcuguugcagugcugaaguauaauggcaucauaaccgacacgauuaaguccuggagaaacaauaucuugaggacucaagagagcgagugugccugcgucaacgggucguguuucaccgugaugacagauggaccaucugacggccaggcuuccuacaaaaucuuucggauugaaaaggguaaaaucgugaagucagucgagaugaaugcccccaacuaucauuacgaagagugcaguuguuacccugauagcuccgagauuacuugcguuugccgcgacaauuggcacgggucuaacagaccaugggugagcuucaaucagaaccucgaauaucagauaggauacaucuguucaggcauuuuuggcgauaauccgaggcccaacgacaaaaccgggaguugcggaccuguauccagcaauggugcgaacggcgugaagggguucucuuuuaaguauggaaacggcgucuggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguucagcaucccgagcugacuggucuggauuguauccgaccuugcuucuggguggaacucauuagaggcaggccaaaagagaacacaaucuggaccuccgggucaaguauaucuuuuuguggagucaauagcgacacugugggcugguccuggcccgauggugcagaguuaccguucacaaucgacaaguga

SEQ ID NO: 140555 - RNA, 1410 nt, Artificial Sequence
  derived and/or modified sequence opt3 from neuraminidase__InfluenzaA__ADF27442
augaaccccaaucagaagaucauuaccauaggcagcgugugcaugacaaucgggauggccaaccugauucuccaaaucggaaauauuaucuccauauggaucucucacucaauucagcuugagaaccagaaucagaucgaaacuuguaaccaaagugucauuacguacgagaauaacaccuggguuaaucagacauaugugaacaucagcaauacuaacuucgcugcaggucaguccguagugucugucaaacuggccggcaauucgucauugugcccugugagcgggugggcgauauacaguaaggacaacuccauuagaaucggaucuaaaggcgauguuuuugugauuagggaaccauucaucagcuguuccccguuagagugccggaccuuuuuccugacacagggugcucuacucaaugacaagcauucaaacgggaccaucaaagaucgcagucccuaucgaacucugaugagcuguccuauuggagaagucccaucucccuacaacucccguuuugagucaguggccuggagcgcaagugccugccacgacggcauaaauuggcuuacaaucggcauuucugggccugauaacggagcuguagcaguucugaaguauaaugguaucauaaccgacacgauuaaguccuggagaaacaauaucuugaggacucaagagagcgaaugugccugcgugaacggcucguguuucaccgucaugacagaugggccaucugacggacaggcuuccuacaaaaucuuucggauugagaagggcaaaaucgugaagucaguggaaaugaaugcccccaacuaucauuacgaggagugcaguuguuacccugauagcuccgaaauuacuugcgucugccgcgacaauuggcacgguucuaacagaccauggguuagcuucaaucagaaccucgaguaucagauaggguacaucuguucaggaauuuuuggcgauaauccgaggcccaacgacaaaaccggcaguugcgggccuguguccagcaauggagcgaacgguguaaagggcuucucuuuuaaguaugggaacggaguguggaucggccggacaaaaucaaucaguagccgcaaugguuucgaaaugauuugggauccaaacggguggaccggcacggacaauaacuuuuccauaaagcaagacaucgucggaauuaaugaguggucuggcuacucggggagcuucgugcagcaucccgaacugacuggacuggauuguauccgaccuugcuucuggguugagcucauuagagguaggccaaaagagaacacaaucuggaccuccggcucaaguauaucuuuuuguggggugaauagcgacacugucggaugguccuggcccgauggcgcagaauuaccguucacaaucgacaaguga

SEQ ID NO: 140556 - RNA, 1410 nt, Artificial Sequence
  derived and/or modified sequence opt3 from neuraminidase__InfluenzaA__ADF27462
augaaccccaaucagaagaucauuaccauaggcagcgugugcaugacaaucgggauggccaaccugauucuccaaaucggaaauauuaucuccauauggaucucucacucaauucagcuugguaaccagaaucagaucgaggcuuguaaccaaagugucauuacuuacgaaaauaacacguggguuaaucagaccuaugugaacaucagcaauacaaacuucgcagccggccaguccguagugucugucaaacuggcgggaaauucgucauugugcccugugagcggaugggcuguuuacaguaaggacaacuccauaagaauuggcucuaaaggugauguguuugucaucagggagccauucauuagcuguuccccguuagaaugccggaccuuuuuccugacucagggggcccuacucaaugacaagcauucaaacggaacaaucaaagaucgcagucccuaucgaacccugaugagcuguccuaucggcgaggugccaucucccuacaacucccguuuugaaucaguagcauggagcgccagugcuugccacgacggcauuaauuggcuuacuauagggaucucuggaccugauaacggugcaguugccgugcugaaguauaauggcauuaucacagacaccauaaaguccuggagaaacaauauuuugaggacgcaagagagcgagugugcuugcgucaacgggucguguuucacugugaugaccgauggaccaucugacggccaggccuccuacaaaaucuuucggaucgaaaaggguaaaauugugaagucagucgagaugaaugcgcccaacuaucauuacgaagagugcaguuguuacccugauagcuccgagaucacaugcguuugccgcgacaauuggcacgggucuaacagaccaugggugagcuucaaucagaaccucgaauaucagauuggauacauauguucaggcaucuuuggcgauaauccgaggcccaacgacaaaacugggaguugcggaccuguauccagcaauggugcaaacggcgugaagggguucucuuuuaaguauggaaacggcgucuggauuggucggaccaaaucaaucaguagccgcaauggguucgagaugaucugggauccaaacggcuggacaggaaccgacaauaacuuuuccauuaagcaagacauagugggcaucaaugaauggucuggguacucggggagcuucguucagcaucccgagcugacgggucuggauuguauucgaccuugcuucuggguggaacucaucagaggcaggccaaaagagaacacuauuuggacauccgggucaaguaucucuuuuuguggagucaauagcgacaccgugggcugguccuggcccgauggugccgaguuaccguucacuauagacaaguga

SEQ ID NO: 140557 - RNA, 1410 nt, Artificial Sequence; identical to SEQ ID NO: 138754
  derived and/or modified sequence opt3 from neuraminidase__InfluenzaA__ADF27472

SEQ ID NO: 140558 - RNA, 1410 nt, Artificial Sequence
  derived and/or modified sequence opt3 from neuraminidase__InfluenzaA__ADF27482
augaaccccaaucagaagaucauuaccauaggcagcgugugcaugacaaucgggauggccaaccugauucuccaaaucggaaauauuaucuccauauggaucucucacucaauucagcuugguaaccagaaucaggucgagacuuguaaccaaaguaucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 140559 - RNA, 1410 nt, Artificial Sequence
  derived and/or modified sequence opt3 from neuraminidase__InfluenzaA__ADF27492
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagccuuguaaccaaagugucauuacuuacgaaaauaacacguggguuaaucagaccuaugugaacaucagcaauacaaacuucgcugcaggccaguccguagugucugucaaacuggccggaaauucgucauugugcccagugagcggaugggcgauauacaguaaggacaacuccauuagaaucggcucuaaaggugauguuuuugugauuagggagccguucaucagcuguucccccuuagaaugccggaccuuuuuccugacucagggggcucuacucaaugacaagcauucaaacggaacaaucaaagaucgcaguccuuaucgaacccugaugagcuguccaauuggcgagguccccucuccuuacaacucccguuuugaaucaguggccuggagcgcaagugccugccacgacggcauaaauuggcuuacuaucgggauuucuggaccagauaacggugcuguagcaguucugaaguauaauggcaucauaacagacaccauuaaguccuggagaaacaauaucuugaggacgcaagagagcgagugugccugcgugaacgggucguguuucacugucaugaccgauggacccucugacggccaggcuuccuacaaaaucuuucggauugaaaaggguaaaaucgugaagucaauugagaugaaugccccuaacuaucauuacgaagagugcaguuguuacccagauagcuccgagauaacaugcgugugccgcgacaauuggcacgggucuaacagaccgugggucagcuucaaucagaaccucgaauaucagaucggauacauuuguucaggcaucuuuggcgauaaucccaggccuaacgacaaaacugggaguugcggaccaguuuccagcaauggugcgaacggcgugaagggguucucuuuuaaguauggaaacggcguauggaucggucggaccaaaucaauuaguagccgcaauggguucgagaugauaugggaucccaacggcuggacaggaaccgacaauaacuuuuccaucaagcaagacauugugggcaucaaugaauggucuggguacucggggagcuucguccagcauccugagcugacgggucuggauuguauucgaccaugcuucuggguggaacucaucagaggcaggcccaaagagaacacuguuuggacauccgggucaaguauaucuuuuuguggagugaauagcgacaccgucggcugguccuggccggauggugcagaguuaccuuucacuaucgacaaguga

SEQ ID NO: 140560 - RNA, 1410 nt, Artificial Sequence; identical to SEQ ID NO: 138754
  derived and/or modified sequence opt3 from neuraminidase__InfluenzaA__ADF27502

SEQ ID NO: 140561 - RNA, 1410 nt, Artificial Sequence; identical to SEQ ID NO: 138754
  derived and/or modified sequence opt3 from neuraminidase__InfluenzaA__ADF27512

SEQ ID NO: 140562 - RNA, 1410 nt, Artificial Sequence
  derived and/or modified sequence opt3 from neuraminidase__InfluenzaA__ADF27522
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggaucaaaucaauuaguagccgcaauggguucgagaugauaugggauccaaacggcuggacaggaaccgacaauaacuuuuccaucaagcaagacauugucggcaucaaugaauggucuggguacucggggagcuucgugcagcaucccgagcugacgggucuggauuguauucgaccuugcuucuggguugaacucaucagaggcaggccaaaagagaacacuauauggacauccgggucaaguaucucuuuuuguggagugaauagcgacaccgucggcugguccuggcccgauggugcagaguuaccguucacuauugacaaguga

SEQ ID NO: 140563 - RNA, 1410 nt, Artificial Sequence; identical to SEQ ID NO: 138754
  derived and/or modified sequence opt3 from neuraminidase__InfluenzaA__ADF27532

SEQ ID NO: 140564 - RNA, 1410 nt, Artificial Sequence
  derived and/or modified sequence opt3 from neuraminidase__InfluenzaA__ADF27542
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauauaggauuggauacauauguucaggcaucuuuggcgauaauccgcggcccaacgacaaaaccgggaguugcggaccuguauccagcaauggugcgaacggcgugaagggguucucuuuuaaguauggaaacggcgucuggauuggucgcacaaaaucaaucaguagccgaaauggguucgagaugaucugggauccaaacggcuggaccggaacggacaauaacuuuuccauuaagcaggacauagugggcaucaaugaauggucuggguacucggggagcuucguucaacaucccgagcugacuggucuggauuguauuagaccuugcuucuggguggaacucaucaggggccggccaaaagagaacacaauuuggaccuccgggucaaguaucucuuuuuguggagucaauagcgacacugugggcugguccuggcccgauggugcagaguuaccguucacaauagacaaguga

SEQ ID NO: 140565 - RNA, 1410 nt, Artificial Sequence
  derived and/or modified sequence opt3 from neuraminidase__InfluenzaA__ADF27552
augaaccccaaucagaagaucauuaccauaggcagcgugugcaugacaaucgggcuggccaaccucauucuucaaaucggaaauauuaucuccauaugggucucucacucaauccagcuggguaaccagaaucagauugagacuuguaaccaaaguguuaucacguacgaaaauaacaccugggugaaucagacauauguaaacauuagcaauacuaacuucgcugcaggccaguccguggucucugugaaauuggccggaaauucgucauuaugcccuguuagcggaugggcgaucuacaguaaggacaacuccgugagaauaggcucuaaaggugaugucuuugugauuagggagccauucaucagcuguuccccgcuggaaugccggaccuuuuuccuaacacagggggcucuccugaaugacaagcauucaaacggaaccauuaaagaucgcagucccuaucgaacucuuaugagcuguccuaucggcgagguaccaucucccuacaacucccguuuugaaucaguugccuggagcgcaagugccugccacgacggcaucaauuggcugacaauugggauaucuggaccugauaacggugcuguggcagucuugaaguauaauggcaucauuaccgacacgaucaaguccuggagaaacaauauacucaggacucaagagagcgagugugccugcgugaacgggucguguuucaccgugaugacagauggaccaucugacggccaggcuuccuacaaaauuuuucggaucgaaaaggguaaaaucgucaagucaguugagaugaaugcccccaacuaucauuacgaagagugcaguuguuacccugauagcuccgagauuacuugcgugugccgcgacaauuggcacgggucuaacagaccaugggugagcuucaaucagaaccuggaauauaggaucggauacauuuguucaggcauauuuggcgauaauccgcggcccaacgacaaaaccgggaguugcggaccuguauccagcaauggugcgaacggcgucaagggguucucuuuuaaguauggaaacggcguguggaucggucgcacaaaaucaauuaguagccgaaauggguucgagaugaucugggauccaaacggcuggaccggaacggacaagaauuuuuccaucaaacaggacauuguuggcauaaacgaauggucuggguacucggggagcuucgugcaacaucccgagcugacuggucucgauuguaucagaccuugcuucugggucgaauuaauuaggggccggccaaaggagaauacaaucuggaccuccgggucaaguauuucuuuuuguggagugaacagcgacacuguaggcugguccuggcccgauggugcagagcugccguucacaaucgacaaauga

SEQ ID NO: 140566 - RNA, 1410 nt, Artificial Sequence; identical to SEQ ID NO: 139580
  derived and/or modified sequence opt3 from neuraminidase__InfluenzaA__ADF27562

SEQ ID NO: 140567 - RNA, 1410 nt, Artificial Sequence; identical to SEQ ID NO: 138754
  derived and/or modified sequence opt3 from neuraminidase__InfluenzaA__ADF27572

SEQ ID NO: 140568 - RNA, 1410 nt, Artificial Sequence
  derived and/or modified sequence opt3 from neuraminidase__InfluenzaA__ADF27582
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauauaggauaggauacaucuguucaggcauuuuuggcgauaauccgcggcccaacgacaaaaccgggaguugcggaccuguguccagcaauggugcgaacggcguaaagggguucucuuuuaaguauggaaacggcguguggaucggucgcacaaaaucaaucaguagccgaaauggguucgagaugauuugggauccaaacggcuggaccggaacggacaauaacuuuuccauaaagcaggacaucgucggcauuaaugaauggucuggguacucggggagcuucgugcaacaucccgagcugacuggucuggauuguaucagaccuugcuucuggguugaacucauuaggggccggccaaaagagaacacaaucuggaccuccgggucaaguauaucuuuuuguggagugaauagcgacacugucggcugguccuggcccgauggugcagaguuaccguucacaaucgacaaguga

SEQ ID NO: 140569 - RNA, 1410 nt, Artificial Sequence; identical to SEQ ID NO: 138754
  derived and/or modified sequence opt3 from neuraminidase__InfluenzaA__ADF27592

SEQ ID NO: 140570 - RNA, 1410 nt, Artificial Sequence
  derived and/or modified sequence opt3 from neuraminidase__InfluenzaA__ADF27602
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaacgcgguaagaucgugaaaucaguggagaugaaugcccccaacuaucauuacgaagagugcaguuguuacccugauagcuccgagauuacuugcgucugcagagacaauuggcacgggucuaacaggccauggguuagcuucaaucagaaccucgaauaucagauaggauacaucuguucaggcauuuuuggcgauaauccgcggcccaacgacaagaccgggaguugcggaccuguguccagcaauggugcgaacggcguaaaaggguucucuuuuaaguauggaaacggcguguggaucggucgcacaaagucaaucaguagccgaaauggguucgagaugauuugggauccaaacggcuggaccggaacggacaauuccuuuucuauaaaacaagacaucgucggcauuaacgaauggucgggguacagcggauccuucgugcagcaucccgagcugacuggucuggauuguaucagaccuugcuucuggguugaacucauuaggggccggccaaaggagaauacaaucuggaccucagggaguucuauaucguuuuguggagugaacuccgacacugucggcuggucauggcccgauggugcagaguuaccguucacaaucgacaaauga

SEQ ID NO: 140571 - RNA, 1410 nt, Artificial Sequence; identical to SEQ ID NO: 138754
  derived and/or modified sequence opt3 from neuraminidase__InfluenzaA__ADF27612

SEQ ID NO: 140572 - RNA, 1410 nt, Artificial Sequence; identical to SEQ ID NO: 140042
  derived and/or modified sequence opt3 from neuraminidase__InfluenzaA__ADF27622

SEQ ID NO: 140573 - RNA, 1410 nt, Artificial Sequence; identical to SEQ ID NO: 140489
  derived and/or modified sequence opt3 from neuraminidase__InfluenzaA__ADF27632

SEQ ID NO: 140574 - RNA, 1410 nt, Artificial Sequence; identical to SEQ ID NO: 138754
  derived and/or modified sequence opt3 from neuraminidase__InfluenzaA__ADF27642

SEQ ID NO: 140575 - RNA, 1410 nt, Artificial Sequence; identical to SEQ ID NO: 138754
  derived and/or modified sequence opt3 from neuraminidase__InfluenzaA__ADF27652

SEQ ID NO: 140576 - RNA, 1410 nt, Artificial Sequence
  derived and/or modified sequence opt3 from neuraminidase__InfluenzaA__ADF27662
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugcaaugacggcauuaacuggcuuacaauagggaucucuggaccugauaauggugcuguugcagugcugaaguauaacggcauuaucaccgacacgauaaaguccuggagaaauaacauuuugaggacucaagagagcgagugugccugcgucaaugggucguguuucaccgugaugacagauggaccaucugacggccaggcuuccuacaaaaucuuucggaucgaaaaggguaaaauugugaagucagucgagaugaacgcccccaauuaucacuacgaagagugcaguuguuacccugauagcuccgagaucacuugcguuugccgcgacaacuggcaugggucuaauagaccaugggugagcuucaaccagaaucucgaauauaggauuggauacauauguucaggcaucuuuggcgauaacccgcggcccaaugacaaaaccgggaguugcggaccuguauccagcaacggugcgaacggcgugaagggguucucuuuuaaguauggaaauggcgucuggauuggucgcacaaaaucaaucaguagccgaaacggguucgagaugaucugggauccaaauggcuggaccggaacggacaacaauuuuuccauuaagcaggacauagugggcaucaacgaauggucuggguacucggggagcuucguucaacaccccgagcugacuggucuggauuguauuagaccuugcuucuggguggaacucaucaggggccggccaaaagagaauacaauuuggaccuccgggucaaguaucucuuuuuguggagucaacagcgacacugugggcugguccuggcccgauggugcagaguuaccguucacaauagacaaguga

SEQ ID NO: 140577 - RNA, 1410 nt, Artificial Sequence; identical to SEQ ID NO: 138754
  derived and/or modified sequence opt3 from neuraminidase__InfluenzaA__ADF27672

SEQ ID NO: 140578 - RNA, 1410 nt, Artificial Sequence; identical to SEQ ID NO: 138754
  derived and/or modified sequence opt3 from neuraminidase__InfluenzaA__ADF27682

SEQ ID NO: 140579 - RNA, 1410 nt, Artificial Sequence; identical to SEQ ID NO: 138754
  derived and/or modified sequence opt3 from neuraminidase__InfluenzaA__ADF27692

SEQ ID NO: 140580 - RNA, 1410 nt, Artificial Sequence; identical to SEQ ID NO: 138754
  derived and/or modified sequence opt3 from neuraminidase__InfluenzaA__ADF27702

SEQ ID NO: 140581 - RNA, 1410 nt, Artificial Sequence; identical to SEQ ID NO: 138754
  derived and/or modified sequence opt3 from neuraminidase__InfluenzaA__ADF27712

SEQ ID NO: 140582 - RNA, 1410 nt, Artificial Sequence; identical to SEQ ID NO: 140042
  derived and/or modified sequence opt3 from neuraminidase__InfluenzaA__ADF27788

SEQ ID NO: 140583 - RNA, 1410 nt, Artificial Sequence; identical to SEQ ID NO: 139997
  derived and/or modified sequence opt3 from neuraminidase__InfluenzaA__ADF27798

SEQ ID NO: 140584 - RNA, 1410 nt, Artificial Sequence; identical to SEQ ID NO: 140489
  derived and/or modified sequence opt3 from neuraminidase__InfluenzaA__ADF27808

SEQ ID NO: 140585 - RNA, 1410 nt, Artificial Sequence
  derived and/or modified sequence opt3 from neuraminidase__InfluenzaA__ADF27818
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccaucaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaauagucgcaacggguucgagaugauaugggauccaaauggcuggaccggaacggacaacaauuuuagcaucaagcaagacauugugggcaucaacgaaugguccggguacucuggaucguucguccagcaucccgagcugacuggucuggauuguauucgaccuugcuucuggguggaacucaucagaggcaggccaaaagagaauacaauauggaccagcggguccucaaucaguuuuuguggaguuaacucugacacugugggcuggagcuggcccgauggugcagaguuaccguucacaauugacaaguga

SEQ ID NO: 140586 - RNA, 1410 nt, Artificial Sequence; identical to SEQ ID NO: 138754
  derived and/or modified sequence opt3 from neuraminidase__InfluenzaA__ADF27838

SEQ ID NO: 140587 - RNA, 1410 nt, Artificial Sequence; identical to SEQ ID NO: 138754
  derived and/or modified sequence opt3 from neuraminidase__InfluenzaA__ADF27848

SEQ ID NO: 140588 - RNA, 1410 nt, Artificial Sequence
  derived and/or modified sequence opt3 from neuraminidase__InfluenzaA__ADF27858
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcaguucugcaugccacgacggcauaaauuggcuuacaaucgggauuuccggaccugauaacggugccguagcuguucugaaguauaauggcaucauaaccgacacgauuaagagcuggagaaacaauaucuugaggacucaagagucggagugugcaugcgugaacgggucuuguuucaccgucaugacagauggaccauccgacggccaggccucauacaaaaucuuucggauugaaaaggguaaaaucgugaagaguguggagaugaaugcucccaacuaucauuacgaagagugcagcuguuacccugauuccucugagauuacuugcgucugccgcgacaauuggcacgggagcaacagaccauggguuucauucaaucagaaccucgaauaucagauaggauacaucuguaguggcauuuuuggcgauaauccgaggcccaacgacaaaaagggguccugcggaccugugagcucuaauggugccaacggcguaaagggguucucauuuaaauauggaaacggcguguggaucggucggaccaagaguaucagcucccgcaauggguucgagaugauuugggauccaaacggcuggacaggaaccgacaauaacuuuucuauaaaacaagacaucgucggcauuaaugaauggucgggguacagcggauccuucgugcagcaucccgagcugacgggucuggauuguauccgaccuugcuucuggguugaacucauuagaggcaggccaaaggagaacacuaucuggacaucagggaguucuauaucguuuuguggagugaauggcgacaccgucgguugguccuggcccgauggggcggaguuaccguucacuaucgacaaauga

SEQ ID NO: 140589 - RNA, 1410 nt, Artificial Sequence
  derived and/or modified sequence opt3 from neuraminidase__InfluenzaA__ADF27878
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaaggggaguugcggaccuguguccagcaauggugcgaacggcguaaagggguucucuuuuaaauauggaaacggcguguggaucggucggaccaagucaaucaguagccgcaauggguucgagaugauuugggauccaaacggcuggacaggaaccgacaauaacuuuuccauaaaacaagacaucgucggcauuaaugaauggucuggguacucggggagcuucgugcagcaucccgagcugacgggucuggauuguauccgaccuugcuucuggguugaacucauuagaggcaggccaaaggagaacacuaucuggacauccgggucaaguauaucuuuuuguggagugaauggcgacaccgucgguuggagcuggcccgauggggcagaguuaccguucacuaucgacaaauga

SEQ ID NO: 140590 - RNA, 1410 nt, Artificial Sequence; identical to SEQ ID NO: 140042
  derived and/or modified sequence opt3 from neuraminidase__InfluenzaA__ADF27888

SEQ ID NO: 140591 - RNA, 1410 nt, Artificial Sequence; identical to SEQ ID NO: 138754
  derived and/or modified sequence opt3 from neuraminidase__InfluenzaA__ADF27898

SEQ ID NO: 140592 - RNA, 1410 nt, Artificial Sequence; identical to SEQ ID NO: 140042
  derived and/or modified sequence opt3 from neuraminidase__InfluenzaA__ADF27908

SEQ ID NO: 140593 - RNA, 1410 nt, Artificial Sequence; identical to SEQ ID NO: 140042
  derived and/or modified sequence opt3 from neuraminidase__InfluenzaA__ADF27918

SEQ ID NO: 140594 - RNA, 1410 nt, Artificial Sequence
  derived and/or modified sequence opt3 from neuraminidase__InfluenzaA__ADF27938
augaaccccaaucagagaaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaagcuggccggaaauucgucauugugcccugugagcggaugggcgauauacaguaaagacaacuccauuaggaucggcucuaagggugauguuuuugugauucgggagccauucaucagcuguuccccguuagaaugccgcaccuuuuuccugacacagggggcucuacucaaugacaaacauucaaacggaaccaucaaggaucgaagucccuaucguacucugaugagcuguccuauuggcgaggucccaucucccuacaacuccagauuugaaucaguggccuggagcgcaagugccugccacgacggcauaaauuggcuuacaaucgggauuucuggaccugauaacggugcuguagcaguucugaaauauaauggcaucauaaccgacacgauuaaguccuggaggaacaauaucuugcggacucaagagagcgagugugccugcgugaacgggucguguuucaccgucaugacagauggaccaucugacggccaggcuuccuacaagaucuuucgcauugaaaaagguaagaucgugaaaucaguggagaugaaugcccccaacuaucauuacgaagagugcaguuguuacccugauagcuccgagauuacuugcgucugcagagacaauuggcacgggucuaacaggccauggguuagcuucaaucagaaccucgaauaucagauaggauacaucuguucaggcauuuuuggcgauaauccgcggcccaacgacaagaccgggaguugcggaccuguguccagcaauggugcgaacggcguaaaaggguucucuuuuaaguauggaaacggcguguggaucggucgcacaaagucaaucaguagccgaaauggguucgagaugauuugggauccaaacggcuggaccggaacggacaauaacuuuuccauaaaacaagacaucgucggcauuaaugaauggucuggguacucggggagcuucgugcagcaucccgagcugacuggucuggauuguaucagaccuugcuucuggguugaacucauuaggggccggccaaaggagaacacaaucuggaccuccgggucaaguaugucuuuuuguggagugaauagcgacacugucggcugguccuggcccgauggugcagaguuaccguucacaauagacaaauga

SEQ ID NO: 140595 - RNA, 1410 nt, Artificial Sequence; identical to SEQ ID NO: 138754
  derived and/or modified sequence opt3 from neuraminidase__InfluenzaA__ADF27948

SEQ ID NO: 140596 - RNA, 1410 nt, Artificial Sequence; identical to SEQ ID NO: 140042
  derived and/or modified sequence opt3 from neuraminidase__InfluenzaA__ADF27958

SEQ ID NO: 140597 - RNA, 1410 nt, Artificial Sequence; identical to SEQ ID NO: 138754
  derived and/or modified sequence opt3 from neuraminidase__InfluenzaA__ADF27968

SEQ ID NO: 140598 - RNA, 1410 nt, Artificial Sequence; identical to SEQ ID NO: 140042
  derived and/or modified sequence opt3 from neuraminidase__InfluenzaA__ADF27978

SEQ ID NO: 140599 - RNA, 1410 nt, Artificial Sequence
  derived and/or modified sequence opt3 from neuraminidase__InfluenzaA__ADF27988
augaaccccaaucagaagaucauuaccauaggcagcgugugcaugacaaucgggcuggccaaccucauucuucaaaucggaaauauuaucuccauauggaucucucacucaauucagcuggguaaccagaaucagaucgagacuuguaaccaaagugucauuagcuacgaaaauaacacguggguuaaucagaccuaugugaacaucuccaauacaaacuucgcugcaggccagucuguagugucggucaaauuggccgggaauagcucauuaugcccugugaguggaugggcgauauacuccaaggacaacucuguuagaauuggcagcaaaggugauguguuugucaucagggagccauucauuuccuguucaccgcuggaaugccggaccuuuuuccuaacucagggggcucuccugaaugacaagcauaguaacggaacaaucaaagaucgcagccccuaucgaacccuuaugucuuguccuaucggcgaggugccaucccccuacaacucacguuuugaaagcguagccuggagugcaucugccugccacgacggcauuaauuggcugacuauagggaucuccggaccugauaacggugcuguugcaguguugaaguauaauggcauuaucacagacaccauaaagagcuggagaaacaauauucucaggacgcaagagucggagugugccugcgucaacgggucuuguuucacugugaugaccgauggaccauccgacggccaggcuucauacaaaaucuuucggaucgaaaaggguaaaauugugaagagugucgagaugaaugcccccaacuaucauuacgaagagugcagcuguuacccugauuccucugagaucacaugcguuugccgcgacaauuggcacgggagcaacagaccaugggugucauucaaucagaaccuggaauauaggauuggauacauauguaguggcaucuuuggcgauaauccgcggcccaacgacaaaacuggguccugcggaccuguaagcucuaauggugcgaacggcgugaagggguucucauuuaaguauggaaacggcgucuggauuggucgcaccaaaaguaucagcucccgaaauggguucgagaugaucugggauccaaacggcuggacaggaaccgacaagaauuuuucuauuaaacaggacauagugggcaucaacgaauggucgggguacagcggauccuucguucaacaucccgagcugacgggucucgauuguauuagaccuugcuucuggguggaauuaaucaggggccggccaaaggagaauacuauuuggacaucagggaguucuaucagcuuuuguggagucaacuccgacaccgugggcuggucauggcccgauggugcagagcugccguucacuauagacaaauga

SEQ ID NO: 140600 - RNA, 1410 nt, Artificial Sequence; identical to SEQ ID NO: 138754
  derived and/or modified sequence opt3 from neuraminidase__InfluenzaA__ADF27998

SEQ ID NO: 140601 - RNA, 1410 nt, Artificial Sequence; identical to SEQ ID NO: 138754
  derived and/or modified sequence opt3 from neuraminidase__InfluenzaA__ADF28008

SEQ ID NO: 140602 - RNA, 1410 nt, Artificial Sequence; identical to SEQ ID NO: 139641
  derived and/or modified sequence opt3 from neuraminidase__InfluenzaA__ADF28018

SEQ ID NO: 140603 - RNA, 1410 nt, Artificial Sequence; identical to SEQ ID NO: 138754
  derived and/or modified sequence opt3 from neuraminidase__InfluenzaA__ADF28028

SEQ ID NO: 140604 - RNA, 1410 nt, Artificial Sequence
  derived and/or modified sequence opt3 from neuraminidase__InfluenzaA__ADF28038
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcuaccggccagcugguaguguccgucaaauuggcaggaaauucuucguuaugcccugugucagggugggccauauacagcaaggacaacaguauuagaaucggcuccaaaggugauguuuuugugauuagggagccauucaucucuuguagcccgcuggaaugccggacauuuuuccuaacccagggggcgcuccugaaugaccgccauuccaacggaacuaucaaggaucgaucacccuaucguacacuuaugaguuguccuauuggcgaggucccaagccccuacaacucuagauuugaauccguggcuuggucagccagcgcaugccacgacggcauaaauuggcugaccaucgggauuaguggaccugauaacggugccguagcuguuuugaaauauaauggcaucauaacggacacuauuaagucuuggaggaacaauauccuccggacccaagaguccgagugugcaugcgugaacgggagcuguuucacagucaugacugauggaccaucggacggccaggccucuuacaagaucuuucgcauugaaaaagguaagaucgugaaauccguggagaugaaugcucccaacuaucauuacgaagagugcucauguuacccugauaguagcgagauuaccugcgucugcagagacaauuggcacggguccaacaggccauggguuucuuucaaucagaaccuggaauaucagauaggauacaucuguagcggcauuuuuggcgauaauccgcggcccaacgacaagacagggucaugcggaccugugaguuccaauggugccaacggcguaaaaggguucagcuuuaaguauggaaacggcguguggaucggucgcaccaagucuaucucaagucgaaauggguucgagaugauuugggauccaaacggcuggacgggaacugacaauaacuuuagcauaaaacaagacaucgucggcauuaaugaaugguccggguacucuggaucguucgugcagcaucccgagcugacaggucucgauuguaucagaccuugcuucuggguugaauuaauuaggggccggccaaaggagaacaccaucuggacuagcggguccucaauaaguuuuuguggagucaauucugacacagugggcuggagcuggcccgauggugcggagcugccguucaccaucgacaaauga

SEQ ID NO: 140605 - RNA, 1410 nt, Artificial Sequence; identical to SEQ ID NO: 138754
  derived and/or modified sequence opt3 from neuraminidase__InfluenzaA__ADF28048

SEQ ID NO: 140606 - RNA, 1410 nt, Artificial Sequence; identical to SEQ ID NO: 138754
  derived and/or modified sequence opt3 from neuraminidase__InfluenzaA__ADF28058

SEQ ID NO: 140607 - RNA, 1410 nt, Artificial Sequence
  derived and/or modified sequence opt3 from neuraminidase__InfluenzaA__ADF28068
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggucgagcagcuugugcccugugaguggaugggcgauauacuccaaggacaauucuauuagaaucggcagcaaaggugauguuuuugugauuagggagccauucaucuccuguucacauuuagaaugccggaccuuuuuccugacacagggggcucuacucaacgacaagcacaguaauggaaccaucaaagaucgcagcccguaucgaacucugaugucuugucccauuggcgaggucccuuccccauacaacucacguuuugaaagcguggccuggagugcaucugccugccaugacggcauaaacuggcuuacaaucgggauuuccggacccgauaauggugcuguagcaguucugaaguauaacggcaucauaaccgacacgauuaagagcuggagaaauaacaucuugaggacucaagagucggagugugccugcgugaaugggucuuguuucaccgucaugacagauggaccuuccgacggccaggcuucauacaaaaucuuucggauugaaaaggguaaaaucgugaagaguguggagaugaacgccccaaauuaucacuacgaagagugcagcuguuaccccgauuccucugagauuacuugcgucugccgcgacaacuggcaugggagcaauagaccuuggguuucauucaaccagaaucucgaauaucagauaggauacaucuguaguggcauuuuuggcgauaacccaaggccgaaugacaaaaagggguccugcggacccgugagcucuaacggugcgaauggcguaaagggguucucauuuaaauauggaaacggcguguggaucggucggaccaagaguaucagcucccgcaacggguucgagaugauuugggauccuaauggcuggacaggaaccgacaacaauuuuucuauaaaacaagacaucgucggcauuaacgaauggucgggguacagcggauccuucgugcagcacccagagcugacgggucuggauuguauccgacccugcuucuggguugaacucauuagaggcaggccuaaggagaauacuaucuggacaucagggaguucuauaucauuuuguggagugaacuccgacaccgucggcuggucauggccagauggugcagaguuacccuucacuaucgacaaauga

SEQ ID NO: 140608 - RNA, 1410 nt, Artificial Sequence; identical to SEQ ID NO: 138754
  derived and/or modified sequence opt3 from neuraminidase__InfluenzaA__ADF28078

SEQ ID NO: 140609 - RNA, 1410 nt, Artificial Sequence; identical to SEQ ID NO: 138754
  derived and/or modified sequence opt3 from neuraminidase__InfluenzaA__ADF28088

SEQ ID NO: 140610 - RNA, 1410 nt, Artificial Sequence; identical to SEQ ID NO: 140216
  derived and/or modified sequence opt3 from neuraminidase__InfluenzaA__ADF28110

SEQ ID NO: 140611 - RNA, 1410 nt, Artificial Sequence; identical to SEQ ID NO: 138754
  derived and/or modified sequence opt3 from neuraminidase__InfluenzaA__ADF28120

SEQ ID NO: 140612 - RNA, 1410 nt, Artificial Sequence; identical to SEQ ID NO: 138754
  derived and/or modified sequence opt3 from neuraminidase__InfluenzaA__ADF29919

SEQ ID NO: 140613 - RNA, 1410 nt, Artificial Sequence; identical to SEQ ID NO: 139891
  derived and/or modified sequence opt3 from neuraminidase__InfluenzaA__ADF42692

SEQ ID NO: 140614 - RNA, 1410 nt, Artificial Sequence; identical to SEQ ID NO: 138754
  derived and/or modified sequence opt3 from neuraminidase__InfluenzaA__ADF42702

SEQ ID NO: 140615 - RNA, 1410 nt, Artificial Sequence; identical to SEQ ID NO: 140589
  derived and/or modified sequence opt3 from neuraminidase__InfluenzaA__ADF42712

SEQ ID NO: 140616 - RNA, 1410 nt, Artificial Sequence; identical to SEQ ID NO: 138754
  derived and/or modified sequence opt3 from neuraminidase__InfluenzaA__ADF42722

SEQ ID NO: 140617 - RNA, 1410 nt, Artificial Sequence; identical to SEQ ID NO: 140042
  derived and/or modified sequence opt3 from neuraminidase__InfluenzaA__ADF42732

SEQ ID NO: 140618 - RNA, 1410 nt, Artificial Sequence; identical to SEQ ID NO: 138754
  derived and/or modified sequence opt3 from neuraminidase__InfluenzaA__ADF42742

SEQ ID NO: 140619 - RNA, 1410 nt, Artificial Sequence; identical to SEQ ID NO: 138744
  derived and/or modified sequence opt3 from neuraminidase__InfluenzaA__ADF58339

SEQ ID NO: 140620 - RNA, 1410 nt, Artificial Sequence; identical to SEQ ID NO: 138754
  derived and/or modified sequence opt3 from neuraminidase__InfluenzaA__ADF58348

SEQ ID NO: 140621 - RNA, 1410 nt, Artificial Sequence; identical to SEQ ID NO: 138754
  derived and/or modified sequence opt3 from neuraminidase__InfluenzaA__ADF58350

SEQ ID NO: 140622 - RNA, 1410 nt, Artificial Sequence; identical to SEQ ID NO: 138754
  derived and/or modified sequence opt3 from neuraminidase__InfluenzaA__ADF58352

SEQ ID NO: 140623 - RNA, 1410 nt, Artificial Sequence
  derived and/or modified sequence opt3 from neuraminidase__InfluenzaA__ADF80459
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuauuacuacgaagagugcaguuguuauccugauagcuccgagauuacuugcgucugccgcgacaauuggcaugggucuaacagaccauggguuaccuucaaucagaaccucgaauaccagauaggauauaucuguagcggcauuuuuggcgauaauccgaggcccaacgacaaaacagggucaugcggaccugugaguuccaauggugcgaacggcguaaagggguucagcuuuaaguacggaaacggcguguggaucggucggaccaaaucuaucucaagucgcaauggguucgagaugauuugggauccaaacggcuggacgggaacugacaauaacuuuagcauaaagcaagacaucgucggcauuaaugaaugguccggguauucuggaucguucgugcagcaccccgagcugacaggucuggauuguauccgaccuugcuucuggguugaacucauuagaggcaggccaaaagagaacaccguguggacuagcggguccucaaucaguuuuuguggagucaauucugacacagugggcuggagcuggcccgauggugcagaguuaccguucaccauagacaaguga

SEQ ID NO: 140624 - RNA, 1410 nt, Artificial Sequence
  derived and/or modified sequence opt3 from neuraminidase__InfluenzaA__ADF80503
augaaccccaaucagaagaucauuaccauaggcagcgugugcaugacaaucgggauggccaaccugauucuccaaaucggaaauauuacuuccaucuggauaucucacucaauccagcuugguaaccagaaucagauugagacguguaaccaaagugucaucaccuacgaaaauaacacauggguuaaucagacuuaugugaacauuagcaauaccaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggacauuuuuccugacccagggggcucuacucaaugacaagcauucaaacggaacuaucaaagaucgcagucccuaucgaacacugaugagcuguccuaucggcgaggucccaucucccuacaacucccguuuugaaucaguggccuggagcgcaagugccugccacgacggcauuaauuggcuuaccauagggaucucuggaccugauaacggugcuguagcaguucugaaguauaauggcauuaucacggacacuauaaaguccuggagaaacaauauuuugaggacccaagagagcgagugugccugcgugaacgggucguguuucacagucaugacugauggaccaucugacggccaggcuuccuacaaaaucuuucggaucgaaaaggguaaaauugugaagucaguggagaugaaugcccccaacuauuacuacgaagagugcaguuguuauccugauagcuccgagauuaccugcgucugccgcgacaauuggcaugggucuaacagaccauggguuagcuucaaucagaaccucgaauaccagaucggauauauauguucaggcaucuuuggcgauaauccgaggcccaacgacaaaacagggaguugcggaccuguguccagcaauggugcgaacggcguaaagggguucucuuuuaaguacggaaacggcguguggauuggucggaccaaaucaaucaguagccgcaauggguucgagaugaucugggauccaaacggcuggacgggaacugacaauaacuuuuccauuaagcaagacauagucggcaucaaugaauggucuggguauucggggagcuucgugcagcaccccgagcugacaggucuggauuguauucgaccuugcuucuggguugaacucaucagaggcaggccaaaagagaacaccauuuggacuuccgggucaaguaucucuuuuuguggagugaauagcgacacagucggcugguccuggcccgauggugcagaguuaccguucaccauagacaaguga

SEQ ID NO: 140625 - RNA, 1410 nt, Artificial Sequence
  derived and/or modified sequence opt3 from neuraminidase__InfluenzaA__ADF83744
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagaagaauauuaccgaaaucguguauuugacaaacaccacuauugagaaagaaaucugccccaaguuagcugaguacagaaauuggaguaaaccucagugugacauaacaggguucgcaccauuuagcaaggauaacuccauuaggcugucugccggaggugacaucuggguaacccgggagcccuaugugucgugcgauccugacaaguguuaccaauucgcgcuaggccaggggacgacucucaauaacguccauucaaauaacaccgugcgcgaucgaacaccauaucguacucugcuuaugaaugaacugggaguucccuuucacuugggcaccaaacaggugugcauugcuuggagcaguuccucuugucaugacgguaaggccuggcuccacgucugcaucacaggggaugacaaaaacgcaaccgccagcuucaucuacaauggaagacugguggauuccguaguuucauggaguaaggagauucugaggacgcaggaaagcgagugugugugcauaaacggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuauccucgguacccaggcguucgcugugugugcagagacaacuggaaaggguccaauaggccgauaguagauauuaacaucaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccauuagcgagaaaucacgauugggauaugagacauuuaaggucaucgaagguuggaguaauccaaaauccaagcugcagauuaacagacaggugauaguagacaggggcaaucggagcggguacucuggaaucuucucaguugagggcaagaguuguauuaaccguugcuuuuauguggaacuaauccgcgguagaaaagaggaaacugagguccucuggaccagcaauuccaucguggucuucugugggacaucuggcacuuacggaaccggcucguggcccgauggggccgacauuaaccugaugccuauauga

SEQ ID NO: 140626 - RNA, 1410 nt, Artificial Sequence; identical to SEQ ID NO: 139608
  derived and/or modified sequence opt3 from neuraminidase__InfluenzaA__ADF83755

SEQ ID NO: 140627 - RNA, 1410 nt, Artificial Sequence
  derived and/or modified sequence opt3 from neuraminidase__InfluenzaA__ADF83766
augaaccccaaucagaagaucauuaccauaggcagcgugugcaugacaaucgggauggccaaccugauucuccaaaucggaaauauuaucuccauauggaucucucacucaauucagcuugguaaccagaaucagacugagacguguaaccaaagugucaucaccuacgaaaauaacacauggguuaaucagacuuaugugaacauuagcaauaccaacuucgcugcaggccaguccguagugucugucaaacuggccggaaauucgucauugugcccugugagcgggugggcgaucuacaguaaggacaacuccauaagaauuggcucuaaaggugauguuuuugugaucagggagccauucauuagcuguuccccguuagaaugccggacauuuuuccugacccagggggcucuacucaaugacaagcauucaaacggaacuaucaaagaucgcagucccuaucgaacacugaugagcuguccuaucggcgaggucccaucucccuacaacucccguuuugaaucaguggccuggagcgcaagugccugccacgacggcauuaauuggcuuaccauagggaucucuggaccugauaacggugcuguagcaguucugaaguauaauggcauuaucacggacacuauaaaguccuggagaaacaauauuuugaggacccaagagagcgagugugccugcgugaacgggucguguuucacagucaugacugauggaccaucugacggccaggcuuccuacaaaaucuuucggaucgaaaaggguaaaauugugaagucaguggagaugaaugcccccaacuaucauuacgaagagugcaguuguuacccugauagcuccgagauuaccugcgucugccgcgacaauuggcacgggucuaacagaccauggguuagcuucaaucagaaccucgaauaucagaucggauacauauguucaggcaucuuuggcgauaauccgaggcccaacgacaaaacagggaguugcggaccuguguccagcaauggugcgaacggcguaaagggguucucuuuuaaguaugauaacggaguguggauuggccggaccaaaucaaucaguagccgcaaugguuucgagaugaucugggacccaaacggguggacgggcacugacaauaacuuuuccauuaagcaagauauagucggaaucaaugaauggucuggcuacucggggagcuucgugcagcaucccgagcugacaggacuggacuguauucgaccuugcuucuggguugaacucaucagagguaggccaaaagagaacaccauuuggacuuccggcucaaguaucucuuuuuguggggugaauagcgauacagucggaugguccuggcccgacggcgcagaguuaccguucaccauagauaaguga

SEQ ID NO: 140628 - RNA, 1410 nt, Artificial Sequence; identical to SEQ ID NO: 138754
  derived and/or modified sequence opt3 from neuraminidase__InfluenzaA__ADF83776

SEQ ID NO: 140629 - RNA, 1410 nt, Artificial Sequence
  derived and/or modified sequence opt3 from neuraminidase__InfluenzaA__ADF83786
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauggcgacacugucgguuggagcuggcccgauggggcagaguuaccguucacaaucgacaaguga

SEQ ID NO: 140630 - RNA, 1410 nt, Artificial Sequence
  derived and/or modified sequence opt3 from neuraminidase__InfluenzaA__ADF83796
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucguccgaauuaaugaauggucuggcuacucggggagcuucgugcagcaucccgagcugacuggacuggauuguaucagaccuugcuucuggguugaacucauuaggggucggccaaaagagaacacaaucuggaccuccggcucaaguauaucuuuuuguggggugaauagcgacacugucggaugguccuggcccgauggcgcagaguuaccguucacaaucgacaaguga

SEQ ID NO: 140631 - RNA, 1410 nt, Artificial Sequence; identical to SEQ ID NO: 138754
  derived and/or modified sequence opt3 from neuraminidase__InfluenzaA__ADF83806

SEQ ID NO: 140632 - RNA, 1410 nt, Artificial Sequence; identical to SEQ ID NO: 140267
  derived and/or modified sequence opt3 from neuraminidase__InfluenzaA__ADF83816

SEQ ID NO: 140633 - RNA, 1410 nt, Artificial Sequence; identical to SEQ ID NO: 138754
  derived and/or modified sequence opt3 from neuraminidase__InfluenzaA__ADF83826

SEQ ID NO: 140634 - RNA, 1410 nt, Artificial Sequence; identical to SEQ ID NO: 138754
  derived and/or modified sequence opt3 from neuraminidase__InfluenzaA__ADF83836

SEQ ID NO: 140635 - RNA, 1410 nt, Artificial Sequence; identical to SEQ ID NO: 138754
  derived and/or modified sequence opt3 from neuraminidase__InfluenzaA__ADF83846

SEQ ID NO: 140636 - RNA, 1410 nt, Artificial Sequence; identical to SEQ ID NO: 138754
  derived and/or modified sequence opt3 from neuraminidase__InfluenzaA__ADF83856

SEQ ID NO: 140637 - RNA, 1410 nt, Artificial Sequence; identical to SEQ ID NO: 140105
  derived and/or modified sequence opt3 from neuraminidase__InfluenzaA__ADF83866

SEQ ID NO: 140638 - RNA, 1410 nt, Artificial Sequence; identical to SEQ ID NO: 140535
  derived and/or modified sequence opt3 from neuraminidase__InfluenzaA__ADF83876

SEQ ID NO: 140639 - RNA, 1410 nt, Artificial Sequence; identical to SEQ ID NO: 140185
  derived and/or modified sequence opt3 from neuraminidase__InfluenzaA__ADF83888

SEQ ID NO: 140640 - RNA, 1410 nt, Artificial Sequence
  derived and/or modified sequence opt3 from neuraminidase__InfluenzaA__ADF83898
augaaccccaaucagaagaucauuaccauaggcagcgugugcaugacaaucgggauggccaaccugauucuccaaaucggaaauauuaucuccauauggaucucucacccuauucagcuugguaaccagaaucagaucgagacuuguaaccaaucagucauuacguacgaaaauaacaccuggguuaaucagacauaugugaacaucaguaauacuaacuucgcugcaggccagagcguaguguccgucaaacuggccggaaauucuucguugugcccagugucagggugggcgauauacagcaaggacaacaguauuagaaucggcuccaaaggugauguuuuugugauuagggagccguucaucucuuguagccccuuagaaugccggaccuuuuuccugacacagggggcucuacucaaugacaagcauuccaacggaaccaucaaagaucgcucaccuuaucgaacucugaugaguuguccaauuggcgagguccccagcccuuacaacucucguuuugaauccguggccuggucagcaagcgccugccacgacggcauaaauuggcuuacaaucgggauuaguggaccagauaacggugcuguagcaguucugaaguauaauggcaucauaaccgacacgauuaagucuuggagaaacaauaucuugaggacucaagaguccgagugugccugcgugaacgggagcuguuucaccgucaugacagauggacccucggacggccaggcuucuuacaaaaucuuucggauugaaaaggguaaaaucgugaaguccguggagaugaaugccccuaacuaucauuacgaagagugcucauguuacccagauaguagcgagauuacuugcgucugccgcgacaauuggcacggguccaacagaccguggguuucuuucaaucagaaccucgaauaucagauaggauacaucuguagcggcauuuuuggcgauaaucccaggccuaacgacaaaaccgggucaugcggaccagugaguuccaauggugcgaacggcguaaagggguucagcuuuaaguauggaaacggcguguggaucggucggacaaaaucuaucucaagucgcaauggguucgagaugauuugggaucccaacggcuggaccggaacggacaauaacuuuagcauaaagcaagacaucgucggcauuaaugaaugguccggguacucuggaucguucgugcagcauccugagcugacuggucuggauuguauccgaccaugcuucuggguugaacucauuagaggcaggcccaaagagaacacaaucuggaccagcggguccucaauaaguuuuuguggagucaauucugacacugugggcuggagcuggccggauggugcagaguuaccuuucacaaucgacaaguga

SEQ ID NO: 140641 - RNA, 1410 nt, Artificial Sequence; identical to SEQ ID NO: 138754
  derived and/or modified sequence opt3 from neuraminidase__InfluenzaA__ADF83908

SEQ ID NO: 140642 - RNA, 1410 nt, Artificial Sequence; identical to SEQ ID NO: 138754
  derived and/or modified sequence opt3 from neuraminidase__InfluenzaA__ADF83918

SEQ ID NO: 140643 - RNA, 1410 nt, Artificial Sequence; identical to SEQ ID NO: 138754
  derived and/or modified sequence opt3 from neuraminidase__InfluenzaA__ADF84444

SEQ ID NO: 140644 - RNA, 1410 nt, Artificial Sequence; identical to SEQ ID NO: 138754
  derived and/or modified sequence opt3 from neuraminidase__InfluenzaA__ADF84462

SEQ ID NO: 140645 - RNA, 1410 nt, Artificial Sequence
  derived and/or modified sequence opt3 from neuraminidase__InfluenzaA__ADF84472
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcagagcaguccguagugucugucaaacuggccggcaauucgucauugugcccugugagcgggugggcgauauacaguaaggacaacuccauuagaaucggaucuaaaggcgauguuuuugugauuagggaaccauucaucagcuguuccccguuagagugccggaccuuuuuccugacacagggugcucuacucaaugacaagcauucaaacgggaccaucaaagaucgcagucccuaucgaacucugaugagcuguccuauuggagaagucccaucucccuacaacucccguuuugagucaguggccuggagcgcaagugccugccacgacggcauaaauuggcuuacaaucggcauuucugggccugauaacggagcuguagcaguucugaaguauaaugguaucauaaccgacacgauuaaguccuggagaaacaauaucuugaggacucaagagagcgaaugugccugcgugaacggcucguguuucaccgucaugacagaugggccaucugacggacaggcuuccuacaaaaucuuucggauugagaagggcaaaaucgugaagucaguggaaaugaaugcccccaacuaucauuacgaggagugcaguuguuacccugauagcuccgaaauuacuugcgucugccgcgacaauuggcacgguucuaacagaccauggguuagcuucaaucagaaccucgaguaucagauaggguacaucuguucaggaauuuuuggcgauaauccgaggcccaacgacaaaaccggcaguugcgggccuguguccagcaauggagcgaacgguguaaagggcuucucuuuuaaguaugggaacggaguguggaucggccggacaaaaucaaucaguagccgcaaugguuucgaaaugauuugggauccaaacggguggaccggcacggacaauaacuuuuccauaaagcaagacaucgucggaauuaaugaguggucuggcuacucggggagcuucgugcagcaucccgaacugacuggacuggauuguauccgaccuugcuucuggguugagcucauuagagguaggccaaaagagaacacaaucuggaccuccggcucaaguauaucuuuuuguggggugaauagcgacacugucggaugguccuggcccgauggcgcagaauuaccguucacaaucgacaaguga

SEQ ID NO: 140646 - RNA, 1410 nt, Artificial Sequence
  derived and/or modified sequence opt3 from neuraminidase__InfluenzaA__ADF84482
augaaccccaaucagaagaucauuauaaucggcagcgugugcaugaccauugggauggccaaccugauccuccaaauuggaaauaucauauccaucuggauuucucacucaauccagcuugguaaccagaaucagauugagacauguaaccaaagugucaucacuuacgaaaauaacacguggguuaaucagaccuaugugaacauaagcaauacaaacuucgcugcaggccaguccguagugucugucaaacuggccggaaauucgucauugugcccugugagcgggugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggucccaucucccuacaacucccguuuugaaucaguggccuggagcgcaagugccugccacgacggcaucaauuggcuuacuauugggaucucuggaccugauaacggugcuguagcaguucugaaguauaauggcauaauuacagacaccaucaaguccuggagaaacaauaucuugaggacgcaagagagcgagugugccugcgugaacgggucguguuucacugucaugaccgauggaccaucugacggccaggcuuccuacaaaauuuuucggaucgaaaaggguaaaauugugaagucaguggagaugaaugcccccaacuaucauuacgaagagugcaguuguuacccugauagcuccgagauaacaugcgucugccgcgacaauuggcacgggucuaacagaccauggguuagcuucaaucagaaccucgaauaucagaucggauacauuuguucaggcaucuuuggcgauaauccgaggcccaacgacaaaacugggaguugcggaccuguguccagcaauggugcgaacggcguaaagggguucucuuuuaaguauggaaacggcguguggaucggucggaccaaaucaauuaguagccgcaauggguucgagaugauaugggauccaaacggcuggacaggaaccgacaauaacuuugcaaucaagcaagacauugucggcaucaaugaaugguccggguacucuggaucguucgugcagcaucccgagcugacgggucuggauuguauucgaccuugcuucuggguugaacucaucagaggcaggccaaaagagaacacuauauggacaagcggguccucaaucaguuuuuguggagucaauucugacaccgugagcugguccuggcccgauggcgccgaguuaccguucacuauugacaaguga

SEQ ID NO: 140647 - RNA, 1410 nt, Artificial Sequence
  derived and/or modified sequence opt3 from neuraminidase__InfluenzaA__ADF84492
augaaccccaaucagaagaucauuaccauaggcagcgugugcaugacaaucgggauggccaaccugauucuccaaaucggaaauauuaucuccauauggaucucucacucaauucagcuugguaaccaggaccagaucgagacuuguaaucaaagugucauuacguacgaaaacaauaccuggguuaaccagacauaugugaauaucagcaacacuaauuucgcugcaggccaguccguagugucugucaaacuggccgggaacucgucauugugcccugugagcggaugggcgauauacaguaaggauaauuccauuagaaucggcucuaaaggugacguuuuugugauuagggagccauucaucagcuguuccccguuagaaugccggaccuuuuuccugacacagggggcucuacucaacgauaagcauucaaauggaaccaucaaagaccgcagucccuaucgaacucugaugagcuguccuauuggcgaggucccaucucccuacaacucccguuuugaaucaguggccuggagcgcaagugccugccacgauggcauaaacuggcuuacaaucgggauuucuggaccugacaauggugcuguagcaguucugaaguauaacggcaucauaaccgauacgauuaaguccuggagaaauaacaucuugaggacucaagagagcgagugugccugcgugaaugggucguguuucaccgucaugacagacggaccaucugauggccaggcuuccuacaaaaucuuucggauugaaaaggguaaaaucgugaagucaguggagaugaacgcccccaauuaucauuacgaagagugcaguuguuacccugacagcuccgagauuacuugcgucugccgcgauaacuggcacgggucuaauagaccauggguuagcuucaaccagaaucucgaauaucagauaggauacaucuguucaggcauuuuuggcgacaacccgaggcccaaugauaaaaccgggaguugcggaccuguguccagcaacggugcgaauggcguaaagggguucucuuuuaaguauggaaacggcguguggaucggucggacaaaaucaaucaguagccgcaacggguucgagaugauuugggacccaaauggcuggaccggaacggacaacaauuuuuccauaaagcaagauaucgucggcauuaacgaauggucuggguacucggguagcuucgugcagcaucccgagcugacuggacuggacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 140648 - RNA, 1410 nt, Artificial Sequence; identical to SEQ ID NO: 139861
  derived and/or modified sequence opt3 from neuraminidase__InfluenzaA__ADF85020

SEQ ID NO: 140649 - RNA, 1410 nt, Artificial Sequence; identical to SEQ ID NO: 138754
  derived and/or modified sequence opt3 from neuraminidase__InfluenzaA__ADF87155

SEQ ID NO: 140650 - RNA, 1410 nt, Artificial Sequence
  derived and/or modified sequence opt3 from neuraminidase__InfluenzaA__ADF87165
augaaccccaaucagaagaucauuauaaucggcagcgugugcaugaccauugggauggccaaccugauccuccaaauuggaaauaucauauccaucuggauuucucacucaauccagcuugguaaccagaaucagauugagacauguaaccaaagugucaucacuuacgaaaauaacacguggguuaaucagaccuaugugaacauaagcaauacaaacuucgcugcaggccaguccguagugucugucaaacuggccggaaauucgucauugugcccugugagcgggugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggucccaucucccuacaacucccguuuugaaucaguggccuggagcgcaagugccugccacgacggcaucaauuggcuuacuauugggaucucuggaccugauaacggugcuguagcaguucugaaguauaauggcauaauuacagacaccaucaaguccuggagaaacaauaucuugaggacgcaagagagcgagugugccugcgugaacgggucguguuucacugucaugaccgauggaccaucugacggccaggcuuccuacaaaauuuuucggaucgauaaggguaaaauugugaagucaguggaaaugaaugcccccaacuaucauuacgaggaaugcaguuguuacccugacagcuccgagauaacaugcgucugccgcgauaauuggcacgggucuaacagaccauggguuagcuucaaucagaaccucgaguaucagaucggauacauuuguucaggcaucuuuggcgacaauccgaggcccaacgauaaaacugggaguugcggaccuguguccagcaauggugcgaacggcguaaagggguucucuuuuaaguauggaaacggcguguggaucggucggaccaaaucaauuaguagccgcaauggguucgaaaugauaugggacccaaacggcuggacaggaaccgacaauaacuuugcaaucaagcaagauauugucggcaucaaugagugguccggguacucuggaucguucgugcagcaucccgaacugacgggucuggacuguauucgaccuugcuucuggguugagcucaucagaggcaggccaaaagaaaacacuauauggacaagcggguccucaaucaguuuuuguggagucaauucugauaccgugggcuggagcuggcccgacggugccgaguuaccguucacuauugauaaguga

SEQ ID NO: 140651 - RNA, 1410 nt, Artificial Sequence; identical to SEQ ID NO: 140645
  derived and/or modified sequence opt3 from neuraminidase__InfluenzaA__ADF87175

SEQ ID NO: 140652 - RNA, 1410 nt, Artificial Sequence; identical to SEQ ID NO: 138754
  derived and/or modified sequence opt3 from neuraminidase__InfluenzaA__ADF87185

SEQ ID NO: 140653 - RNA, 1410 nt, Artificial Sequence; identical to SEQ ID NO: 140645
  derived and/or modified sequence opt3 from neuraminidase__InfluenzaA__ADF87195

SEQ ID NO: 140654 - RNA, 1410 nt, Artificial Sequence; identical to SEQ ID NO: 138754
  derived and/or modified sequence opt3 from neuraminidase__InfluenzaA__ADF87205

SEQ ID NO: 140655 - RNA, 1410 nt, Artificial Sequence; identical to SEQ ID NO: 138754
  derived and/or modified sequence opt3 from neuraminidase__InfluenzaA__ADF87215

SEQ ID NO: 140656 - RNA, 1410 nt, Artificial Sequence
  derived and/or modified sequence opt3 from neuraminidase__InfluenzaA__ADF87235
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuuaagauugaaaaagguaagaucgugaaaucaguggagaugaaugcccccaacuaucauuacgaagagugcaguuguuacccugauagcuccgagauuacuugcgucugccgggacaauuggcacgggucuaaccgcccauggguuagcuucaaucagaaccucgaauaucagauaggauacaucuguucaggcauuuuuggcgauaauccgagacccaacgacaagaccgggaguugcggaccuguguccagcaauggugcgaacggcguaaagggguucucuuuuaaauauggaaacggcguguggaucgguaggacaaagucaaucaguagccggaauggguucgagaugauuugggauccaaacggcuggaccggaacggacaauaacuuuuccauaaaacaagacaucgucggcauuaaugaauggucuggguacucggggagcuucgugcagcaucccgagcugacuggucuggauuguauccgcccuugcuucuggguugaacucauucgaggcagaccaaaggagaacacaaucuggaccuccgggucaaguauaucuuuuuguggagugaauagcgacacugucggcugguccuggcccgauggugcagaguuaccguucacaaucgacaaauga

SEQ ID NO: 140657 - RNA, 1410 nt, Artificial Sequence; identical to SEQ ID NO: 140645
  derived and/or modified sequence opt3 from neuraminidase__InfluenzaA__ADF87245

SEQ ID NO: 140658 - RNA, 1410 nt, Artificial Sequence; identical to SEQ ID NO: 140645
  derived and/or modified sequence opt3 from neuraminidase__InfluenzaA__ADF87265

SEQ ID NO: 140659 - RNA, 1410 nt, Artificial Sequence
  derived and/or modified sequence opt3 from neuraminidase__InfluenzaA__ADF87285
augaaccccaaucagaagaucauuaccauaggcagcgugugcauguccaucgggauggccaaccugauucuccaaaucggaaauauuaucucuauauggaucucacacaguauucagcuugguaacaaaaaucagaucgagacauguaaccagagcgucauuacuuacgaaaauaacacguggguuaaucaaaccuaugugaacaucuccaauacaaacuucgcugcaggccagucuguagugucggucaagcuggccgggaauagcucauugugcccugugaguggaugggcgauauacuccaaagacaacucuauuagaaucggcagcaagggugauguuuuugugauuagggagccauucaucuccuguucaccguuagaaugccggaccuuuuuccugacucagggggcucuacucaaugacaaacauaguaacggaacaaucaaggaucgcagccccuaucgaacccugaugucuuguccuauuggcgaggucccaucccccuacaacucacguuuugaaagcguggccuggagugcaucugccugccacgacggcauaaauuggcuuacuaucgggauuuccggaccugauaacggugcuguagcaguucugaaguauaauggcaucauaacagacaccauuaaaagcuggagaaacaauaucuugaggacgcaggagucggagugugccugcgugaacgggucuuguuucacugucaugaccgauggaccauccgacggccaggcuucauacaagaucuuucggauugaaaaagguaagaucgugaaaaguguggagaugaaugcccccaacuaucauuacgaagagugcagcuguuacccugauuccucugagauuacaugcgucugccgcgacaauuggcacgggagcaacagaccauggguuucauucaaucaaaaccucgaauaucagauaggauacaucuguaguggcauuuuuggcgauaauccgaggcccaacgacaagaagggguccugcggaccugugagcucuaauggugcgaacggcguaaaaggguucucauuuaaguauggaaacggcguguggaucggucggacuaaaaguaucagcucccgcaauggguucgagaugauuugggauccaaacggcuggaccggaacagacaauaacuuuucuauaaagcaggacaucgucggcaugaaugaauggucgggguacagcggauccuucgugcaacaucccgagcugaccggucuggauuguauucgaccuugcuucuggguugaacucaucagaggcaggccaaaagagaacacgauuuggacuucagggaguucuaucagcuuuuguggagucaauuccgacacagugggcuggucauggcccgauggugcagaguuaccguucaccauagacaaguga

SEQ ID NO: 140660 - RNA, 1410 nt, Artificial Sequence; identical to SEQ ID NO: 138754
  derived and/or modified sequence opt3 from neuraminidase__InfluenzaA__ADF87295

SEQ ID NO: 140661 - RNA, 1410 nt, Artificial Sequence; identical to SEQ ID NO: 138754
  derived and/or modified sequence opt3 from neuraminidase__InfluenzaA__ADF87305

SEQ ID NO: 140662 - RNA, 1410 nt, Artificial Sequence; identical to SEQ ID NO: 138754
  derived and/or modified sequence opt3 from neuraminidase__InfluenzaA__ADF87334

SEQ ID NO: 140663 - RNA, 1410 nt, Artificial Sequence; identical to SEQ ID NO: 138754
  derived and/or modified sequence opt3 from neuraminidase__InfluenzaA__ADF87344

SEQ ID NO: 140664 - RNA, 1410 nt, Artificial Sequence
  derived and/or modified sequence opt3 from neuraminidase__InfluenzaA__ADF87354
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauuacuuuuccauaaagcaagacaucgucggcauuaacgaauggucuggguauucggggagcuucgugcagcaucccgagcugacuggucuggauuguauccgaccuugcuucuggguugaacucauuagaggcaggccaaaagagaauacaaucuggaccuccgggucaaguauaucuuuuuguggagugaacagcgacacugucggcugguccuggcccgauggugcagaguuaccguucacaaucgacaaguga

SEQ ID NO: 140665 - RNA, 1410 nt, Artificial Sequence; identical to SEQ ID NO: 139337
  derived and/or modified sequence opt3 from neuraminidase__InfluenzaA__ADF87364

SEQ ID NO: 140666 - RNA, 1410 nt, Artificial Sequence; identical to SEQ ID NO: 138754
  derived and/or modified sequence opt3 from neuraminidase__InfluenzaA__ADF87374

SEQ ID NO: 140667 - RNA, 1410 nt, Artificial Sequence
  derived and/or modified sequence opt3 from neuraminidase__InfluenzaA__ADF87384
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaaguauuaucacguacgaaaauaacaccugggucaaucagacauauguuaacauaagcaauacuaacuucgcugcaggccaguccgugguaucugugaaacuggccggaaauucgucauugugcccugucagcggaugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaauggguucgagaugauaugggauccaaacggcuggaccggaacggacaauaacuuuuccaucaagcaagacauugugggcaucaaugaauggucuggguacucggggagcuucguccagcaucccgagcugacuggucuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 140668 - RNA, 1410 nt, Artificial Sequence; identical to SEQ ID NO: 138754
  derived and/or modified sequence opt3 from neuraminidase__InfluenzaA__ADF97251

SEQ ID NO: 140669 - RNA, 1410 nt, Artificial Sequence; identical to SEQ ID NO: 139997
  derived and/or modified sequence opt3 from neuraminidase__InfluenzaA__ADF97252

SEQ ID NO: 140670 - RNA, 1410 nt, Artificial Sequence; identical to SEQ ID NO: 138754
  derived and/or modified sequence opt3 from neuraminidase__InfluenzaA__ADF97253

SEQ ID NO: 140671 - RNA, 1410 nt, Artificial Sequence; identical to SEQ ID NO: 138754
  derived and/or modified sequence opt3 from neuraminidase__InfluenzaA__ADF97254

SEQ ID NO: 140672 - RNA, 1410 nt, Artificial Sequence
  derived and/or modified sequence opt3 from neuraminidase__InfluenzaA__ADF97255
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaaucauuuuuccauaaagcaagacaucgucggcauuaacgaauggucuggguacucggggagcuucgugcagcaccccgagcugacuggucuggauuguauccgaccuugcuucuggguugaacucauuagaggcaggccaaaagagaauacaaucuggaccuccgggucaaguauaucuuuuuguggagugaacagcgacacugucggcugguccuggcccgauggugcagaguuaccguucacaaucgacaaguga

SEQ ID NO: 140673 - RNA, 1410 nt, Artificial Sequence; identical to SEQ ID NO: 138754
  derived and/or modified sequence opt3 from neuraminidase__InfluenzaA__ADF97256

SEQ ID NO: 140674 - RNA, 1410 nt, Artificial Sequence; identical to SEQ ID NO: 138754
  derived and/or modified sequence opt3 from neuraminidase__InfluenzaA__ADF97257

SEQ ID NO: 140675 - RNA, 1410 nt, Artificial Sequence; identical to SEQ ID NO: 139108
  derived and/or modified sequence opt3 from neuraminidase__InfluenzaA__ADF97837

SEQ ID NO: 140676 - RNA, 1410 nt, Artificial Sequence; identical to SEQ ID NO: 138754
  derived and/or modified sequence opt3 from neuraminidase__InfluenzaA__ADG08120

SEQ ID NO: 140677 - RNA, 1350 nt, Artificial Sequence
  derived and/or modified sequence opt3 from neuraminidase__InfluenzaA__ADG21408
augaaccccaaucagaagaucauuaccauaggcagcaucugcauggugauugggaucgucucccugaugcuccaaauuggaaacaugaucucuauauggguuucacacaguauccagacagguaaucagugucaggacgagccuauuagcaacacuaaauuccuuacggaaaaggccguggcuuccguaacccuggcaggcaauuugucuuuaugcccagugucggggugggccgucuacucaaaagauaacagcaucagaauuggaaguaggggcgacguguuuguuauccgggagccguucauauccuguucucaucuggaaugccgcacauuuuuccuaacucaaggugcgcuccugaaugauaagcacagcaacgggaccgugaaagaccgaucaccccaucguacacuuauguccuguccugucggagaggcuccaagucccuauaauagcagauuugaaucuguggccugguccgcaucagccugccacgauggcaccagcuggcugacuauuggcaucagugggccugacaacggagcuguagcaguuuugaaguacaaugguauuaucacagauaccaucaagucuuggaggaacaauauuaugcggacgcaggaguccgagugugccugcgugaacggcagcuguuucacugucaugaccgacgggccaucgucuggacaggcuuccuauaaaauauuuaagauggaaaaaggcaagguggugaaaucagucgagcucgaugcccccaauuaccauuaugaagagugcaguuguuacccugacgcgggugagaucacaugcguuugccgcgauaacuggcacgggagcaacagaccauggguguccuucaaucagaaccuggaauaucaaauuggauacaucuguucuggcguauuuggcgacaauccgaggcccaacgaugggacuggaagcugcgguccuguguucccaaauggcgcauacggggucaagggauuuucauucaaguauggcaacgguguguggauagggcggaccaaaaguacaaauucccgcagcggcuuugagaugauuugggaccccaacggauggaccggcacggacucuucauucaguguuaagcaggauaucguggccaucacugacuggagcggguacuccggaucuuucguccagcacccugaacugacaggucucgauuguauucgaccaugcuuuuggguggaguuaaucagaggcaggcccaaagaaucgaccauuuggacuagcggguccucaauaaguuucuguggaguaaauggcgacacaguuucuuggagcuggccggauggugcugagcugccuuuuaccaucgacaaguga

SEQ ID NO: 140678 - RNA, 1350 nt, Artificial Sequence; identical to SEQ ID NO: 139039
  derived and/or modified sequence opt3 from neuraminidase__InfluenzaA__ADG21409

SEQ ID NO: 140679 - RNA, 1350 nt, Artificial Sequence; identical to SEQ ID NO: 139039
  derived and/or modified sequence opt3 from neuraminidase__InfluenzaA__ADG21415

SEQ ID NO: 140680 - RNA, 1350 nt, Artificial Sequence; identical to SEQ ID NO: 139039
  derived and/or modified sequence opt3 from neuraminidase__InfluenzaA__ADG21417

SEQ ID NO: 140681 - RNA, 1350 nt, Artificial Sequence
  derived and/or modified sequence opt3 from neuraminidase__InfluenzaA__ADG21419
augaaccccaaucagaagaucauuaccauaggcagcaucugcauggugauugggaucgucucccugaugcuccaaauuggaaacaugaucucuauauggguuucacacaguauccagacagguaaucagugucaggacgagagcauuuccaacacuaaauuccuuacggaaaaggccguggcuucuguaacccuggcaggcaauucgucauugugcccuaucagcgggugggccguguacaguaaagauaacuccauuagaaucggaucuaggggcgacgucuuugugauacgggagccauucauuagcuguucccauuuagaaugccgcacauuuuuccugacucaaggugcgcuacucaaugauaagcacucaaacgggaccguuaaagaccgaaguccgcaucguacacugaugagcugucccgugggagaggcuccuucuccauauaauuccagauuugaaucagucgccuggagcgcaagugccugccacgauggcaccucuuggcuuacuaucggcauuuccgggcccgacaacggagcuguggcaguacugaaguacaaugguaucaucacagauaccauuaagagcuggaggaacaauauaaugcggacgcaggagucggagugugccugcguuaacggcucuuguuucacugugaugaccgacgggccuuccucaggacaggcuaguuauaaaaucuuuaagauggaaaaaggcaaggucgugaaaagcguggaguuggaugccccaaauuaccauuaugaagagugcuccuguuaccccgacgcgggugagauuacaugcgucugccgcgauaacuggcacgggucuaacagaccuuggguuagcuucaaucagaaccucgaauaucaaaucggauacauauguucaggcguguuuggcgacaauccaaggccgaacgaugggacuggaaguugcggucccguauucccuaauggcgcauacggggugaagggauuuuccuucaaguauggcaacggugucuggauugggcggaccaaaagcacaaauucucgcucaggcuuugagaugaucugggacccaaacggauggaccggcacggacaguagcuucuccgugaagcaggauaucguugccauuacugacuggucuggguacucggguagcuucgugcagcaccccgaacugacaggacuggauuguauccgaccuugcuuuugggucgagcucauuagaggcaggccaaaagaauccaccauauggacuucagggaguucuaucagcuucuguggagugaauggcgacacaguauccuggucauggcccgauggugcugaguuaccguuuaccauugacaaguga

SEQ ID NO: 140682 - RNA, 1350 nt, Artificial Sequence
  derived and/or modified sequence opt3 from neuraminidase__InfluenzaA__ADG21423
augaaccccaaucagaagaucauuaccauaggcagcaucugcauggugauugggaucgucucccugaugcuccaaauuggaaacaugaucucuauauggguuucacacaguauccagacagguaaucagugucaggacgagccuauuagcaacacuaaauuccuuacggaaaaggccguggcuuccguaacccuggcaggcaauucuucguugugcccaaucucagggugggccguguacagcaaagauaacaguauuagaaucggauccaggggcgacgucuuugugauacgggagccguucauuucuuguagccauuuagaaugccgcacauuuuuccugacucaaggugcgcuacucaaugauaagcacuccaacgggaccguuaaagaccgaucaccccaucguacacugaugaguuguccugugggagaggcuccaagccccuauaauucuagauuugaauccgucgccuggucagcaagcgccugccacgauggcaccaguuggcuuacuaucggcauuucugggccugacaacggagcuguggcaguacugaaguacaaugguaucaucacagauaccauuaaguccuggaggaacaauauaaugcggacgcaggagagcgagugugccugcguuaacggcucguguuucacugugaugaccgacgggccaucuuccggacaggcuucauauaaaaucuuuaagauggaaaaaggcaaggucgugaaaaguguggaguuggaugcccccaauuaccauuaugaagagugcagcuguuacccugacgcgggugagauuacaugcgucugccgcgauuccuggcacgggucuaacagaccauggguuagcuucaaccagaaucucgaauaucaaaucggauacauauguucaggcguguuuggcgacaacccgaggcccaaugaugggacuggaaguugcgguccuguauucccaaacggcgcauacggggugaagggauuuuccuucaaguauggcaauggugucuggauugggcggaccaaaagcacaaacucucgcucaggcuuugagaugaucugggaccccaauggauggaccggcacggacaguagcuucuccgugaagcaggauaucguugccauuacugacuggucuggguacucggguagcuucgugcagcacccugaacugacaggacuggauuguauccgaccaugcuuuugggucgagcucauuagaggcaggcccaaagaauccaccauauggacuucagggaguucuaucagcuucuguggagugaacggcgacacaguauccuggucauggccggauggugcugaguuaccuuuuaccauugacaaguga

SEQ ID NO: 140683 - RNA, 1350 nt, Artificial Sequence
  derived and/or modified sequence opt3 from neuraminidase__InfluenzaA__ADG21424
augaaccccaaucagaagaucauuaccauaggcagcaucugcauggugauugggaucgccucccugaugcuccaaauuggaaacaugaucucuauaugggucucacacaguauccagacagguaaucagugucaggacgagagcauuuccaacacuaaauuccuuacggaaaaggcuguugcaucugugacccuggccggcaauucgucauugugcccuaucagcgggugggcgguauacaguaaagauaacuccauuagaaucggaucuaagggcgacguguuugucauaagggagccauucauuagcuguucccauuuagaaugccggacauuuuuccugacucaaggugcucuacucaaugauaaacacucaaacgggaccgugaaggaccgcaguccgcaucgaacacugaugagcugucccguuggagaggccccuucuccauauaauucccguuuugaaucaguggcauggagcgccagugcuugccacgauggcaccucuuggcuuacuaucggcauuuccgggcccgacaacggagcagucgccgugcugaaguacaaugguaucaucacagauaccauuaaaagcuggagaaacaauauaaugaggacgcaggagucggagugugcuugcguaaacggcucuuguuucacuguuaugaccgacgggccuuccucaggacaggccaguuauaagaucuuuaaaauggaaaagggcaaaguggucaagagcguggaguuggaugcgccaaauuaccauuaugaagagugcuccuguuaccccgacgcaggagagauuacaugcgugugccgggauaacuggcacgggucuaaccgcccuugggucagcuucaaucagaaccucgaauaucaaaucggauacauauguucaggcguuuuuggcgacaauccaagaccgaacgaugggacuggaaguugcggucccguguucccuaauggcgccuacgggguaaagggauuuuccuucaaauauggcaacgguguguggauugggaggaccaagagcacaaauucucggucaggcuuugagaugaucugggacccaaacggauggaccggcacggacaguagcuucuccgucaaacaggauaucguggcuauuacugacuggucuggguacucggguagcuucguucagcaccccgaacugacaggucuggauuguauccgcccuugcuuuuggguggagcucauucgaggcagaccaaaggaauccaccauauggacuucagggaguucuaucagcuucuguggagucaauggcgacacaguguccuggucauggcccgauggugccgaguuaccguuuaccauugacaaauga

SEQ ID NO: 140684 - RNA, 1350 nt, Artificial Sequence
  derived and/or modified sequence opt3 from neuraminidase__InfluenzaA__ADG21426
augaaccccaaucagaagaucauuaccauaggcagcaucugcauggugauugggaucgucucccugaugcuccaaauuggaaacaugaucucuauauggguuucacacaguauccagacagagaaucagugucaggacgaaccuauuagcaacacuaaauuccuuacggagaaggccguggcuuccguaacccuggcagguaauucuucguugugcccaaucucaggcugggccguguacagcaaagauaacaguauuagaaucggguccaggggagacgucuuugugauacgggaaccguucauuucuuguagccauuuagagugccgcacauuuuuccugacucaaggcgcgcuacucaaugauaagcacuccaacgguaccguuaaagaccgaucaccccaucguacacugaugaguuguccugugggggaagcuccaagccccuauaauucuagauuugaguccgucgccuggucagcaagcgccugccacgauggaaccaguuggcuuacuaucggcauuucuggcccugacaacggggcuguggcaguacugaaguacaauggaaucaucacagauaccauuaaguccuggaggaacaauauaaugcggacgcaggagagcgaaugugccugcguuaacgguucguguuucacugugaugaccgacggcccaucuuccgggcaggcuucauauaaaaucuuuaagauggagaaaggaaaggucgugaaaaguguggaauuggaugcccccaauuaccauuaugaggagugcagcuguuacccugacgcgggcgaaauuacaugcgucugccgcgauaacuggcacgguuccaacagaccauggguuucuuucaaucagaaccucgaguaucaaaucggguacauauguagcggaguguuuggcgacaauccgaggcccaacgauggcacugggucaugcggaccuguauucccaaauggugcauacggcgugaagggguuuaguuucaaguauggaaacggcgucuggauuggucggaccaaauccacaaauagccgcucuggguuugaaaugaucugggaccccaacggcuggaccggaacggacucaaguuucagcgugcgacaggauaucguugccauuacugacugguccggcuacucugggucguucgugcagcacccugagcugacaggacuggauuguaucagaccaugcuuuugggucgaacucauuaggggucggcccaaggagagcaccauauggacuuccggcucaaguaucucuuucuguggggugaauggagacacaguaagcugguccuggccggauggcgcugaguuaccuuuuaccauugacaaauga

SEQ ID NO: 140685 - RNA, 1350 nt, Artificial Sequence
  derived and/or modified sequence opt3 from neuraminidase__InfluenzaA__ADG21428
augaaccccaaucagaagaucauuaccauaggcagcaucugcauggugauugggaucgucucccugaugcuccaaauuggaaacaugaucucuauauggguuucacacccuauccagacagguaaucagugucaggacaaaccaauuaguaacacuaaguuccuuacggagaaagccguggcuagcguaacccuggcaggcaauuccucuuugugcccgaucucggggugggccguguacucaaaggauaacagcauuagaaucggaaguaggggcgacgucuuugugauacgggaacccuucauuuccuguucucauuuagagugccgcacauuuuuccugacucaaggugcgcuacucaaugauaaacacagcaacgggaccguuaaggaccgauccccucaucguacacugaugucauguccagugggagaagcucccaguccuuauaauagcagauuugagucugucgccugguccgcaucagccugccacgauggcaccagcuggcuuacuaucggcauuagugggccagacaacggagcuguggcaguacugaaguacaaugguaucaucacagauaccauuaaaucuuggaggaacuccauaaugcggacgcaggaaagcgagugugccugcguuaauggcucguguuucacugugaugaccgacgggcccucuuccggacaggcuucauauaagaucuuuaaaauggagaagggcaaagucgugaagaguguggaauuggaugccccuaacuaccauuaugaggaaugcagcuguuacccagacgcgggugagauuacaugcgucugccgcgauaauuggcacggguccaacagaccguggguuucuuucaaccagaaucucgaguaucaaaucggauacauauguagcggcguguuuggcgacaaccccaggccuaaugaugggacuggaucaugcgguccaguauuccccaacggcgcauacggggugaagggauuuaguuucaaauauggcaauggugucuggauugggcggaccaaguccacaaacagccgcucuggcuuugaaaugaucugggacccuaauggauggaccggcacggacucaaguuucagcgugaaacaggauaucguugccauuacugacugguccggguacucuggaucguucgugcagcacccagagcugacaggucuggauuguauccgacccugcuuuugggucgaacucauuagaggcaggccgaaggagagcaccauauggacuuccgggucaaguaucucuuucuguggagugaacggcgacacaguaagcugguccuggccugauggugcugaauuacccuuuaccauugacaaauga

SEQ ID NO: 140686 - RNA, 1350 nt, Artificial Sequence; identical to SEQ ID NO: 139039
  derived and/or modified sequence opt3 from neuraminidase__InfluenzaA__ADG21430

SEQ ID NO: 140687 - RNA, 1350 nt, Artificial Sequence
  derived and/or modified sequence opt3 from neuraminidase__InfluenzaA__ADG21432
augaaccccaaucagaagaucauuaccauaggcagcaucugcauggugauugggaucgucucccugaugcuccaaauuggaaacaugaucucuauauggguuucacacaguauccagacagguaaucagugucaggacgagccuauuagcaacacuaaauuccuuacggaaaaggccguggcuuccguaacccuggcaggcaauucuucguugugcccaaucucagggugggccguguacagcaaagauaacaguauuagaaucggauccaggggcgacgucuuugugauacgggagccguucauuucuuguagccauuuagaaugccgcacauuuuuccugacucaaggugcgcuacucaaugauaagcacuccaacgggaccguuaaagaccgaucaccccaucguacacugaugaguuguccugugggagaggcuccaagccccuauaauucuagauuugaauccgucgccuggucagcaagcgccugccacgauggcaccaguuggcuuacuaucggcauuucugggccugacaacggagcuguggcaguacugaaguacaaugguaucaucacagauaccauuaaguccuggaggaacaauauaaugcggacgcaggagagcgagugugccugcguuaacggcucguguuucacugugaugaccgacgggccaucuuccggacaggcuucauauaaaaucuuuaagauggaaaaaggcaaggucgugaaaaguguggaguuggaugcccccaauuaccauuaugaagagugcagcuguuacccugacgcgggugagauuacaugcgucugccgcgauaacuggcacggguccaacagaccauggguuucuuucaaucagaaccucgaauaucaaaucggauacauauguagcggcguguuuggcgacaauccgaggcccaacgaugggacuggaucaugcgguccuguauucccaaauggcgcauacggggugaagggauuuaguuuccgguauggcaacggugucuggauugggcgcaccaaguccacaaauagccgaucuggcuuugagaugaucugggaccccaacggauggaccggcacggacucaaguuucagcgugaaacaggauaucguugccauuacugacugguccggguacucuggaucguucgugcagcacccugaacugacaggucuggauuguaucagaccaugcuuuugggucgagcucauuaggggccggcccaaggaaagcaccauauggacuuccgggucaaguaucucuuucuguggagugaauggcgacacaguaagcugguccuggccggauggugcugaguuaccuuuuaccauugacaaauga

SEQ ID NO: 140688 - RNA, 1350 nt, Artificial Sequence
  derived and/or modified sequence opt3 from neuraminidase__InfluenzaA__ADG21438
augaaccccaaucagaagaucauuaccauaggcagcaucugcauggugauugggaucgucucccugaugcuccaaauuggaaacaugaucucuauauggaucucacacaguauucagacagguaaucagugucaggacgagccuaucagcaacacuaaauuccuuacggaaaaggccguugcuuccgugacccuggcaggcaauucuucguugugcccaauuucagggugggccguauacagcaaagauaacaguaucagaauaggauccaggggcgacguguuugucauucgggagccguucaucucuuguagccauuuagaaugccgcacauuuuuccugacucaaggugcgcuacucaaugauaagcacuccaacgggaccgugaaagaccgaucaccccaucguacacugaugaguuguccuguuggagaggcuccaagccccuauaauucuagauuugaauccguggccuggucagcaagcgccugccacgauggcaccaguuggcuuacuauuggcaucucugggccugacaacggagcugucgcagugcugaaguacaaugguaucauuacagauaccauaaaguccuggaggaacaauaucaugcggacgcaggagagcgagugugccugcguaaacggcucguguuucacuguuaugaccgacgggccaucuuccggacaggcuucauauaaaauuuuuaagauggaaaaaggcaagguggucaaaaguguggaguuggaugcccccaauuaccauuaugaagagugcagcuguuacccugacgcgggugagaucacaugcgugugccgcgauaacuggcacggguccaacagaccaugggucucuuucaaucagaaccucgaauaucaaauaggauacauuuguagcggcguuuuuggcgacaauccgaggcccaacgaugggacuggaucaugcgguccuguguucccaaauggcgcauacgggguaaagggauuuaguuucaaguauggcuccgguguguggaucgggcggaccaaaagcacaaacucucgcucaggcuuugagaugaucugggaccccaauggauggaccggcacggacaguagcuucuccgucaagcaggauauuguggccaucacugacuggucuggguacucggguagcuucguucagcacccugaacugacaggacuggauuguauucgaccaugcuuuuggguggagcucauaagaggcaggcccaaagaauccaccaucuggacuucagggaguucuauuagcuucuguggagucaacggcgacacaguguccuggucauggccggauggugcugaguuaccuuuuaccaucgacaaguga

SEQ ID NO: 140689 - RNA, 1350 nt, Artificial Sequence
  derived and/or modified sequence opt3 from neuraminidase__InfluenzaA__ADG21440
augaaccccaaucagaagaucauuaccauaggcagcaucugcauggugauugggaucgccucccugaugcuccaaauuggaaacaugaucucuauaugggucucacacaguauccagacagguaaucagugucaggacgagagcauuuccaacacuaaauuccuuacggaaaaggcuguugcaucugugacccuggccggcaauucgucauugugcccuaucagcgggugggcgguauacaguaaagauaacuccauuagaaucggaucuaggggcgacguguuugucauacgggagccauucauuagcuguucccauuuagaaugccgcacauuuuuccugacucaaggugcucuacucaaugauaagcacucaaacgggaccgugaaagaccgaaguccgcaucguacacugaugagcugucccguuggagaggccccuucuccauauaauuccagauuugaaucaguggcauggagcgccagugcuugccacgauggcaccucuuggcuuacuaucggcauuuccgggcccgacaacggagcagucgccgugcugaaguacaaugguaucaucacagauaccauuaagagcuggaggaacaauauaaugcggacgcaggagucggagugugcuugcguaaacggcucuuguuucacuguuaugaccgacgggccuuccucaggacaggccaguuauaaaaucuuuaagauggaaaaaggcaagguggucaaaagcguggaguuggaugcgccaaauuaccauuaugaagagugcuccuguuaccccgacgcaggagagauuacaugcgugugccgcgauaacuggcacgggucuaacagaccuugggucagcuucaaucagaaccucgaauaucaaaucggauacauauguucaggcguuuuuggcgacaauccaaggccgaacgaugggacuggaaguugcggucccguguucccuaauggcgccuacgggguaaagggauuuuccuucaaguauggcaacgguguguggauugggcggaccaaaagcacaaauucucgcucaggcuuugagaugaucugggacccaaacggauggaccggcacggacaguagcuucuccgucaagcaggauaucguggcuauuacugacuggucuggguacucggguagcuucguucagcaccccgaacugacaggucuggauuguauccgaccuugcuuuuggguggagcucauuagaggcaggccaaaagaauccaccauauggacuucagggaguucuaucagcuucuguggagucaauggcgacacaguguccuggucauggcccgauggugccgaguuaccguuuaccauugacaaguga

SEQ ID NO: 140690 - RNA, 1350 nt, Artificial Sequence; identical to SEQ ID NO: 139039
  derived and/or modified sequence opt3 from neuraminidase__InfluenzaA__ADG21442

SEQ ID NO: 140691 - RNA, 1350 nt, Artificial Sequence
  derived and/or modified sequence opt3 from neuraminidase__InfluenzaA__ADG21444
augaaccccaaucagaagaucauuaccauaggcagcaucugcauggugauugggaucgucucccugaugcuccaaauuggaaacaugaucucuauauggguuucacacaguauccagacagguaaucagugucaggacgagagcauuuccaacacuaaauuccuuacggaaaaggccgugaccucuguaacacuggcuggcaauucgucauugugcccuaucagcgggugggcaguguacaguaaagauaacuccauuagaaucggaucuaggggcgacgucuuugugauacgggagccauucauuagcuguucccauuuagaaugccgcaccuuuuuccugacucaaggugcccuacucaaugauaagcacucaaacgggacaguuaaagaccgaaguccgcaucguacccugaugagcugucccgugggagaggcgccuucuccauauaauuccagauuugaaucagucgcuuggagcgccagugcaugccacgauggcacuucuuggcuuacaaucggcauuuccgggcccgacaacggagccguggcuguacugaaguacaaugguaucaucaccgauacgauuaagagcuggaggaacaauauaaugcggacucaggagucggagugugcaugcguuaacggcucuuguuucaccgugaugacagacgggccuuccucaggacaggccaguuauaaaaucuuuaagauggaaaaaggcaaggucgugaaaagcguggaguuggaugcuccaaauuaccauuaugaagagugcuccuguuaccccgacgccggugagauuacuugcgucugccgcgauaacuggcacgggucuaacagaccuuggaucagcuucaaucagaaccucgaauaucaaauaggauacauuuguucaggcguuuuuggcgacaauccaaggccgaacgaugggaccggaaguugcggucccguguucccuaauggcgcguacgggguaaagggauuuuccuucaaguauggcaacgguguguggaucgggcggacaaaaagcaccaauucucgcucaggcuuugagaugaucugggacccaaacggauggacgggcacugacaguagcuucuccgucaagcaggauauuguggcaaucacagacuggucuggguacucggguagcuucguucagcaccccgaacugaccggacuggauuguauucgaccuugcuuuuggguggagcucauaagaggcaggccaaaagaauccacuaucuggacaucagggaguucuauuagcuucuguggagucaauggcgacaccguguccuggucauggcccgauggugccgaguuaccguuuacgaucgacaaguga

SEQ ID NO: 140692 - RNA, 1350 nt, Artificial Sequence; identical to SEQ ID NO: 139039
  derived and/or modified sequence opt3 from neuraminidase__InfluenzaA__ADG21446

SEQ ID NO: 140693 - RNA, 1350 nt, Artificial Sequence
  derived and/or modified sequence opt3 from neuraminidase__InfluenzaA__ADG21448
augaaccccaaucagaagaucauuaccauaggcagcaucugcauggugauugggaucgucucccugaugcuccaaauuggaaacaugaucucuauauggguuucacacaguauccagacagguaaucagugucaggacgagccuauuagcaacacuaaauuccuuacggaaaaggccguggcuuccguaacccuggcaggcaauucuucguugugcccaaucucagggugggccguguacagcaaagauaacaguauuagaaucggauccaggggcgacgucuuugugauacgggagccguucauuucuuguagccauuuagaaugccgcacauuuuuccugacucaaggugcgcuacucaaugauaagcacuccaacgggaccguuaaagaccgaucaccccaucguacacugaugaguuguccugugggagaggcuccaagccccuauaauucuagauuugaauccgucgccuggucagcaagcgccugccacgauggcaccaguuggcuuacuaucggcauuucugggccugacaacggagcuguggcaguacugaaguacaaugguaucaucacagauaccauuaaguccuggaggaacaauauaaugcggacgcaggagagcgagugugccugcguuaacggcucguguuucacugugaugaccgacgggccaucuuccggacaggcuucauauaaaaucuuuaagauggaaaaaggcaaggucgugaaaaguguggaguuggaugcccccaauuaccauuaugaagagugcagcuguuacccugacgcgggugagauuacaugcgucugccgcgauaacuggcacggguccaacagaccauggaucucuuucaaucagaaccucgaauaucaaauaggauacauuuguagcggcguuuuuggcgacaauccgaggcccaacgaugggacuggaucaugcgguccuguguucccaaauggcgcauacgggguaaagggauuuaguuucaaguauggcaacgguguguggaucgggcggaccaaauccacaaauagccgcucuggcuuugagaugaucugggaccccaacggauggaccggcacggacucaaguuucagcgucaagcaggauauuguggccaucacugacugguccggguacucuggaucguucguucagcacccugaacugacaggucuggauuguauucgaccaugcuuuuggguggagcucauaagaggcaggcccaaagaaagcaccaucuggacuuccgggucaaguauuucuuucuguggagucaauggcgacacagugagcugguccuggccggauggugcugaguuaccuuuuaccaucgacaaguga

SEQ ID NO: 140694 - RNA, 1350 nt, Artificial Sequence; identical to SEQ ID NO: 140693
  derived and/or modified sequence opt3 from neuraminidase__InfluenzaA__ADG21450

SEQ ID NO: 140695 - RNA, 1410 nt, Artificial Sequence; identical to SEQ ID NO: 138754
  derived and/or modified sequence opt3 from neuraminidase__InfluenzaA__ADG27797

SEQ ID NO: 140696 - RNA, 1410 nt, Artificial Sequence
  derived and/or modified sequence opt3 from neuraminidase__InfluenzaA__ADG27983
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaaccaucacuaugaagagugcaguuguuacccugauagcuccgagauuacuugcgucugccgcgacaauuggcaugggucuaacagaccauggguuagcuucaaucagaaccucgaauaccagauaggauauaucuguucaggcauuuuuggcgauaauccgaggcccaacgacaaaaccgggaguugcggaccuguguccagcaauggugcgaacggcguaaagggguucucuuuuaaguacggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguauucggggagcuucgugcagcaccccgagcugacuggucuggauuguauccgaccuugcuucuggguugaacucauuagaggcaggccaaaagagaacacaaucuggaccuccgggucaaguauaucuuuuuguggagugaauagcgacacuaugggcugguccuggcccgauggugcagaguuaccguucacaaucgacaaguga

SEQ ID NO: 140697 - RNA, 1410 nt, Artificial Sequence; identical to SEQ ID NO: 138754
  derived and/or modified sequence opt3 from neuraminidase__InfluenzaA__ADG27989

SEQ ID NO: 140698 - RNA, 1410 nt, Artificial Sequence; identical to SEQ ID NO: 140696
  derived and/or modified sequence opt3 from neuraminidase__InfluenzaA__ADG27998

SEQ ID NO: 140699 - RNA, 1410 nt, Artificial Sequence; identical to SEQ ID NO: 139108
  derived and/or modified sequence opt3 from neuraminidase__InfluenzaA__ADG28013

SEQ ID NO: 140700 - RNA, 1410 nt, Artificial Sequence; identical to SEQ ID NO: 138754
  derived and/or modified sequence opt3 from neuraminidase__InfluenzaA__ADG42086

SEQ ID NO: 140701 - RNA, 1410 nt, Artificial Sequence; identical to SEQ ID NO: 138754
  derived and/or modified sequence opt3 from neuraminidase__InfluenzaA__ADG42096

SEQ ID NO: 140702 - RNA, 1410 nt, Artificial Sequence; identical to SEQ ID NO: 140331
  derived and/or modified sequence opt3 from neuraminidase__InfluenzaA__ADG42106

SEQ ID NO: 140703 - RNA, 1410 nt, Artificial Sequence; identical to SEQ ID NO: 138754
  derived and/or modified sequence opt3 from neuraminidase__InfluenzaA__ADG42116

SEQ ID NO: 140704 - RNA, 1410 nt, Artificial Sequence; identical to SEQ ID NO: 138754
  derived and/or modified sequence opt3 from neuraminidase__InfluenzaA__ADG42126

SEQ ID NO: 140705 - RNA, 1410 nt, Artificial Sequence; identical to SEQ ID NO: 138754
  derived and/or modified sequence opt3 from neuraminidase__InfluenzaA__ADG42136

SEQ ID NO: 140706 - RNA, 1410 nt, Artificial Sequence; identical to SEQ ID NO: 139337
  derived and/or modified sequence opt3 from neuraminidase__InfluenzaA__ADG42146

SEQ ID NO: 140707 - RNA, 1410 nt, Artificial Sequence; identical to SEQ ID NO: 138754
  derived and/or modified sequence opt3 from neuraminidase__InfluenzaA__ADG42156

SEQ ID NO: 140708 - RNA, 1410 nt, Artificial Sequence; identical to SEQ ID NO: 138754
  derived and/or modified sequence opt3 from neuraminidase__InfluenzaA__ADG42166

SEQ ID NO: 140709 - RNA, 1410 nt, Artificial Sequence; identical to SEQ ID NO: 138754
  derived and/or modified sequence opt3 from neuraminidase__InfluenzaA__ADG42186

SEQ ID NO: 140710 - RNA, 1410 nt, Artificial Sequence; identical to SEQ ID NO: 140645
  derived and/or modified sequence opt3 from neuraminidase__InfluenzaA__ADG42196

SEQ ID NO: 140711 - RNA, 1410 nt, Artificial Sequence
  derived and/or modified sequence opt3 from neuraminidase__InfluenzaA__ADG42206
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccaaaauuacuugcgucugccgcgacaauuggcacgggucuaacagaccauggguuagcuucaaucagaaccucgaguaucagauaggauacaucuguucaggcauuuuuggcgauaauccgaggcccaacgacaagaccgggaguugcggaccuguguccagcaauggugcgaacggcguaaagggguucucuuuuaaauauggaaacggcguguggaucggucggacaaagucaaucaguagccgcaauggguucgaaaugauuugggauccaaacggcuggaccggaacggacaauaacuuuuccauaaaacaagacaucgucggcauuaaugaguggucuggguacucggggagcuucgugcagcaucccgaacugacuggucuggauuguauccgaccuugcuucuggguugagcucauuagaggcaggccaaaggaaaacacaaucuggaccuccgggucaaguauaucuuuuuguggagugaauagcgacacugucggcugguccuggcccgauggugcagaguuaccguucacaaucgacaaauga

SEQ ID NO: 140712 - RNA, 1410 nt, Artificial Sequence; identical to SEQ ID NO: 138754
  derived and/or modified sequence opt3 from neuraminidase__InfluenzaA__ADG42216

SEQ ID NO: 140713 - RNA, 1410 nt, Artificial Sequence; identical to SEQ ID NO: 140105
  derived and/or modified sequence opt3 from neuraminidase__InfluenzaA__ADG42226

SEQ ID NO: 140714 - RNA, 1410 nt, Artificial Sequence; identical to SEQ ID NO: 138754
  derived and/or modified sequence opt3 from neuraminidase__InfluenzaA__ADG42236

SEQ ID NO: 140715 - RNA, 1410 nt, Artificial Sequence; identical to SEQ ID NO: 138754
  derived and/or modified sequence opt3 from neuraminidase__InfluenzaA__ADG42246

SEQ ID NO: 140716 - RNA, 1410 nt, Artificial Sequence; identical to SEQ ID NO: 138754
  derived and/or modified sequence opt3 from neuraminidase__InfluenzaA__ADG42256

SEQ ID NO: 140717 - RNA, 1410 nt, Artificial Sequence; identical to SEQ ID NO: 138754
  derived and/or modified sequence opt3 from neuraminidase__InfluenzaA__ADG42276

SEQ ID NO: 140718 - RNA, 1410 nt, Artificial Sequence
  derived and/or modified sequence opt3 from neuraminidase__InfluenzaA__ADG42296
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugagggcccaagagagcgagugugcuugcgugaacgggucguguuucacugucaugaccgauggaccaucugacggccaggccuccuacaaaaucuuucggauugaaaaggguaaaaucgugaagucaguggagaugaaugcgcccaacuaucauuacgaagagugcaguuguuacccugauagcuccgagauuacaugcgucugccgcgacaauuggcacgggucuaacagaccauggguuagcuucaaucagaaccucgaauaucagauaggauacaucuguucaggcauuuuuggcgauaauccgaggcccaacgacaaaacugggaguugcggaccuguguccagcaauggugcaaacggcguaaagggguucucuuuuaaguauggaaacggcguguggaucggucggaccaaaucaaucaguagccgcaauggguucgagaugauuugggauccaaacggcuggacaggaaccgacaauaacuuuuccauaaagcaagacaucgucggcauuaaugaauggucuggguacucggggagcuucgugcagcaucccgagcugacgggucuggauuguauccgaccuugcuucuggguugaacucauuagaggcaggccaaaagagaacacuaucuggacauccgggucaaguauaucuuuuuguggagugaauagcgacaccgucggcugguccuggcccgauggugccgaguuaccguucacuaucgacaaguga

SEQ ID NO: 140719 - RNA, 1410 nt, Artificial Sequence; identical to SEQ ID NO: 138754
  derived and/or modified sequence opt3 from neuraminidase__InfluenzaA__ADG42306

SEQ ID NO: 140720 - RNA, 1410 nt, Artificial Sequence; identical to SEQ ID NO: 138754
  derived and/or modified sequence opt3 from neuraminidase__InfluenzaA__ADG42316

SEQ ID NO: 140721 - RNA, 1410 nt, Artificial Sequence; identical to SEQ ID NO: 138754
  derived and/or modified sequence opt3 from neuraminidase__InfluenzaA__ADG42326

SEQ ID NO: 140722 - RNA, 1410 nt, Artificial Sequence
  derived and/or modified sequence opt3 from neuraminidase__InfluenzaA__ADG42336
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucuaugaaacuggccggaaauucgucauugugcccugucagcggaugggcgauauacaguaaggacaacuccauuagaaucggcucuaaaggugauguguuuguuauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggugccaucucccuacaacucccguuuugaaucagucgccuggagcgcaagugccugccacgacggcauaaauuggcuuacaaucgggauuucuggaccugauaacggugcuguggcaguacugaaguauaauggcaucauaaccgacacgauuaaguccuggagaaacaauaucuugaggacucaagagagcgagugugccugcguuaacgggucguguuucaccgugaugacagauggaccaucugacggccaggcuuccuacaaaaucuuucggauugaaaaggguaaaaucgucaagucaguggagaugaaugcccccaacuaucauuacgaagagugcaguuguuacccugauagcuccgagauuacuugcgugugccgcgacaauuggcacgggucuaacagaccaugggucagcuucaaucagaaccucgaauaucagauaggauacaucuguucaggcauuuuuggcgauaauccgaggcccaacgacaaaaccgggaguugcggaccuguuuccagcaauggugcgaacggcgugaagggguucucuuuuaaguauggaaacggcguauggaucggucggacaaaaucaaucaguagccgcaauggguucgagaugauuugggauccaaacggcuggaccggaacggacaauaaguuuuccauaaaacaagacaucgugggcauuaacgaauggucuggguacucggggagcuucguccagcaucccgagcugacuggucuggauuguauccgaccuugcuucuggguggaacucauuagaggcaggccaaaggagaauacaaucuggaccuccgggucaaguauaucuuuuuguggaguuaacagcgacacugugggcugguccuggcccgauggugcagaguuaccguucacaaucgacaaauga

SEQ ID NO: 140723 - RNA, 1410 nt, Artificial Sequence; identical to SEQ ID NO: 140216
  derived and/or modified sequence opt3 from neuraminidase__InfluenzaA__ADG42346

SEQ ID NO: 140724 - RNA, 1410 nt, Artificial Sequence; identical to SEQ ID NO: 139931
  derived and/or modified sequence opt3 from neuraminidase__InfluenzaA__ADG42356

SEQ ID NO: 140725 - RNA, 1410 nt, Artificial Sequence
  derived and/or modified sequence opt3 from neuraminidase__InfluenzaA__ADG42366
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggaucagcuucaaucagaaccucgaauaucagauaggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaauggguucgagaugauaugggauccaaacggcuggaccggaacggacaauaaguuuuccaucaaacaagacauugugggcaucaacgaauggucuggguacucggggagcuucguccagcaucccgagcugacuggucuggauuguauucgaccuugcuucuggguggaacucaucagaggcaggccaaaggagaauacaauauggaccuccgggucaaguaucucuuuuuguggaguuaacagcgacacugugggcugguccuggcccgauggugcagaguuaccguucacaauugacaaauga

SEQ ID NO: 140726 - RNA, 1410 nt, Artificial Sequence; identical to SEQ ID NO: 138754
  derived and/or modified sequence opt3 from neuraminidase__InfluenzaA__ADG42376

SEQ ID NO: 140727 - RNA, 1410 nt, Artificial Sequence
  derived and/or modified sequence opt3 from neuraminidase__InfluenzaA__ADG42386
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaauuugccggaaauucgucacugugcccugugagcggaugggcgauauacaguaaggacaacuccauuagaaucggcucuaaaggugauguuuucgugauuagggagccauuuaucagcuguuccccguuggaaugccggaccuucuuuuuaacacagggggcucugcuaaaugacaagcauucaaacggaaccaucaaagaucgcagucccuaucgaacucucaugagcuguccuauuggcgaggucccaucucccuacaacucccguuucgaaucaguggccuggagcgcaagugccugccacgacggcauaaauuggcugacaaucgggauuucuggaccugauaacggugcuguagcaguucuuaaguauaauggcaucauaaccgacacgauuaaguccuggagaaacaauauccugaggacucaagagagcgagugugccugcgugaacgggucguguuuuaccgucaugacagauggaccaaaugacggccaggcuucuuacaaaaucuuccggauugaaaaggguaaaaucgugaaguccguggagaugaacgcccccaauuaucauuacgaagagugcucauguuacccugauaguagcgagauuacuugcgucugccgcgacaacuggcacggguccaauagaccauggguuucuuuuaaccagaauuuggaauaucagauaggauacaucuguagcggcauuuucggcgauaacccgaggcccaaugacaaaaccgggucaugcggaccugugaguuccaacggugcgaacggcguaaagggguuuagcuucaaguauggaaauggcguguggaucggucggacaaaaucuaucucaagucgcagcggguuugagaugauuugggauccaaacggcuggaccggaacggacaauaaguucuccauaaaacaagacaucgucggcauuaacgaauggucuggguacucggggagcuucgugcagcaucccgagcucacuggucuggauuguauccgaccuugcuuuuggguugaacugauuagaggcaggccaaaggagaauacaaucuggaccuccgggucaaguauaucuuucuguggagugaacagcgacacugucggcugguccuggcccgauggugcagagcucccguuuacaaucgacaaauga

SEQ ID NO: 140728 - RNA, 1410 nt, Artificial Sequence; identical to SEQ ID NO: 140711
  derived and/or modified sequence opt3 from neuraminidase__InfluenzaA__ADG42396

SEQ ID NO: 140729 - RNA, 1410 nt, Artificial Sequence
  derived and/or modified sequence opt3 from neuraminidase__InfluenzaA__ADG42406
augaaccccaaucagaagaucauuaccauaggcagcgugugcaugacaaucgggauggccaaccugauucuccaaaucggaaauauucuuuccacuuggaucucucacucaauacagcuggguaaccagaaucagaucgagacguguaaccaaagugucauuaccuacgaaaauaacacauggguuaaucagacuuaugugaacaucagcaauaccaacuucgcugcaggccaguccguagugucugucaaauuggccggaaauucgucauuaugcccugugagcggaugggcgauuuacaguaaggacaacuccaucagaauaggcucuaaaggugauguuuuugugauuagggagccauucaucagcuguuccccgcuggaaugccggacauuuuuccuaacccagggggcucuccugaaugacaagcauucaaacggaacuauuaaagaucgcagucccuaucgaacacuuaugagcuguccuaucggcgaggucccaucucccuacaacucccguuuugaaucaguggccuggagcgcaagugccugccacgacggcaucaauuggcugaccauugggauaucuggaccugauaacggugcuguagcaguuuugaaguauaauggcaucauuacggacacuaucaaguccuggagaaacaauauacucaggacccaagagagcgagugugccugcgugaacgggucguguuucacagucaugacugauggaccaucugacggccaggcuuccuacaaaauuuuucggaucgaaaaggguaaaaucgugaagucaguggagaugaaugcccccaacuaucauuacgaagagugcaguuguuacccugauagcuccgagauuaccugcgucugccgcgacaauuggcacgggucuaacagaccauggguuagcuucaaucagaaccuggaauaucagaucggauacauuuguucaggcauauuuggcgauaauccgaggcccaacgacaaaaaggggaguugcggaccuguguccagcaauggugcgaacggcguaaagggguucucuuuuaaauauggaaacggcguguggaucggucggacaaagucaauuaguagccgcaauggguucgagaugaucugggauccaaacggcuggaccggaacggacaauaacuuuuccaucaaacaagacauugucggcauaaaugaauggucuggguacucggggagcuucgugcagcaucccgagcugacuggucucgauuguauccgaccuugcuucuggguugaauuaauuagaggcaggccaaaggagaacacaaucuggaccuccgggucaaguauuucuuuuuguggagugaauagcgacacugucggcugguccuggcccgauggugcagagcugccguucacaaucgacaaauga

SEQ ID NO: 140730 - RNA, 1410 nt, Artificial Sequence; identical to SEQ ID NO: 139931
  derived and/or modified sequence opt3 from neuraminidase__InfluenzaA__ADG42426

SEQ ID NO: 140731 - RNA, 1410 nt, Artificial Sequence; identical to SEQ ID NO: 138754
  derived and/or modified sequence opt3 from neuraminidase__InfluenzaA__ADG42436

SEQ ID NO: 140732 - RNA, 1410 nt, Artificial Sequence
  derived and/or modified sequence opt3 from neuraminidase__InfluenzaA__ADG42446
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugccaaacuggcgggaaauucgucauugugcccugucagcggaugggcuauauacaguaaggacaacuccauuagaaucggcucuaaaggugauguguuuguuauuagggagccauucaucagcuguuccccguuagaaugccggaccuuuuuccugacacagggggcccuacucaaugacaagcauucaaacggaaccaucaaagaucgcagucccuaucgaacucugaugagcuguccuauuggcgaggugccaucucccuacaacucccguuuugaaucagucgcauggagcgccagugcuugccacgacggcauaaauuggcuuacaaucgggauuucuggaccugauaacggugcaguggccguacugaaguauaauggcaucauaaccgacacgauuaaguccuggagaaacaauaucuugaggacucaagagagcgagugugcuugcguuaacgggucguguuucaccgugaugacagauggaccaucugacggccaggccuccuacaaaaucuuucggauugaaaaggguaaaaucgucaagucaguggagaugaaugcgcccaacuaucauuacgaagagugcaguuguuacccugauagcuccgagauuacuugcgugugccgcgacaauuggcacgggucuaacagaccaugggucagcuucaaucagaaccucgaauaucagauaggauacaucuguucaggcauuuuuggcgauaauccgaggcccaacgacaaaaccgggaguugcggaccuguuuccagcaauggugcaaacggcgugaagggguucucuuuuaaguauggaaacggcguauggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguccagcaucccgagcugacuggucuggauuguauccgaccuugcuucuggguggaacucauuagaggcaggccaaaagagaacacaaucuggaccuccgggucaaguauaucuuuuuguggaguuaauagcgacacugugggcugguccuggcccgauggugccgaguuaccguucacaaucgacaaguga

SEQ ID NO: 140733 - RNA, 1410 nt, Artificial Sequence
  derived and/or modified sequence opt3 from neuraminidase__InfluenzaA__ADG42456
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcaguccccaccgaacucugaugagcuguccuauuggcgaggucccaucucccuauaacucccguuuugaaucaguggccuggagcgcaagugccugccaugacggcauaaauuggcuuacaaucgggauuucuggaccugauaacggugcuguagcaguucugaaguacaauggcaucauaaccgacacgauuaaguccuggagaaacaauaucuugaggacucaagagagcgagugugccugcgugaacgggucguguuucaccgucaugacagauggaccaucugacggccaggcuuccuauaaaaucuuucggauugaaaaggguaaaaucgugaagucaguggagaugaaugcccccaacuaccacuaugaagagugcaguuguuacccugauagcuccgagauuacuugcgucugccgcgacaauuggcaugggucuaacagaccauggguuagcuucaaucagaaccucgaauaccagauaggauauaucuguucaggcauuuuuggcgauaauccgaggcccaacgacaaaaccgggaguugcggaccuguguccagcaauggugcgaacggcguaaagggguucucuuuuaaguacggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguauucggggagcuucgugcagcaccccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 140734 - RNA, 1410 nt, Artificial Sequence; identical to SEQ ID NO: 138754
  derived and/or modified sequence opt3 from neuraminidase__InfluenzaA__ADG42466

SEQ ID NO: 140735 - RNA, 1410 nt, Artificial Sequence
  derived and/or modified sequence opt3 from neuraminidase__InfluenzaA__ADG42476
augaaccccaaucagaagaucauuaccauaggcagcgugugcaugacaaucgggauggccaaccugauucuccaaaucggaaauauuaucuccauauggaucucucacucaauucagcuugguaaccagaaucagacugagacguguaaccaaagugucaucaccuacgaaaauaacacauggguuaaucagacuuaugugaacauuagcaauaccaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggacauuuuuccugacccagggggcucuacucaaugacaagcauucaaacggaacuaucaaagaucgcagucccuaucgaacacugaugagcuguccuaucggcgaggucccaucucccuacaacucccguuuugaaucaguggccuggagcgcaagugccugccacgacggcauuaauuggcuuaccauagggaucucuggaccugauaacggugcuguagcaguucugaaguauaauggcauuaucacggacacuauaaaguccuggagaaacaauauuuugaggacccaagagagcgagugugccugcgugaacgggucguguuucacagucaugacugauggaccaucugacggccaggcuuccuacaaaaucuuucggaucgaaaaggguaaaauugugaagucaguggagaugaaugcccccaacuaucauuacgaagagugcaguuguuacccugauagcuccgagauuaccugcgucugccgcgacaauuggcacgggucuaacagaccauggguuagcuucaaucagaaccucgaauaucagaucggauacauauguucaggcaucuuuggcgauaauccgaggcccaacgacaaaacagggaguugcggaccuguguccagcaauggugcgaacggcguaaagggguucucuuuuaaguauggaaacggcguguggauuggucggaccaaaucaaucaguagccgcaauggguucgagaugaucugggauccaaacggcuggacgggaacugacaauaacuuuuccauuaagcaagacauagucggcaucaaugaauggucuggguacucggggagcuucgugcagcaucccgagcugacaggucuggauuguauucgaccuugcuucuggguugaacucaucagaggcaggccaaaagagaacaccauuuggacuuccgggucaaguaucucuuuuuguggagugaauagcgacacagucggcugguccuggcccgauggugcagaguuaccguucaccauagacaaguga

SEQ ID NO: 140736 - RNA, 1410 nt, Artificial Sequence; identical to SEQ ID NO: 140656
  derived and/or modified sequence opt3 from neuraminidase__InfluenzaA__ADG42486

SEQ ID NO: 140737 - RNA, 1410 nt, Artificial Sequence; identical to SEQ ID NO: 138754
  derived and/or modified sequence opt3 from neuraminidase__InfluenzaA__ADG42496

SEQ ID NO: 140738 - RNA, 1410 nt, Artificial Sequence
  derived and/or modified sequence opt3 from neuraminidase__InfluenzaA__ADG42506
augaaccccaaucagaagaucauuauaaucggcagcgugugcaugaccauugggauggccaaccugauccuccaaauuggaaauaucauauccaucuggauuucucacucaauccagcuugguaaccagaaucagauugagacauguaaccaaaguaucauaacuuacgaaaauaacacgugggucaaucagaccuauguuaacauuagcaauacaaacuucgcugcaggccaguccgugguaucugugaaacuggccggaaauucgucauugugcccugucagcggaugggcgaucuacaguaaggacaacuccauuagaaucggcucuaaaggugauguguuuguuaucagggagccauucauuagcuguuccccguuagaaugccggaccuuuuuccugacucagggggcucuacucaaugacaagcauucaaacggaacaauaaaagaucgcagucccuaucgaacccugaugagcuguccuaucggcgaggugccaucucccuacaacucccguuuugaaucagucgccuggagcgcaagugccugccacgacggcauuaauuggcuuacuaucgggauaucuggaccugauaacggugcuguggcaguacugaaguauaauggcauuaucacagacaccaucaaguccuggagaaacaauauuuugaggacgcaagagagcgagugugccugcguuaacgggucguguuucacugugaugaccgauggaccaucugacggccaggcuuccuacaaaaucuuucggauugaaaaggguaaagucgugaagucaguggagaugaaugcccccaacuaucauuacgaagagugcaguuguuacccugauagcuccgagauaacaugcgucugccgcgacaauuggcacgggucuaacagaccauggguuagcuucaaucagaaccucgaauaucagaucggauacauuuguucaggcaucuuuggcgauaauccgaggcccaacgacaaaacugggaguugcggaccuguguccagcaauggugcgaacggcguaaagggguucucuuuuaaguauggaaacggcguguggaucggucggaccaaaucaauuaguagccgcaauggguucgagaugauaugggauccaaacggcuggacaggaaccgacaauaacuuuuccaucaagcaagacauugucggcaucaaugaauggucuggguacucggggagcuucgugcagcaucccgagcugacgggucuggauuguauucgaccuugcuucuggguugaacucaucagaggcaggccaaaagagaacacuauauggacauccgggucaaguaucucuuuuuguggagugaauagcgacaccgucggcugguccuggcccgauggugcagaguuaccguucacuauugacaaguga

SEQ ID NO: 140739 - RNA, 1410 nt, Artificial Sequence; identical to SEQ ID NO: 139929
  derived and/or modified sequence opt3 from neuraminidase__InfluenzaA__ADG42516

SEQ ID NO: 140740 - RNA, 1410 nt, Artificial Sequence
  derived and/or modified sequence opt3 from neuraminidase__InfluenzaA__ADG42526
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugccucaacgggucguguuucaccgugaugacagauggaccaucugacggccaggcuuccuacaaaaucuuucggauugaaaaggguaaaaucgucaagucaguggagaugaaugcccccaacuaucauuacgaagagugcaguuguuacccugauagcuccgagauuacuugcgugugccgcgacaauuggcacgggucuaacagaccaugggucagcuucaaucagaaccuggaauaucagauaggauacaucuguucaggcauuuuuggcgauaauccgaggcccaacgacaaaaccgggaguugcggaccuguuuccagcaauggugcgaacggcgugaagggguucucuuuuaaguauggaaacggcguauggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguccagcaucccgagcugacuggucucgauuguauccgaccuugcuucuggguggaauuaauuagaggcaggccaaaagagaacacaaucuggaccuccgggucaaguauaucuuuuuguggaguuaauagcgacacugugggcugguccuggcccgauggugcagagcugccguucacaaucgacaaguga

SEQ ID NO: 140741 - RNA, 1410 nt, Artificial Sequence
  derived and/or modified sequence opt3 from neuraminidase__InfluenzaA__ADG42536
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugacuagcgacacagucggcugguccuggcccgauggugcagaguuaccguucaccaucgacaaguga

SEQ ID NO: 140742 - RNA, 1410 nt, Artificial Sequence; identical to SEQ ID NO: 138754
  derived and/or modified sequence opt3 from neuraminidase__InfluenzaA__ADG42546

SEQ ID NO: 140743 - RNA, 1410 nt, Artificial Sequence; identical to SEQ ID NO: 138754
  derived and/or modified sequence opt3 from neuraminidase__InfluenzaA__ADG42556

SEQ ID NO: 140744 - RNA, 1410 nt, Artificial Sequence
  derived and/or modified sequence opt3 from neuraminidase__InfluenzaA__ADG42566
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccauuccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcacucaaacggaaccaucaaagaucgcagucccuaucgaacucugaugagcuguccuauuggcgaggucccaucucccuacaacucccguuuugaaucaguggccuggagcgcaagugccugccaugacggcauaaauuggcuuacaaucgggauuucuggaccugauaacggugcuguagcaguucugaaguauaauggcaucauaaccgacacgauuaaguccuggagaaacaauaucuugaggacucaggagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucacuacgaagagugcaguuguuacccugauagcuccgagauuacuugcgucugccgcgacaauuggcaugggucuaacagaccauggguuagcuucaaucaaaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaggacaucgucggcauuaaugaauggucuggguacucggggagcuucgugcaacaccccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 140745 - RNA, 1410 nt, Artificial Sequence
  derived and/or modified sequence opt3 from neuraminidase__InfluenzaA__ADG42576
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccuuauaacggugcuguagcaguucugaaguacaauggcaucauaaccgauacgauuaaguccuggagaaacaauaucuugaggacucaagagagcgagugugccugcgugaacgggucguguuucaccgucaugacagacggaccaucugauggccaggcuuccuauaaaaucuuuaagauugaaaaagguaagaucgugaaaucaguggagaugaaugcccccaacuaccauuacgaagagugcaguuguuauccugacagcuccgagauuacuugcgucugccgggauaauuggcacgggucuaaccgcccauggguuagcuucaaucagaaccucgaauaccagauaggauauaucuguucaggcauuuuuggcgacaauccgagacccaacgauaagaccgggaguugcggaccuguguccagcaauggugcgaacggcguaaagggguucucuuuuaaauacggaaacggcguguggaucgguaggacaaagucaaucaguagccggaauggguucgagaugauuugggacccaaacggcuggaccggaacggauaauaacuuuuccauaaaacaagacaucgucggcauuaaugaauggucuggguauucggggagcuucgugcagcaucccgagcugacuggucuggacuguauccgcccuugcuucuggguugaacucauucgaggcagaccaaaggagaacacaaucuggaccuccgggucaaguauaucuuuuuguggagugaauagcgauacugucggcugguccuggcccgacggugcagaguuaccguucacaaucgauaaauga

SEQ ID NO: 140746 - RNA, 1410 nt, Artificial Sequence; identical to SEQ ID NO: 138754
  derived and/or modified sequence opt3 from neuraminidase__InfluenzaA__ADG42586

SEQ ID NO: 140747 - RNA, 1410 nt, Artificial Sequence
  derived and/or modified sequence opt3 from neuraminidase__InfluenzaA__ADG42606
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucccuaucgacaaguga

SEQ ID NO: 140748 - RNA, 1410 nt, Artificial Sequence
  derived and/or modified sequence opt3 from neuraminidase__InfluenzaA__ADG42616
augaacagcaaucagaagaucauuaccauaggcuccgugugcaugacaaucgggauggccaaccugauucuccaaaucggaaauauuaucucuauauggaucucacacaguauucagcuugguaaccagaaucagaucgagacuuguaaccaaagcgucauuacguacgaaaauaacaccuggguuaaucagacauaugugaacaucuccaauacuaacuucgcugcaggccagucuguagugucggucaaacuggccgggaauagcagcuugugccccgugaguggaugggcgauauacuccaaggacaacucuauuagaaucggcagcaaaggugauguuuuugugauuagggagccuuucaucuccuguucaccauuagaaugccggaccuuuuuccugacacagggggcucuacucaaugacaagcauaguaacggaaccaucaaagaucgcagcccguaucgaacucugaugucuugucccauuggcgaggucccuuccccauacaacucacguuuugaaagcguggccuggagugcaucugccugccacgacggcauaaauuggcuuacaaucgggauuuccggacccgauaacggugcuguagcaguucugaaguauaauggcaucauaaccgacacgauuaagagcuggagaaacaauaucuugaggacucaagagucggagugugccugcgugaacgggucuuguuucaccgucaugacagauggaccuuccgacggccaggcuucauacaaaaucuuucggauugaaaaggguaaaaucgugaagaguguggagaugaaugccccaaacuaucauuacgaagagugcagcuguuaccccgauuccucugagauuacuugcgucugccgcgacaauuggcacgggagcaacagaccuuggguuucauucaaucagaaccucgaauaucagauaggauacaucuguaguggcauuuuuggcgauaauccaaggccgaacgacaaaaccggguccugcggacccgugagcucuaauggugcgaacggcguaaagggguucucauuuaaguauggaaacggcguguggaucggucggacaaaaaguaucagcucccgcaauggguucgagaugauuugggauccuaacggcuggaccggaacggacaauaacuuuucuauaaagcaagacaucgucggcauuaaugaauggucgggguacagcggauccuucgugcagcauccagagcugacuggucuggauuguauccgacccugcuucuggguugaacucauuagaggcaggccuaaagagaacacaaucuggaccucagggaguucuauaucauuuuguggagucaauuccgacacugugggcuggucauggccagauggugcagaguuacccuucacaaucgacaaguga

SEQ ID NO: 140749 - RNA, 1410 nt, Artificial Sequence; identical to SEQ ID NO: 139337
  derived and/or modified sequence opt3 from neuraminidase__InfluenzaA__ADG42626

SEQ ID NO: 140750 - RNA, 1410 nt, Artificial Sequence; identical to SEQ ID NO: 140735
  derived and/or modified sequence opt3 from neuraminidase__InfluenzaA__ADG42636

SEQ ID NO: 140751 - RNA, 1410 nt, Artificial Sequence
  derived and/or modified sequence opt3 from neuraminidase__InfluenzaA__ADG42646
augaaccccaaucagagaaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaagcuggccggaaauucgucauugugcccugugagcggaugggcgauauacaguaaagacaacuccauuaggaucggcucuaagggugauguuuuugugauucgggagccauucaucagcuguuccccguuagaaugccgcaccuuuuuccugacacagggggcucuacucaaugacaaacauucaaacggaaccaucaaggaucgaagucccuaucguacucugaugagcuguccuauuggcgaggucccaucucccuacaacuccagauuugaaucaguggccuggagcgcaagugccugccacgacggcauaaauuggcuuacaaucgggauuucuggaccugauaacggugcuguagcaguucugaaauauaauggcaucauaaccgacacgauuaaguccuggaggaacaauaucuugcggacucaagagagcgagugugccugcgugaacgggucguguuucaccgucaugacagauggaccaucugacggccaggcuuccuacaagaucuuucgcauugaaaaagguaagaucgugaaaucaguggagaugaaugcccccaacuaucauuacgaagagugcaguuguuacccugauagcuccgagauuacuugcgucugcagagacaauuggcacgggucuaacaggccauggguuagcuucaaucagaaccucgaauaucagauaggauacaucuguucaggcauuuuuggcgauaauccgcggcccaacgacaagaccgggaguugcggaccuguguccagcaauggugcgaacggcguaaaaggguucucuuuuaaguauggaaacggcguguggaucggucgcacaaagucaaucaguagccgaaauggguucgagaugauuugggauccaaacggcuggaccggaacggacaauaacuuuuccauaaaacaagacaucgucggcauuaaugaauggucuggguacucggggagcuucgugcagcaucccgagcugacuggucuggauuguaucagaccuugcuucuggguugaacucauuaggggccggccaaaggagaacacaaucuggaccuccgggucaaguauaucuuuuuguggagugaauagcgacacugucggcugguccuggcccgauggugcagaguuaccguucacaaucgacaaauga

SEQ ID NO: 140752 - RNA, 1410 nt, Artificial Sequence; identical to SEQ ID NO: 138754
  derived and/or modified sequence opt3 from neuraminidase__InfluenzaA__ADG42656

SEQ ID NO: 140753 - RNA, 1410 nt, Artificial Sequence; identical to SEQ ID NO: 140667
  derived and/or modified sequence opt3 from neuraminidase__InfluenzaA__ADG42666

SEQ ID NO: 140754 - RNA, 1410 nt, Artificial Sequence
  derived and/or modified sequence opt3 from neuraminidase__InfluenzaA__ADG42676
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagauuuguaaccaaagugucaucacuuacgaaaauaacacguggguuaaucagaccuaugugaacauaagcaauacaaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcagucccuaucgaacccugaugagcuguccuauaggcgaggucccaucucccuacaacucccguuuugaaucaguggccuggagcgcaagugccugccacgacggcaucaauuggcuuacuauugggaucucuggaccugauaacggugcuguagcaguucugaaguauaauggcauaauuacagacaccaucaaguccuggagaaacaauaucuugaggacgcaagagagcgagugugccugcgugaacgggucguguuucacugucaugaccgauggaccaucugacggccaggcuuccuacaaaauuuuucggaucgaaaaggguaaaauugugaagucaguggagaugaaugcccccaacuaucauuacgaagagugcaguuguuacccugauagcuccgagauaacaugcgucugccgcgacaauuggcacgggucuaacagaccauggguuagcuucaaucagaaccucgaauaucagaucggauacauuuguucaggcaucuuuggcgauaauccgaggcccaacgacaaaacugggaguugcggaccuguguccagcaauggugcgaacggcguaaagggguucucuuuuaaguauggaaacggcguguggaucggucggaccaaaucaauuaguagccgcaauggguucgagaugauaugggauccaaacggcuggacaggaaccgacaauaacuuuuccaucaagcaagacauugucggcaucaaugaauggucuggguacucggggagcuucgugcagcaucccgagcugacgggucuggauuguauucgaccuugcuucuggguugaacucaucagaggcaggccaaaagagaacacuauauggacauccgggucaaguaucucuuuuuguggagugaauagcgacaccgucggcugguccuggcccgauggugcagaguuaccguucacuauugacaaguga

SEQ ID NO: 140755 - RNA, 1410 nt, Artificial Sequence; identical to SEQ ID NO: 138754
  derived and/or modified sequence opt3 from neuraminidase__InfluenzaA__ADG42686

SEQ ID NO: 140756 - RNA, 1410 nt, Artificial Sequence; identical to SEQ ID NO: 140331
  derived and/or modified sequence opt3 from neuraminidase__InfluenzaA__ADG42696

SEQ ID NO: 140757 - RNA, 1410 nt, Artificial Sequence; identical to SEQ ID NO: 140535
  derived and/or modified sequence opt3 from neuraminidase__InfluenzaA__ADG42706

SEQ ID NO: 140758 - RNA, 1410 nt, Artificial Sequence; identical to SEQ ID NO: 138754
  derived and/or modified sequence opt3 from neuraminidase__InfluenzaA__ADG42716

SEQ ID NO: 140759 - RNA, 1410 nt, Artificial Sequence; identical to SEQ ID NO: 140042
  derived and/or modified sequence opt3 from neuraminidase__InfluenzaA__ADG42726

SEQ ID NO: 140760 - RNA, 1410 nt, Artificial Sequence; identical to SEQ ID NO: 139337
  derived and/or modified sequence opt3 from neuraminidase__InfluenzaA__ADG42746

SEQ ID NO: 140761 - RNA, 1410 nt, Artificial Sequence; identical to SEQ ID NO: 140267
  derived and/or modified sequence opt3 from neuraminidase__InfluenzaA__ADG42756

SEQ ID NO: 140762 - RNA, 1410 nt, Artificial Sequence; identical to SEQ ID NO: 140042
  derived and/or modified sequence opt3 from neuraminidase__InfluenzaA__ADG42766

SEQ ID NO: 140763 - RNA, 1410 nt, Artificial Sequence; identical to SEQ ID NO: 140042
  derived and/or modified sequence opt3 from neuraminidase__InfluenzaA__ADG42776

SEQ ID NO: 140764 - RNA, 1410 nt, Artificial Sequence; identical to SEQ ID NO: 140042
  derived and/or modified sequence opt3 from neuraminidase__InfluenzaA__ADG42796

SEQ ID NO: 140765 - RNA, 1410 nt, Artificial Sequence
  derived and/or modified sequence opt3 from neuraminidase__InfluenzaA__ADG42806
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucuccuggucauggcccgauggcgcagaguuaccguucacaaucgacaaguga

SEQ ID NO: 140766 - RNA, 1410 nt, Artificial Sequence; identical to SEQ ID NO: 138754
  derived and/or modified sequence opt3 from neuraminidase__InfluenzaA__ADG42816

SEQ ID NO: 140767 - RNA, 1410 nt, Artificial Sequence; identical to SEQ ID NO: 138754
  derived and/or modified sequence opt3 from neuraminidase__InfluenzaA__ADG42826

SEQ ID NO: 140768 - RNA, 1410 nt, Artificial Sequence; identical to SEQ ID NO: 138754
  derived and/or modified sequence opt3 from neuraminidase__InfluenzaA__ADG42836

SEQ ID NO: 140769 - RNA, 1410 nt, Artificial Sequence; identical to SEQ ID NO: 140370
  derived and/or modified sequence opt3 from neuraminidase__InfluenzaA__ADG42846

SEQ ID NO: 140770 - RNA, 1410 nt, Artificial Sequence; identical to SEQ ID NO: 138754
  derived and/or modified sequence opt3 from neuraminidase__InfluenzaA__ADG42856

SEQ ID NO: 140771 - RNA, 1410 nt, Artificial Sequence; identical to SEQ ID NO: 140366
  derived and/or modified sequence opt3 from neuraminidase__InfluenzaA__ADG42866

SEQ ID NO: 140772 - RNA, 1410 nt, Artificial Sequence; identical to SEQ ID NO: 138754
  derived and/or modified sequence opt3 from neuraminidase__InfluenzaA__ADG42876

SEQ ID NO: 140773 - RNA, 1410 nt, Artificial Sequence; identical to SEQ ID NO: 140403
  derived and/or modified sequence opt3 from neuraminidase__InfluenzaA__ADG42886

SEQ ID NO: 140774 - RNA, 1410 nt, Artificial Sequence; identical to SEQ ID NO: 140346
  derived and/or modified sequence opt3 from neuraminidase__InfluenzaA__ADG42896

SEQ ID NO: 140775 - RNA, 1410 nt, Artificial Sequence; identical to SEQ ID NO: 140346
  derived and/or modified sequence opt3 from neuraminidase__InfluenzaA__ADG42906

SEQ ID NO: 140776 - RNA, 1410 nt, Artificial Sequence; identical to SEQ ID NO: 138754
  derived and/or modified sequence opt3 from neuraminidase__InfluenzaA__ADG42916

SEQ ID NO: 140777 - RNA, 1410 nt, Artificial Sequence; identical to SEQ ID NO: 138754
  derived and/or modified sequence opt3 from neuraminidase__InfluenzaA__ADG42926

SEQ ID NO: 140778 - RNA, 1410 nt, Artificial Sequence; identical to SEQ ID NO: 138754
  derived and/or modified sequence opt3 from neuraminidase__InfluenzaA__ADG58909

SEQ ID NO: 140779 - RNA, 1410 nt, Artificial Sequence; identical to SEQ ID NO: 138754
  derived and/or modified sequence opt3 from neuraminidase__InfluenzaA__ADG58910

SEQ ID NO: 140780 - RNA, 1410 nt, Artificial Sequence
  derived and/or modified sequence opt3 from neuraminidase__InfluenzaA__ADG58913
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuaccuucaaucagaaccucgaauaucagauaggauacaucuguagcggcauuuuuggcgauaauccgaggcccaacgacaaaacagggucaugcggaccugugaguuccaauggugcgaacggcguaaagggguucagcuuuaaguauggaaacggcguguggaucggucggaccaaaucuaucucaagucgcaauggguucgagaugauuugggauccaaacggcuggacgggaacugacaauaacuuuagcauaaagcaagacaucgucggcauuaaugaaugguccggguacucuggaucguucgugcagcaucccgagcugacaggucuggauuguauccgaccuugcuucuggauugaacucaucagaggcaggccaaaagagaacaccauauggacuagcggguccucaaucaguuuuuguggaguuaauucugacacagugggcuggagcuggcccgauggugcagaguuaccguucaccauugacaaguga

SEQ ID NO: 140781 - RNA, 1410 nt, Artificial Sequence; identical to SEQ ID NO: 138754
  derived and/or modified sequence opt3 from neuraminidase__InfluenzaA__ADG58914

SEQ ID NO: 140782 - RNA, 1410 nt, Artificial Sequence; identical to SEQ ID NO: 138754
  derived and/or modified sequence opt3 from neuraminidase__InfluenzaA__ADG58916

SEQ ID NO: 140783 - RNA, 1410 nt, Artificial Sequence; identical to SEQ ID NO: 138754
  derived and/or modified sequence opt3 from neuraminidase__InfluenzaA__ADG58917

SEQ ID NO: 140784 - RNA, 1410 nt, Artificial Sequence
  derived and/or modified sequence opt3 from neuraminidase__InfluenzaA__ADG58918
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuaccuucaaucagaaccucgaauaucagauaggauacaucuguagcggcauuuuuggcgauaauccgaggcccaacgacaaaacagggucaugcggaccugugaguuccaauggugcgaacggcguaaagggguucagcuuuaaguauggaaacggcguguggaucggucggaccaaaucuaucucaagucgcaauggguucgagaugauuugggauccaaacggcuggacgggaacugacaauaacuuuagcauaaagcaagacaucgucggcauuaaugaaugguccggguacucuggaucguucgugcagcaucccgagcugacaggucuggauuguauccgaccuugcuucuggguugaacucauuagaggcaggccaaaagagaacaccaucuggacuagcggguccucaauaaguuuuuguggagucaauucugacacagugggcuggagcuggcccgauggugcagaguuaccguucaccaucgacaaguga

SEQ ID NO: 140785 - RNA, 1410 nt, Artificial Sequence; identical to SEQ ID NO: 140780
  derived and/or modified sequence opt3 from neuraminidase__InfluenzaA__ADG58919

SEQ ID NO: 140786 - RNA, 1410 nt, Artificial Sequence; identical to SEQ ID NO: 138909
  derived and/or modified sequence opt3 from neuraminidase__InfluenzaA__ADG58920

SEQ ID NO: 140787 - RNA, 1410 nt, Artificial Sequence; identical to SEQ ID NO: 138909
  derived and/or modified sequence opt3 from neuraminidase__InfluenzaA__ADG58921

SEQ ID NO: 140788 - RNA, 1410 nt, Artificial Sequence; identical to SEQ ID NO: 138909
  derived and/or modified sequence opt3 from neuraminidase__InfluenzaA__ADG58922

SEQ ID NO: 140789 - RNA, 1410 nt, Artificial Sequence; identical to SEQ ID NO: 138909
  derived and/or modified sequence opt3 from neuraminidase__InfluenzaA__ADG58923

SEQ ID NO: 140790 - RNA, 1410 nt, Artificial Sequence; identical to SEQ ID NO: 138909
  derived and/or modified sequence opt3 from neuraminidase__InfluenzaA__ADG58924

SEQ ID NO: 140791 - RNA, 1410 nt, Artificial Sequence; identical to SEQ ID NO: 138909
  derived and/or modified sequence opt3 from neuraminidase__InfluenzaA__ADG58925

SEQ ID NO: 140792 - RNA, 1410 nt, Artificial Sequence; identical to SEQ ID NO: 138909
  derived and/or modified sequence opt3 from neuraminidase__InfluenzaA__ADG58926

SEQ ID NO: 140793 - RNA, 1410 nt, Artificial Sequence; identical to SEQ ID NO: 138909
  derived and/or modified sequence opt3 from neuraminidase__InfluenzaA__ADG58927

SEQ ID NO: 140794 - RNA, 1410 nt, Artificial Sequence; identical to SEQ ID NO: 139772
  derived and/or modified sequence opt3 from neuraminidase__InfluenzaA__ADG58928

SEQ ID NO: 140795 - RNA, 1410 nt, Artificial Sequence; identical to SEQ ID NO: 139772
  derived and/or modified sequence opt3 from neuraminidase__InfluenzaA__ADG58929

SEQ ID NO: 140796 - RNA, 1410 nt, Artificial Sequence
  derived and/or modified sequence opt3 from neuraminidase__InfluenzaA__ADG58931
augaaccccaaucagaagaucauuaccauaggcagcgugugcaugacaaucgggauggccaaccugauucuccaaaucggaaauacuauuuccaucuggauaaaccacucuauccagcuugguaaucagaaccagauugagacguguaaucaaucagucaucaccuacgaaaacaauacauggguuaaccagacuuaugugaauauuaguaacaccaauuucgcugcaggccagagcguaguguccgucaaacuggccgggaacucuucguugugcccugugucaggaugggcgaucuacagcaaggacaauaguauaagaauuggcuccaaaggugauguuuuugugaucagggagccauucauuucuuguagcccguuagaaugccggacauuuuuccugacccagggggcucuacucaacgacaagcauuccaacggaacuaucaaagaucgcucacccuaucgaacacugaugaguuguccuaucggcgaggucccaagccccuacaauucucguuuugaauccguggccuggucagcaagcgccugccacgacggcauuaacuggcuuaccauagggaucaguggaccugauaauggugcuguagcaguucugaaguauaacggcauuaucacggacacuauaaagucuuggagaaauaacauuuugaggacccaagaguccgagugugccugcgugaaugggagcuguuucacagucaugacugauggaccaucggacggccaggcuucuuacaaaaucuuucggaucgaaaaggguaaaauugugaaguccguggagaugaacgcccccaauuaucauuacgaagagugcucauguuacccugauaguagcgagauuaccugcgucugccgcgacaacuggcacggguccaauagaccauggguuucuuucaaccagaaucucgaauaucagaucggauacauauguagcggcaucuuuggcgauaacccgaggcccaaugacaaaacagggucaugcggaccugugaguuccaacggugcgaacggcguaaagggguucagcuuuaaguauggaaauggcguguggauuggucggaccaaaucuaucucaagucgcaacggguucgagaugaucugggauccaaauggcuggacgggaacugacaacaauuuuagcauuaagcaagacauagucggcaucaacgaaugguccggguacucuggaucguucgugcagcaucccgagcugacaggucuggauuguauucgaccuugcuucuggguugaacucaucagaggcaggccaaaagagaauaccauuuggacuagcggguccucaaucaguuuuuguggagugaacucugacacagucggcuggagcuggcccgauggugcagaguuaccguucaccauagacaaguga

SEQ ID NO: 140797 - RNA, 1410 nt, Artificial Sequence; identical to SEQ ID NO: 140796
  derived and/or modified sequence opt3 from neuraminidase__InfluenzaA__ADG58932

SEQ ID NO: 140798 - RNA, 1410 nt, Artificial Sequence; identical to SEQ ID NO: 140796
  derived and/or modified sequence opt3 from neuraminidase__InfluenzaA__ADG58933

SEQ ID NO: 140799 - RNA, 1410 nt, Artificial Sequence; identical to SEQ ID NO: 140796
  derived and/or modified sequence opt3 from neuraminidase__InfluenzaA__ADG58934

SEQ ID NO: 140800 - RNA, 1410 nt, Artificial Sequence; identical to SEQ ID NO: 140796
  derived and/or modified sequence opt3 from neuraminidase__InfluenzaA__ADG58935

SEQ ID NO: 140801 - RNA, 1410 nt, Artificial Sequence; identical to SEQ ID NO: 140796
  derived and/or modified sequence opt3 from neuraminidase__InfluenzaA__ADG58936

SEQ ID NO: 140802 - RNA, 1410 nt, Artificial Sequence; identical to SEQ ID NO: 140796
  derived and/or modified sequence opt3 from neuraminidase__InfluenzaA__ADG58937

SEQ ID NO: 140803 - RNA, 1410 nt, Artificial Sequence; identical to SEQ ID NO: 140796
  derived and/or modified sequence opt3 from neuraminidase__InfluenzaA__ADG58938

SEQ ID NO: 140804 - RNA, 1410 nt, Artificial Sequence
  derived and/or modified sequence opt3 from neuraminidase__InfluenzaA__ADG59589
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuauggcaguacugaaguauaauggcaucauaaccgacacgauuaaguccuggagaaacaauaucuugaggacucaagagagcgagugugccugcguuaacgggucguguuucaccgugaugacagauggaccaucugacggccaggcuuccuacaaaaucuuucggauugaaaaggguaaagucgugaagucaguggagaugaaugcccccaacuaucauuacgaagagugcaguuguuacccugauagcuccgagaucacuugcgucugccgcgacaauuggcacgggucuaacagaccauggguuagcuucaaucagaaccucgaauaucagauuggauacauauguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucuggauuguauucgaccuugcuucuggguugaacucaucagaggcaggccaaaagagaacacaauuuggaccuccgggucaaguaucucuuuuuguggagugaauagcgacacugucggcugguccuggcccgauggugcagaguuaccguucacaauagacaaguga

SEQ ID NO: 140805 - RNA, 1410 nt, Artificial Sequence; identical to SEQ ID NO: 138754
  derived and/or modified sequence opt3 from neuraminidase__InfluenzaA__ADG59590

SEQ ID NO: 140806 - RNA, 1410 nt, Artificial Sequence; identical to SEQ ID NO: 138754
  derived and/or modified sequence opt3 from neuraminidase__InfluenzaA__ADG59591

SEQ ID NO: 140807 - RNA, 1410 nt, Artificial Sequence; identical to SEQ ID NO: 138754
  derived and/or modified sequence opt3 from neuraminidase__InfluenzaA__ADG59592

SEQ ID NO: 140808 - RNA, 1410 nt, Artificial Sequence; identical to SEQ ID NO: 140656
  derived and/or modified sequence opt3 from neuraminidase__InfluenzaA__ADG59593

SEQ ID NO: 140809 - RNA, 1410 nt, Artificial Sequence; identical to SEQ ID NO: 139931
  derived and/or modified sequence opt3 from neuraminidase__InfluenzaA__ADG59594

SEQ ID NO: 140810 - RNA, 1410 nt, Artificial Sequence; identical to SEQ ID NO: 139931
  derived and/or modified sequence opt3 from neuraminidase__InfluenzaA__ADG59595

SEQ ID NO: 140811 - RNA, 1410 nt, Artificial Sequence
  derived and/or modified sequence opt3 from neuraminidase__InfluenzaA__ADG59596
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgaccggaccgggaguugcggaccuguguccagcaauggugcgaacggcguaaaaggguucucuuuuaaguauggaaacggcguguggaucggucgcacaaagucaaucaguagccgaaauggguucgagaugauuugggauccaaacggcuggaccggaacggacaauaacuuuuccauaaaacaagacaucgucggcauuaaugaauggucuggguacucggggagcuucgugcagcaucccgagcugacuggucuggauuguaucagaccuugcuucuggguugaacucauuaggggccggccaaaggagaacacaaucuggaccuccgggucaaguauaucuuuuuguggagugaauagcgacacugucggcugguccuggcccgauggugcagaguuaccguucacaaucgacaaauga

SEQ ID NO: 140812 - RNA, 1410 nt, Artificial Sequence; identical to SEQ ID NO: 138754
  derived and/or modified sequence opt3 from neuraminidase__InfluenzaA__ADG59597

SEQ ID NO: 140813 - RNA, 1410 nt, Artificial Sequence; identical to SEQ ID NO: 138754
  derived and/or modified sequence opt3 from neuraminidase__InfluenzaA__ADG59598

SEQ ID NO: 140814 - RNA, 1410 nt, Artificial Sequence; identical to SEQ ID NO: 139929
  derived and/or modified sequence opt3 from neuraminidase__InfluenzaA__ADG59599

SEQ ID NO: 140815 - RNA, 1410 nt, Artificial Sequence; identical to SEQ ID NO: 138754
  derived and/or modified sequence opt3 from neuraminidase__InfluenzaA__ADG59601

SEQ ID NO: 140816 - RNA, 1410 nt, Artificial Sequence; identical to SEQ ID NO: 140656
  derived and/or modified sequence opt3 from neuraminidase__InfluenzaA__ADG59602

SEQ ID NO: 140817 - RNA, 1410 nt, Artificial Sequence; identical to SEQ ID NO: 140656
  derived and/or modified sequence opt3 from neuraminidase__InfluenzaA__ADG59603

SEQ ID NO: 140818 - RNA, 1410 nt, Artificial Sequence; identical to SEQ ID NO: 138754
  derived and/or modified sequence opt3 from neuraminidase__InfluenzaA__ADG59604

SEQ ID NO: 140819 - RNA, 1410 nt, Artificial Sequence; identical to SEQ ID NO: 138754
  derived and/or modified sequence opt3 from neuraminidase__InfluenzaA__ADG59605

SEQ ID NO: 140820 - RNA, 1410 nt, Artificial Sequence; identical to SEQ ID NO: 139772
  derived and/or modified sequence opt3 from neuraminidase__InfluenzaA__ADG59606

SEQ ID NO: 140821 - RNA, 1410 nt, Artificial Sequence; identical to SEQ ID NO: 138754
  derived and/or modified sequence opt3 from neuraminidase__InfluenzaA__ADG59607

SEQ ID NO: 140822 - RNA, 1410 nt, Artificial Sequence; identical to SEQ ID NO: 138754
  derived and/or modified sequence opt3 from neuraminidase__InfluenzaA__ADG59608

SEQ ID NO: 140823 - RNA, 1410 nt, Artificial Sequence; identical to SEQ ID NO: 139575
  derived and/or modified sequence opt3 from neuraminidase__InfluenzaA__ADG59609

SEQ ID NO: 140824 - RNA, 1410 nt, Artificial Sequence; identical to SEQ ID NO: 140656
  derived and/or modified sequence opt3 from neuraminidase__InfluenzaA__ADG59610

SEQ ID NO: 140825 - RNA, 1410 nt, Artificial Sequence; identical to SEQ ID NO: 139772
  derived and/or modified sequence opt3 from neuraminidase__InfluenzaA__ADG59611

SEQ ID NO: 140826 - RNA, 1410 nt, Artificial Sequence; identical to SEQ ID NO: 140656
  derived and/or modified sequence opt3 from neuraminidase__InfluenzaA__ADG59612

SEQ ID NO: 140827 - RNA, 1410 nt, Artificial Sequence
  derived and/or modified sequence opt3 from neuraminidase__InfluenzaA__ADG59613
augaaccccaaucagaagaucauuaccauaggcagcgugugcaugacaaucgggaugacuaaccugauucuccaacuuggaaauaucauuuccaucuggauaucucacucaauccagcuggguaaccagaaucagauugagacguguaaccaaagugucaucaccuacgaaaauaacacauggguuaaucagacuuaugugaacauuagcaauaccaacuucgccgcuggccaguccguagugucugucaaauuggcaggaaauucgucauuaugcccugugagcgggugggccaucuacaguaaggacaacuccauaagaauuggcucuaaaggugauguuuuugugaucagggagccauucauuagcuguuccccgcuggaaugccggacauuuuuccuaacccagggggcgcuccugaaugacaagcauucaaacggaacuaucaaagaucgcagucccuaucgaacacuuaugagcuguccuaucggcgaggucccaucucccuacaacucccguuuugaaucaguggcuuggagcgccagugcaugccacgacggcauuaauuggcugaccauagggaucucuggaccugauaacggugccguagcuguuuugaaguauaauggcauuaucacggacacuauaaaguccuggagaaacaauauucucaggacccaagagagcgagugugcaugcgugaacgggucguguuucacagucaugacugauggaccaucugacggccaggccuccuacaaaaucuuucggaucgaaaaggguaaaauugugaagucaguggagaugaaugcucccaacuaucauuacgaagagugcaguuguuacccugauagcuccgagauuaccugcgucugccgcgacaauuggcacgggucuaacagaccauggguuagcuucaaucagaaccuggaauaucagaucggauacauauguucaggcaucuuuggcgauaauccgaggcccaacgacaaaacagggaguugcggaccuguguccagcaauggugccaacggcguaaagggguucucuuuuaaguauggaaacggcguguggauuggucggaccaaaucaaucaguagccgcaauggguucgagaugaucugggauccaaacggcuggacgggaacugacaauuccuuuucuauuaagcaagacauagucggcaucaacgaauggucgggguacagcggauccuucgugcagcaucccgagcugacaggucucgauuguauucgaccuugcuucuggguugaauuaaucagaggcaggccaaaagagaauaccguguggacuucagggaguucuauuagcuuuuguggagucaacuccgacacagugggcuggucauggcccgauggugcggagcugccguucaccaucgacaaguga

SEQ ID NO: 140828 - RNA, 1410 nt, Artificial Sequence; identical to SEQ ID NO: 139929
  derived and/or modified sequence opt3 from neuraminidase__InfluenzaA__ADG59614

SEQ ID NO: 140829 - RNA, 1410 nt, Artificial Sequence; identical to SEQ ID NO: 138754
  derived and/or modified sequence opt3 from neuraminidase__InfluenzaA__ADH01811

SEQ ID NO: 140830 - RNA, 1410 nt, Artificial Sequence; identical to SEQ ID NO: 138754
  derived and/or modified sequence opt3 from neuraminidase__InfluenzaA__ADH01821

SEQ ID NO: 140831 - RNA, 1410 nt, Artificial Sequence; identical to SEQ ID NO: 138754
  derived and/or modified sequence opt3 from neuraminidase__InfluenzaA__ADH01831

SEQ ID NO: 140832 - RNA, 1410 nt, Artificial Sequence; identical to SEQ ID NO: 138754
  derived and/or modified sequence opt3 from neuraminidase__InfluenzaA__ADH01841

SEQ ID NO: 140833 - RNA, 1410 nt, Artificial Sequence; identical to SEQ ID NO: 138754
  derived and/or modified sequence opt3 from neuraminidase__InfluenzaA__ADH01851

SEQ ID NO: 140834 - RNA, 1410 nt, Artificial Sequence; identical to SEQ ID NO: 138754
  derived and/or modified sequence opt3 from neuraminidase__InfluenzaA__ADH01861

SEQ ID NO: 140835 - RNA, 1410 nt, Artificial Sequence; identical to SEQ ID NO: 138754
  derived and/or modified sequence opt3 from neuraminidase__InfluenzaA__ADH01871

SEQ ID NO: 140836 - RNA, 1410 nt, Artificial Sequence; identical to SEQ ID NO: 138754
  derived and/or modified sequence opt3 from neuraminidase__InfluenzaA__ADH01881

SEQ ID NO: 140837 - RNA, 1410 nt, Artificial Sequence; identical to SEQ ID NO: 138754
  derived and/or modified sequence opt3 from neuraminidase__InfluenzaA__ADH01891

SEQ ID NO: 140838 - RNA, 1410 nt, Artificial Sequence; identical to SEQ ID NO: 138754
  derived and/or modified sequence opt3 from neuraminidase__InfluenzaA__ADH01901

SEQ ID NO: 140839 - RNA, 1410 nt, Artificial Sequence; identical to SEQ ID NO: 138754
  derived and/or modified sequence opt3 from neuraminidase__InfluenzaA__ADH01911

SEQ ID NO: 140840 - RNA, 1410 nt, Artificial Sequence; identical to SEQ ID NO: 138754
  derived and/or modified sequence opt3 from neuraminidase__InfluenzaA__ADH01921

SEQ ID NO: 140841 - RNA, 1410 nt, Artificial Sequence; identical to SEQ ID NO: 138754
  derived and/or modified sequence opt3 from neuraminidase__InfluenzaA__ADH01931

SEQ ID NO: 140842 - RNA, 1410 nt, Artificial Sequence; identical to SEQ ID NO: 140645
  derived and/or modified sequence opt3 from neuraminidase__InfluenzaA__ADH01941

SEQ ID NO: 140843 - RNA, 1410 nt, Artificial Sequence; identical to SEQ ID NO: 138754
  derived and/or modified sequence opt3 from neuraminidase__InfluenzaA__ADH01951

SEQ ID NO: 140844 - RNA, 1410 nt, Artificial Sequence; identical to SEQ ID NO: 138754
  derived and/or modified sequence opt3 from neuraminidase__InfluenzaA__ADH01961

SEQ ID NO: 140845 - RNA, 1410 nt, Artificial Sequence
  derived and/or modified sequence opt3 from neuraminidase__InfluenzaA__ADH01981
augaaccccaaucagaagaucauuaccauaggcagcgccugcaugacaaucgggauggcuaaccugauucuccaaaucggaaauauuaucuccauauggaucucucacucaauucagcuugguaaccagaaucagacugagacguguaaccaaagugugaucaccuacgaaaauaacacaugggucaaucagacuuauguuaacauuagcaauaccaacuucgcagccggccaguccgugguaucugugaaacuggcgggaaauucgucauugugcccugucagcggaugggcuaucuacaguaaggacaacuccauaagaauuggcucuaaaggugauguguuuguuaucagggagccauucauuagcuguuccccguuagaaugccggacauuuuuccugacccagggggcccuacucaaugacaagcauucaaacggaacuaucaaagaucgcagucccuaucgaacacugaugagcuguccuaucggcgaggugccaucucccuacaacucccguuuugaaucagucgcauggagcgccagugcuugccacgacggcauuaauuggcuuaccauagggaucucuggaccugauaacggugcaguggccguacugaaguauaauggcauuaucacggacacuauaaaguccuggagaaacaauauuuugaggacccaagagagcgagugugcuugcguuaacgggucguguuucacagugaugacugauggaccaucugacggccaggccuccuacaaaaucuuucggaucgaaaaggguaaaauugucaagucaguggagaugaaugcgcccaacuaucauuacgaagagugcaguuguuacccugauagcuccgagauuaccugcgugugccgcgacaauuggcacgggucuaacagaccaugggucagcuucaaucagaaccucgaauaucagaucggauacauauguucaggcaucuuuggcgauaauccgaggcccaacgacaaaacagggaguugcggaccuguuuccagcaauggugcaaacggcgugaagggguucucuuuuaaguauggaaacggcguauggauuggucggaccaaaucaaucaguagccgcaauggguucgagaugaucugggauccaaacggcuggacgggaacugacaauaacuuuuccauuaagcaagacauagugggcaucaaugaauggucuggguacucggggagcuucguccagcaucccgagcugacaggucuggauuguauucgaccuugcuucuggguggaacucaucagaggcaggccaaaagagaacaccauuuggacuuccgggucaaguaucucuuuuuguggaguuaauagcgacacagugggcugguccuggcccgauggugccgaguuaccguucaccauagacaaguga

SEQ ID NO: 140846 - RNA, 1410 nt, Artificial Sequence; identical to SEQ ID NO: 140042
  derived and/or modified sequence opt3 from neuraminidase__InfluenzaA__ADH01991

SEQ ID NO: 140847 - RNA, 1410 nt, Artificial Sequence; identical to SEQ ID NO: 140711
  derived and/or modified sequence opt3 from neuraminidase__InfluenzaA__ADH02011

SEQ ID NO: 140848 - RNA, 1410 nt, Artificial Sequence; identical to SEQ ID NO: 139931
  derived and/or modified sequence opt3 from neuraminidase__InfluenzaA__ADH02021

SEQ ID NO: 140849 - RNA, 1410 nt, Artificial Sequence; identical to SEQ ID NO: 138754
  derived and/or modified sequence opt3 from neuraminidase__InfluenzaA__ADI24510

SEQ ID NO: 140850 - RNA, 1410 nt, Artificial Sequence; identical to SEQ ID NO: 138754
  derived and/or modified sequence opt3 from neuraminidase__InfluenzaA__ADI24516

SEQ ID NO: 140851 - RNA, 1410 nt, Artificial Sequence; identical to SEQ ID NO: 138754
  derived and/or modified sequence opt3 from neuraminidase__InfluenzaA__ADI24518

SEQ ID NO: 140852 - RNA, 1410 nt, Artificial Sequence; identical to SEQ ID NO: 138754
  derived and/or modified sequence opt3 from neuraminidase__InfluenzaA__ADI24522

SEQ ID NO: 140853 - RNA, 1410 nt, Artificial Sequence; identical to SEQ ID NO: 138754
  derived and/or modified sequence opt3 from neuraminidase__InfluenzaA__ADI24524

SEQ ID NO: 140854 - RNA, 1410 nt, Artificial Sequence; identical to SEQ ID NO: 138754
  derived and/or modified sequence opt3 from neuraminidase__InfluenzaA__ADI24526

SEQ ID NO: 140855 - RNA, 1410 nt, Artificial Sequence; identical to SEQ ID NO: 138754
  derived and/or modified sequence opt3 from neuraminidase__InfluenzaA__ADI24528

SEQ ID NO: 140856 - RNA, 1410 nt, Artificial Sequence; identical to SEQ ID NO: 138754
  derived and/or modified sequence opt3 from neuraminidase__InfluenzaA__ADI24530

SEQ ID NO: 140857 - RNA, 1410 nt, Artificial Sequence
  derived and/or modified sequence opt3 from neuraminidase__InfluenzaA__ADI24532
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcucuggugcgaauggcguaaagggguucucauuuaaguauggaaacggcguguggaucggucggacaaaaaguaucagcucccgcaacggguucgagaugauuugggauccaaauggcuggaccggaacggacaacaauuuuucuauaaagcaagacaucgucggcauuaacgaauggucgggguacagcggauccuucgugcagcaucccgagcugacuggucuggauuguauccgaccuugcuucuggguugaacucauuagaggcaggccaaaagagaauacaaucuggaccucagggaguucuauaucguuuuguggagugaacuccgacacugucggcuggucauggcccgauggugcagaguuaccguucacaaucgacaaguga

SEQ ID NO: 140858 - RNA, 1410 nt, Artificial Sequence; identical to SEQ ID NO: 138754
  derived and/or modified sequence opt3 from neuraminidase__InfluenzaA__ADI24538

SEQ ID NO: 140859 - RNA, 1410 nt, Artificial Sequence; identical to SEQ ID NO: 138754
  derived and/or modified sequence opt3 from neuraminidase__InfluenzaA__ADI24548

SEQ ID NO: 140860 - RNA, 1410 nt, Artificial Sequence; identical to SEQ ID NO: 138754
  derived and/or modified sequence opt3 from neuraminidase__InfluenzaA__ADI24556

SEQ ID NO: 140861 - RNA, 1410 nt, Artificial Sequence; identical to SEQ ID NO: 138754
  derived and/or modified sequence opt3 from neuraminidase__InfluenzaA__ADI24558

SEQ ID NO: 140862 - RNA, 1410 nt, Artificial Sequence; identical to SEQ ID NO: 138754
  derived and/or modified sequence opt3 from neuraminidase__InfluenzaA__ADI24560

SEQ ID NO: 140863 - RNA, 1410 nt, Artificial Sequence; identical to SEQ ID NO: 138754
  derived and/or modified sequence opt3 from neuraminidase__InfluenzaA__ADI24562

SEQ ID NO: 140864 - RNA, 1410 nt, Artificial Sequence; identical to SEQ ID NO: 138754
  derived and/or modified sequence opt3 from neuraminidase__InfluenzaA__ADI24564

SEQ ID NO: 140865 - RNA, 1410 nt, Artificial Sequence; identical to SEQ ID NO: 138754
  derived and/or modified sequence opt3 from neuraminidase__InfluenzaA__ADI24566

SEQ ID NO: 140866 - RNA, 1410 nt, Artificial Sequence; identical to SEQ ID NO: 138754
  derived and/or modified sequence opt3 from neuraminidase__InfluenzaA__ADI24568

SEQ ID NO: 140867 - RNA, 1410 nt, Artificial Sequence; identical to SEQ ID NO: 138754
  derived and/or modified sequence opt3 from neuraminidase__InfluenzaA__ADI24570

SEQ ID NO: 140868 - RNA, 1410 nt, Artificial Sequence; identical to SEQ ID NO: 138754
  derived and/or modified sequence opt3 from neuraminidase__InfluenzaA__ADI24572

SEQ ID NO: 140869 - RNA, 1410 nt, Artificial Sequence; identical to SEQ ID NO: 138754
  derived and/or modified sequence opt3 from neuraminidase__InfluenzaA__ADI24574

SEQ ID NO: 140870 - RNA, 1410 nt, Artificial Sequence; identical to SEQ ID NO: 138754
  derived and/or modified sequence opt3 from neuraminidase__InfluenzaA__ADI24576

SEQ ID NO: 140871 - RNA, 1410 nt, Artificial Sequence; identical to SEQ ID NO: 138754
  derived and/or modified sequence opt3 from neuraminidase__InfluenzaA__ADI24580

SEQ ID NO: 140872 - RNA, 1410 nt, Artificial Sequence; identical to SEQ ID NO: 139929
  derived and/or modified sequence opt3 from neuraminidase__InfluenzaA__ADI24582

SEQ ID NO: 140873 - RNA, 1410 nt, Artificial Sequence
  derived and/or modified sequence opt3 from neuraminidase__InfluenzaA__ADI24584
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugccugucaaacuggccggaaauucuucguugugcccagugaacgggugggcgauauacucaaaggacaauagcauuagaaucggcaguaaaggugauguuuuugugauuagggagccguucaucuccuguucucccuuagaaugccggaccuuuuuccugacacagggggcucuacucaacgacaagcauagcaacggaaccaucaaagaucgcuccccuuaucgaacucugaugucauguccaauuggcgagguccccaguccuuacaauagccguuuugaaucuguggccugguccgcaucagccugccacgacggcauaaacuggcuuacaaucgggauuagcggaccagauaauggugcuguagcaguucugaaguauaacggcaucauaaccgacacgauuaagaguuggagaaauaacaucuugaggacucaagagucugagugugccugcgugaauggguccuguuucaccgucaugacagauggacccagcgacggccaggcuucguacaaaaucuuucggauugaaaaggguaaaaucgugaagucuguggagaugaacgccccuaauuaucauuacgaagagugcuccuguuacccagauucaagugagauuacuugcgucugccgcgacaacuggcacgggagcaauagaccguggguuuccuucaaccagaaucucgaauaucagauaggauacaucuguucuggcauuuuuggcgauaaccccaggccuaaugacaaaaccgggagcugcggaccagugucaaguaacggugcgaacggcguaaagggguucuccuuuaaguauggaaauggcguguggaucggucggacaaaaagcaucucuucacgcaacggguucgagaugauuugggaucccaauggcuggaccggaacggacaacaauuuuaguauaaagcaagacaucgucggcauuaacgaauggagcggguacuccggaucuuucgugcagcauccugagcugacuggucuggauuguauccgaccaugcuucuggguugaacucauuagaggcaggcccaaagagaauacaaucuggaccucggggagcuccauaucauuuuguggagugaacagugacacugucggcuggucuuggccggauggugcagaguuaccuuucacaaucgacaaguga

SEQ ID NO: 140874 - RNA, 1410 nt, Artificial Sequence; identical to SEQ ID NO: 139108
  derived and/or modified sequence opt3 from neuraminidase__InfluenzaA__ADI24592

SEQ ID NO: 140875 - RNA, 1410 nt, Artificial Sequence; identical to SEQ ID NO: 138754
  derived and/or modified sequence opt3 from neuraminidase__InfluenzaA__ADI24598

SEQ ID NO: 140876 - RNA, 1410 nt, Artificial Sequence; identical to SEQ ID NO: 138754
  derived and/or modified sequence opt3 from neuraminidase__InfluenzaA__ADI24604

SEQ ID NO: 140877 - RNA, 1410 nt, Artificial Sequence; identical to SEQ ID NO: 138754
  derived and/or modified sequence opt3 from neuraminidase__InfluenzaA__ADI24620

SEQ ID NO: 140878 - RNA, 1410 nt, Artificial Sequence; identical to SEQ ID NO: 138754
  derived and/or modified sequence opt3 from neuraminidase__InfluenzaA__ADI24622

SEQ ID NO: 140879 - RNA, 1410 nt, Artificial Sequence; identical to SEQ ID NO: 139108
  derived and/or modified sequence opt3 from neuraminidase__InfluenzaA__ADI46780

SEQ ID NO: 140880 - RNA, 1410 nt, Artificial Sequence
  derived and/or modified sequence opt3 from neuraminidase__InfluenzaA__ADI46789
augaaccccaaucagaagaucauuaccauaggcagcgugugcaugacaaucgggauggccaaccugaugcuccaaauuggaaauaucauuuccaucuggauaucucacucaauccagcuugguaaccagaaucagauugagacuuguaaccaaagugucaucacguacgaaaauaacaccuggguuaaucagacauaugugaacauuagcaauacuaacuucgcugcaggccaguccguagugucugucaaacuggccggaaauucgucauugugcccugugagcgggugggcgaucuacaguaaggacaacuccguuagaauaggcucuaaaggugauguguuugucauuagggagccauucaucagcuguuccccguuagaaugccggaccuuuuuccugacacagggggcucuacucaaugacaagcauucaaacggaaccauuaaagaucgcagucccuaucgaacucugaugagcuguccuaucggcgaggugccaucucccuacaacucccguuuugaaucaguagccuggagcgcaagugccugccacgacggcaucaauuggcuuacaauugggauaucuggaccugauaacggugcuguugcagugcugaaguauaauggcaucauuaccgacacgaucaaguccuggagaaacaauauauugaggacucaagagagcgagugugccugcgucaacgggucguguuucaccgugaugacagauggaccaucuaaugaacaggcuuccuacaaaauuuuucggaucgagaagggcaaaaucgugaagucagucgaaaugaacgcccccaauuaucauuacgaggagugcaguuguuacccugacagcuccgaaauuacuugcguuugccgcgauaacuggcacgguucuaauagaccaugggugagcuucaaccagaaucucgaguaucagaucggguacauuuguucaggaauauuuggcgacaacccgaggcccaaugauaaaaccggcaguugcgggccuguauccagcaacggagcgaacggugugaagggcuucucuuuuaaguaugggaauggagucuggaucggccggacaaaaucaauuaguagccgcaacgguuucgaaaugaucugggacccaaauggguggaccggcacggauaacaauuuuuccaucaagcaagacauugugggaauaaacgaguggucuggcuacucggggagcuucguucagcaucccgaacugacuggacuggacuguauccgaccuugcuucuggguggagcucauuagagguaggccaaaagagaauacaaucuggaccuccggcucaaguauuucuuuuuguggggucaacagcgauacugugggaugguccuggcccgacggcgcagaauuaccguucacaaucgauaaguga

SEQ ID NO: 140881 - RNA, 1410 nt, Artificial Sequence; identical to SEQ ID NO: 138754
  derived and/or modified sequence opt3 from neuraminidase__InfluenzaA__ADI48185

SEQ ID NO: 140882 - RNA, 1410 nt, Artificial Sequence; identical to SEQ ID NO: 138754
  derived and/or modified sequence opt3 from neuraminidase__InfluenzaA__ADI48187

SEQ ID NO: 140883 - RNA, 1410 nt, Artificial Sequence; identical to SEQ ID NO: 138754
  derived and/or modified sequence opt3 from neuraminidase__InfluenzaA__ADI48189

SEQ ID NO: 140884 - RNA, 1410 nt, Artificial Sequence; identical to SEQ ID NO: 138754
  derived and/or modified sequence opt3 from neuraminidase__InfluenzaA__ADI48191

SEQ ID NO: 140885 - RNA, 1410 nt, Artificial Sequence; identical to SEQ ID NO: 138754
  derived and/or modified sequence opt3 from neuraminidase__InfluenzaA__ADI48193

SEQ ID NO: 140886 - RNA, 1410 nt, Artificial Sequence; identical to SEQ ID NO: 138754
  derived and/or modified sequence opt3 from neuraminidase__InfluenzaA__ADI48195

SEQ ID NO: 140887 - RNA, 1410 nt, Artificial Sequence
  derived and/or modified sequence opt3 from neuraminidase__InfluenzaA__ADI48197
augaaccccaaucagaagaucauuaccauaggcagcgugugcaugacaaucgggauggccaaccugauucuccaaaucggaaauauuaucuccauauggaucucucacucaauucaguucgguaaccagaaucagaucgagacuuguaaccaaagugucauuacguacgaaaauaacaccuggguuaaucagacauaugugaacaucagcaauacuaacuuugcugcaggccaguccguagugucugucaaacuugccggaaauucgucacugugcccugugagcggaugggcgauauacaguaaggacaacuccauuagaaucggcucuaaaggugauguuuucgugauuagggagccauuuaucagcuguuccccguuggaaugccggaccuucuuuuuaacacagggggcucugcuaaaugacaagcauucaaacggaaccaucaaagaucgcagucccuaucgaacucucaugagcuguccuauuggcgaggucccaucucccuacaacucccguuucgaaucaguggccuggagcgcaagugccugccacgacggcauaaauuggcugacaaucgggauuucuggaccugauaacggugcuguagcaguucuuaaguauaauggcaucauaaccgacacgauuaaguccuggagaaacaauauccugaggacucaagagagcgagugugccugcgugaacgggucguguuuuaccgucaugacagauggaccaucugacggccaggcuuccuacaaaaucuuccggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuuuaaucagaacuuggaauaucagauaggauacaucuguucaggcauuuucggcgauaauccgaggcccaacgacaaaaccgggaguugcggaccuguguccagcaauggugcgaacggcguaaagggguuuucuuucaaguauggaaacggcguguggaucggucggacaaaaucaaucaguagccgcaauggguuugagaugauuugggauccaaacggcuggaccggaacggacaauaacuucuccauaaagcaagacaucgucggcauuaaugaauggucuggguacucggggagcuucgugcagcaucccgagcucacuggucuggauuguauccgaccuugcuuuuggguugaacugauuagaggcaggccaaaagagaacacaaucuggaccuccgggucaaguauaucuuucuguggagugaauagcgacacugucggcugguccuggcccgauggugcagagcucccguuuacaaucgacaaguga

SEQ ID NO: 140888 - RNA, 1410 nt, Artificial Sequence; identical to SEQ ID NO: 138754
  derived and/or modified sequence opt3 from neuraminidase__InfluenzaA__ADI48199

SEQ ID NO: 140889 - RNA, 1410 nt, Artificial Sequence; identical to SEQ ID NO: 138754
  derived and/or modified sequence opt3 from neuraminidase__InfluenzaA__ADI48201

SEQ ID NO: 140890 - RNA, 1410 nt, Artificial Sequence; identical to SEQ ID NO: 138754
  derived and/or modified sequence opt3 from neuraminidase__InfluenzaA__ADI48203

SEQ ID NO: 140891 - RNA, 1410 nt, Artificial Sequence
  derived and/or modified sequence opt3 from neuraminidase__InfluenzaA__ADI48205
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguucccauuuagaaugccggaccuuuuuccugacacagggggcucuacucaaugacaagcacucaaacggaaccaucaaagaucgcaguccguaucgaacucugaugagcugucccauuggcgaggucccuucuccauacaacucccguuuugaaucaguggccuggagcgcaagugccugccaugacggcauaaauuggcuuacaaucgggauuucuggacccgauaacggugcuguagcaguucugaaguauaauggcaucauaaccgacacgauuaaguccuggagaaacaauaucuugaggacucaagagagcgagugugccugcgugaacgggucguguuucaccgucaugacagauggaccuucugacggccaggcuuccuacaaaaucuuucggauugaaaaggguaaaaucgugaagucaguggagaugaaugccccaaacuaucacuacgaagagugcaguuguuaccccgauagcuccgagauuacuugcgucugccgcgacaauuggcaugggucuaacagaccuuggguuagcuucaaucagaaccucgaauaucagauaggauacaucuguucaggcauuuuuggcgauaauccaaggccgaacgacaaaaccgggaguugcggacccguguccagcaauggugcgaacggcguaaagggguucucuuuuaaguauggaaacggcguguggaucggucggacaaaaucaaucaguagccgcaauggguucgagaugauuugggauccuaacggcuggaccggaacggacaauaacuuuuccauaaagcaagacaucgucggcauuaaugaauggucuggguacucggggagcuucgugcagcacccagagcugacuggucuggauuguauccgacccugcuucuggguugaacucauuagaggcaggccuaaagagaacacaaucuggaccuccgggucaaguauaucuuuuuguggagugaauagcgacacugucggcugguccuggccagauggugcagaguuacccuucacaaucgacaaguga

SEQ ID NO: 140892 - RNA, 1410 nt, Artificial Sequence; identical to SEQ ID NO: 138754
  derived and/or modified sequence opt3 from neuraminidase__InfluenzaA__ADI48207

SEQ ID NO: 140893 - RNA, 1410 nt, Artificial Sequence; identical to SEQ ID NO: 138754
  derived and/or modified sequence opt3 from neuraminidase__InfluenzaA__ADI48209

SEQ ID NO: 140894 - RNA, 1410 nt, Artificial Sequence; identical to SEQ ID NO: 138754
  derived and/or modified sequence opt3 from neuraminidase__InfluenzaA__ADI48211

SEQ ID NO: 140895 - RNA, 1410 nt, Artificial Sequence; identical to SEQ ID NO: 138754
  derived and/or modified sequence opt3 from neuraminidase__InfluenzaA__ADI48213

SEQ ID NO: 140896 - RNA, 1410 nt, Artificial Sequence; identical to SEQ ID NO: 138754
  derived and/or modified sequence opt3 from neuraminidase__InfluenzaA__ADI48215

SEQ ID NO: 140897 - RNA, 1410 nt, Artificial Sequence; identical to SEQ ID NO: 138754
  derived and/or modified sequence opt3 from neuraminidase__InfluenzaA__ADI48217

SEQ ID NO: 140898 - RNA, 1410 nt, Artificial Sequence; identical to SEQ ID NO: 138754
  derived and/or modified sequence opt3 from neuraminidase__InfluenzaA__ADI48219

SEQ ID NO: 140899 - RNA, 1410 nt, Artificial Sequence; identical to SEQ ID NO: 138754
  derived and/or modified sequence opt3 from neuraminidase__InfluenzaA__ADI48221

SEQ ID NO: 140900 - RNA, 1410 nt, Artificial Sequence; identical to SEQ ID NO: 138754
  derived and/or modified sequence opt3 from neuraminidase__InfluenzaA__ADI48625

SEQ ID NO: 140901 - RNA, 1410 nt, Artificial Sequence; identical to SEQ ID NO: 138754
  derived and/or modified sequence opt3 from neuraminidase__InfluenzaA__ADI48635

SEQ ID NO: 140902 - RNA, 1410 nt, Artificial Sequence; identical to SEQ ID NO: 138754
  derived and/or modified sequence opt3 from neuraminidase__InfluenzaA__ADI48655

SEQ ID NO: 140903 - RNA, 1410 nt, Artificial Sequence; identical to SEQ ID NO: 138754
  derived and/or modified sequence opt3 from neuraminidase__InfluenzaA__ADI48665

SEQ ID NO: 140904 - RNA, 1410 nt, Artificial Sequence
  derived and/or modified sequence opt3 from neuraminidase__InfluenzaA__ADI48675
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcagguuaaaagagaacacaaucuggaccuccgggucaaguauaucuuuuuguggagugaauagcgacacugucggcugguccuggccagauggugcagagcugcccuucacaaucgacaaguga

SEQ ID NO: 140905 - RNA, 1410 nt, Artificial Sequence
  derived and/or modified sequence opt3 from neuraminidase__InfluenzaA__ADI48685
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacggggcuuguuucaccgucaugacagauggaccaucggacggccaggccucuuacaaaaucuuucggauugaaaaggguaaaaucgugaaguccguggagaugaaugcgcccaacuaucauuacgaagagugcucauguuacccugauaguagcgagauuacuugcgucugccgcgacaauuggcacggguccaacagaccauggguuucuuucaaucagaaccucgaauaucagauaggauacaucuguagcggcauuuuuggcgauaauccgaggcccaacgacaaaaccgggucaugcggaccugugaguuccaauggugcaaacggcguaaagggguucagcuuuaaguauggaaacggcguguggaucggucggacaaaaucuaucucaagucgcaauggguucgagaugauuugggauccaaacggcuggaccggaacggacaauaacuuuagcauaaagcaagacaucgucggcauuaaugaaugguccggguacucuggaucguucgugcagcaucccgagcugacuggucuggauuguauccgaccuugcuucuggguugaacucauuagaggcaggccaaaagagaacacaaucuggaccagcggguccucaauaaguuuuuguggagucaauucugacacugugggcuggagcuggcccgauggugccgaguuaccguucacaaucgacaaguga

SEQ ID NO: 140906 - RNA, 1410 nt, Artificial Sequence; identical to SEQ ID NO: 138754
  derived and/or modified sequence opt3 from neuraminidase__InfluenzaA__ADI48695

SEQ ID NO: 140907 - RNA, 1410 nt, Artificial Sequence; identical to SEQ ID NO: 138744
  derived and/or modified sequence opt3 from neuraminidase__InfluenzaA__ADI48705

SEQ ID NO: 140908 - RNA, 1410 nt, Artificial Sequence; identical to SEQ ID NO: 138754
  derived and/or modified sequence opt3 from neuraminidase__InfluenzaA__ADI48715

SEQ ID NO: 140909 - RNA, 1410 nt, Artificial Sequence; identical to SEQ ID NO: 138754
  derived and/or modified sequence opt3 from neuraminidase__InfluenzaA__ADI48725

SEQ ID NO: 140910 - RNA, 1410 nt, Artificial Sequence; identical to SEQ ID NO: 138754
  derived and/or modified sequence opt3 from neuraminidase__InfluenzaA__ADI48735

SEQ ID NO: 140911 - RNA, 1410 nt, Artificial Sequence; identical to SEQ ID NO: 138754
  derived and/or modified sequence opt3 from neuraminidase__InfluenzaA__ADI48745

SEQ ID NO: 140912 - RNA, 1410 nt, Artificial Sequence
  derived and/or modified sequence opt3 from neuraminidase__InfluenzaA__ADI48755
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauauccgacaccauuaagagcuggagaaacaauaucuugaggacgcaagagucggagugugccugcgugaacgggucuuguuucacugucaugaccgauggaccauccgacggccaggcuucauacaaaaucuuucggauugaaaaggguaaaaucgugaagaguguggagaugaaugcccccaacuaucauuacgaagagugcagcuguuacccugauuccucugagauuacaugcgucugccgcgacaauuggcacgggagcaacagaccauggguuucauucaaucagaaccucgaauaucagauaggauacaucuguaguggcauuuuuggcgauaauccgaggcccaacgacaaaacuggguccugcggaccugugagcucuaauggugcgaacggcguaaagggguucucauuuaaguauggaaacggcguguggaucggucggaccaaaaguaucagcucccgcaauggguucgagaugauuugggauccaaacggcuggacaggaaccgacaauaacuuuucuauaaagcaagacaucgucggcauuaaugaauggucgggguacagcggauccuucgugcagcaucccgagcugacgggucuggauuguauccgaccuugcuucuggguugaacucauuagaggcaggccaaaagagaacacuaucuggacaucagggaguucuauaucguuuuguggagucaauuccgacaccgugggcuggucauggcccgauggugcagaguuaccguucacuaucgacaaguga

SEQ ID NO: 140913 - RNA, 1410 nt, Artificial Sequence; identical to SEQ ID NO: 138754
  derived and/or modified sequence opt3 from neuraminidase__InfluenzaA__ADI48765

SEQ ID NO: 140914 - RNA, 1410 nt, Artificial Sequence; identical to SEQ ID NO: 138754
  derived and/or modified sequence opt3 from neuraminidase__InfluenzaA__ADI48775

SEQ ID NO: 140915 - RNA, 1410 nt, Artificial Sequence; identical to SEQ ID NO: 138754
  derived and/or modified sequence opt3 from neuraminidase__InfluenzaA__ADI48785

SEQ ID NO: 140916 - RNA, 1410 nt, Artificial Sequence; identical to SEQ ID NO: 138754
  derived and/or modified sequence opt3 from neuraminidase__InfluenzaA__ADI48795

SEQ ID NO: 140917 - RNA, 1410 nt, Artificial Sequence; identical to SEQ ID NO: 138754
  derived and/or modified sequence opt3 from neuraminidase__InfluenzaA__ADI49032

SEQ ID NO: 140918 - RNA, 1410 nt, Artificial Sequence; identical to SEQ ID NO: 138754
  derived and/or modified sequence opt3 from neuraminidase__InfluenzaA__ADI49243

SEQ ID NO: 140919 - RNA, 1410 nt, Artificial Sequence; identical to SEQ ID NO: 138754
  derived and/or modified sequence opt3 from neuraminidase__InfluenzaA__ADI49263

SEQ ID NO: 140920 - RNA, 1410 nt, Artificial Sequence; identical to SEQ ID NO: 138754
  derived and/or modified sequence opt3 from neuraminidase__InfluenzaA__ADI49273

SEQ ID NO: 140921 - RNA, 1410 nt, Artificial Sequence; identical to SEQ ID NO: 138754
  derived and/or modified sequence opt3 from neuraminidase__InfluenzaA__ADI49283

SEQ ID NO: 140922 - RNA, 1410 nt, Artificial Sequence; identical to SEQ ID NO: 138754
  derived and/or modified sequence opt3 from neuraminidase__InfluenzaA__ADI49315

SEQ ID NO: 140923 - RNA, 1410 nt, Artificial Sequence; identical to SEQ ID NO: 138754
  derived and/or modified sequence opt3 from neuraminidase__InfluenzaA__ADI49325

SEQ ID NO: 140924 - RNA, 1410 nt, Artificial Sequence; identical to SEQ ID NO: 138754
  derived and/or modified sequence opt3 from neuraminidase__InfluenzaA__ADI49335

SEQ ID NO: 140925 - RNA, 1410 nt, Artificial Sequence
  derived and/or modified sequence opt3 from neuraminidase__InfluenzaA__ADI49345
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaaccuggcugcaggccaguccguagugucugucaaauuggccggaaauucgucauuaugcccugugagcggaugggcgauauacaguaaggacaacuccauuagaaucggcucuaaaggugauguuuucgugauuagggagccauuuaucagcuguuccccgcuggaaugccggaccuucuuucuaacacagggggcucuccugaaugacaagcauucaaacggaaccaucaaagaucgcagucccuaucgaacucuuaugagcuguccuauuggcgacgucccaucucccuacaacucccguuucgagucaguggccuggagcgcaagugccugccacgauggcauaaauuggcugacaaucgggauuucuggaccugacaacggugcuguagcaguuuugaaguauaauggcaucauaaccgauacgauuaaguccuggagaaacaauauccucaggacucaagaaagcgagugugccugcgugaacgggucguguuuuaccgucaugacagacggaccaucugauggccaggcuuccuacaaaaucuuccggauugagaaggguaaaaucgugaagucaguggaaaugaaugcccccaacuaucauuacgaggaaugcaguuguuacccugacagcuccgagauuacuugcgucugccgcgauaauuggcacgggucuaacagaccauggguuagcuuuaaucagaaccuggaguaucagauaggauacaucuguucaggcauuuucggcgacaauccgaggcccaacgauaaaaccgggaguugcggaccuguguccagcaauggugcgaacggcguaaagggguuuucuuucaaguauggaaacggcguguggaucggucggacaaaaucaaucaguagccgcaauggguuugaaaugauuugggacccaaacggcuggaccggaacggacaauaacuucuccauaaagcaagauaucgucggcauuaaugaguggucuggguacucggggagcuuugugcagcaucccgaacugacuggucucgacuguauccgaccuugcuucuggguugaguuaauuagaggcaggccaaaagaaaacacaaucuggaccuccgggucaaguauaucuuucuguggagugaauagcgauacugucggcugguccuggcccgacggugcagagcugccguuuacaaucgauaaguga

SEQ ID NO: 140926 - RNA, 1410 nt, Artificial Sequence; identical to SEQ ID NO: 138754
  derived and/or modified sequence opt3 from neuraminidase__InfluenzaA__ADI49355

SEQ ID NO: 140927 - RNA, 1410 nt, Artificial Sequence; identical to SEQ ID NO: 138754
  derived and/or modified sequence opt3 from neuraminidase__InfluenzaA__ADI49365

SEQ ID NO: 140928 - RNA, 1410 nt, Artificial Sequence; identical to SEQ ID NO: 138754
  derived and/or modified sequence opt3 from neuraminidase__InfluenzaA__ADI49375

SEQ ID NO: 140929 - RNA, 1410 nt, Artificial Sequence; identical to SEQ ID NO: 138754
  derived and/or modified sequence opt3 from neuraminidase__InfluenzaA__ADI49385

SEQ ID NO: 140930 - RNA, 1410 nt, Artificial Sequence
  derived and/or modified sequence opt3 from neuraminidase__InfluenzaA__ADI49395
augaaccccaaucagaagaucauuaccauaggcagcgugugcaugacaaucgggauggccaaccugauucuccaaaucggaaauaugauuuccaucuggauaucucacucaauccagcuugguaaccagaaucagauugagacuuguaaccaaagugucaucacguacgaaaauaacaccuggguuaaucagacauaugugaacauuagcaauacuaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggucccaucucccuacaacucccguuuugaaucaguggccuggagcgcaagugccugccacgacggcauuaauuggcuuacaauagggaucucuggaccugauaacggugcuguagcaguucugaaguauaauggcauuaucaccgacacgauaaaguccuggagaaacaauauuuugaggacucaagagagcgagugugccugcgugaacgggucguguuucaccgucaugacagauggaccaucugacggccaggcuuccuacaaaaucuuucggaucgaaaaggguaaaauugugaagucaguggagcucaaugcccccaacuaucauuacgaagagugcaguuguuacccugauagcuccgagaucacuugcgucugccgcgacaauuggcacgggucuaacagaccauggguuagcuucaaucagaaccuggaauaucagauuggauacauauguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucucgauuguauucgaccuugcuucuggguugaauuaaucagaggcaggccaaaagagaacacaauuuggaccuccgggucaaguaucucuuuuuguggagugaauagcgacacugucggcugguccuggcccgauggugcagagcugccguucacaauagacaaguga

SEQ ID NO: 140931 - RNA, 1410 nt, Artificial Sequence; identical to SEQ ID NO: 138754
  derived and/or modified sequence opt3 from neuraminidase__InfluenzaA__ADI49720

SEQ ID NO: 140932 - RNA, 1410 nt, Artificial Sequence; identical to SEQ ID NO: 138754
  derived and/or modified sequence opt3 from neuraminidase__InfluenzaA__ADI49730

SEQ ID NO: 140933 - RNA, 1410 nt, Artificial Sequence; identical to SEQ ID NO: 138754
  derived and/or modified sequence opt3 from neuraminidase__InfluenzaA__ADI49740

SEQ ID NO: 140934 - RNA, 1410 nt, Artificial Sequence; identical to SEQ ID NO: 138754
  derived and/or modified sequence opt3 from neuraminidase__InfluenzaA__ADI49750

SEQ ID NO: 140935 - RNA, 1410 nt, Artificial Sequence; identical to SEQ ID NO: 138754
  derived and/or modified sequence opt3 from neuraminidase__InfluenzaA__ADI49760

SEQ ID NO: 140936 - RNA, 1410 nt, Artificial Sequence; identical to SEQ ID NO: 138784
  derived and/or modified sequence opt3 from neuraminidase__InfluenzaA__ADI49780

SEQ ID NO: 140937 - RNA, 1410 nt, Artificial Sequence; identical to SEQ ID NO: 138744
  derived and/or modified sequence opt3 from neuraminidase__InfluenzaA__ADI49790

SEQ ID NO: 140938 - RNA, 1410 nt, Artificial Sequence; identical to SEQ ID NO: 138754
  derived and/or modified sequence opt3 from neuraminidase__InfluenzaA__ADI49821

SEQ ID NO: 140939 - RNA, 1410 nt, Artificial Sequence; identical to SEQ ID NO: 138744
  derived and/or modified sequence opt3 from neuraminidase__InfluenzaA__ADI50029

SEQ ID NO: 140940 - RNA, 1410 nt, Artificial Sequence
  derived and/or modified sequence opt3 from neuraminidase__InfluenzaA__ADI52830
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccguuagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugacgaguuaccguucacaauagauaaguga

SEQ ID NO: 140941 - RNA, 1410 nt, Artificial Sequence
  derived and/or modified sequence opt3 from neuraminidase__InfluenzaA__ADI52831
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucagucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 140942 - RNA, 1410 nt, Artificial Sequence; identical to SEQ ID NO: 138754
  derived and/or modified sequence opt3 from neuraminidase__InfluenzaA__ADI52832

SEQ ID NO: 140943 - RNA, 1410 nt, Artificial Sequence
  derived and/or modified sequence opt3 from neuraminidase__InfluenzaA__ADI52833
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggccccaucucccuacaacucccguuuugaaucagucgcauggagcgccagugcuugccacgacggcauaaauuggcuuacaaucgggauuucuggaccugauaacggugcaguggccguacugaaguauaauggcaucauaaccgacacgauuaaguccuggagaaacaauaucuugaggacucaagagagcgagugugcuugcguuaacgggucguguuucaccgugaugacagauggaccaucugacggccaggccuccuacaaaaucuuucggauugaaaaggguaaaaucgucaagucaguggagaugaaugcgcccaacuaucauuacgaagagugcaguuguuacccugauagcuccgagauuacuugcgugugccgcgacaauuggcacgggucuaacagaccaugggucagcuucaaucagaaccucgaauaucagauaggauacaucuguucaggcauuuuuggcgauaauccgaggcccaacgacaaaaccgggaguugcggaccuguuuccagcaauggugcaaacggcgugaagggguucucuuuuaaguauggaaacggcguauggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguccagcaucccgagcugacuggucuggauuguauccgaccuugcuucuggguggaacucauuagaggcaggccaaaagagaacacaaucuggaccuccgggucaaguauaucuuuuuguggaguuaauagcgacacugugggcugguccuggcccgauggugccgaguuaccguucacaaucgacaaguga

SEQ ID NO: 140944 - RNA, 1413 nt, Artificial Sequence; identical to SEQ ID NO: 139477
  derived and/or modified sequence opt3 from neuraminidase__InfluenzaA__ADI75821

SEQ ID NO: 140945 - RNA, 1410 nt, Artificial Sequence; identical to SEQ ID NO: 139921
  derived and/or modified sequence opt3 from neuraminidase__InfluenzaA__ADI75832

SEQ ID NO: 140946 - RNA, 1413 nt, Artificial Sequence
  derived and/or modified sequence opt3 from neuraminidase__InfluenzaA__ADI75854
augaaccccaaucagaagaucauuaccauaggcagcaucuccauugccaucgggauuaucucucugaugcuccaaauaggaucaaucauuaguaucugggcuagccacuccauucagacagguucucagaacaauacuggcaucugcaaccagagaauaauuacguacgaaaauucgaccugggugaaccauacauaugucaauaucaacaauacuaacguuguggcaggggaggacaaaaccucaguaacacuugccggaaauagcagucuguguuccauuucuggcugggcgaucuacaccaaggauaacagcaucaggauugguuccaaaggggacguguucgucauacgggagccuuuuaucucaugcagucacuuggaaugucgcacuuucuuuuuaacacaaggagcucugcuaaaugauaagcauagcaacggcaccgugaaagaccgaucuccauaucgugcccucauguccugcccgcugggcgaggcacccucaccuuacaauagcaaguucgaaaguguugccuggucugcuuccgcaugucacgaugggaugggauggcuuacgauugguaucagcggcccagacaacggggccguggcuguccugaaguauaacggaauaauuacuggcaccaucaaaucguggaagaaacagaucuugagaacacaggagucugagugcguguguaugaaugguuccugcuuuacuauuaugaccgaugggcccucaaacaaggccgcgaguuacaaaaucuucaagauugaaaagggaaaaguaacaaagagcauagagcucaaugcaccuaacuuuuauuacgaagaguguuccugcuacccagacaccggcaucguuaugugugugugcagggauaauuggcauggcucuaaccggcccugggucagcuucaaucagaaccuggacuaucaaauuggguacaucugcucaggaguguuuggugauaauccucgcccagaggacggcgaagggaguuguaacccggugacggucgauggagccaauggcguuaaagguuucuccuauaaguacgggaacggcguguggaucggaagaacuaaaagcaauaggcugcggaagggcuuugagaugauuugggaccccaacggguggacaaauaccgacucugauuucucaguaaaacaggacguggucgcuauaacugauuggaguggauauagcgguuccuuugugcagcacccugaacucacaggcuuagacugcauccgcccauguuucuggguugagcuggugcgagggcuucccagagaaaacaccacgauuuggaccucuggaucgagcaucuccuucugcggcgucaacucagauacagccaauuggaguuggccugacggugcagaguugccauuuacuauugauaaguga

SEQ ID NO: 140947 - RNA, 1410 nt, Artificial Sequence
  derived and/or modified sequence opt3 from neuraminidase__InfluenzaA__ADI75876
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaguaugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcaucgcuuggagcaguuccucuugucaugacgguaaagccuggcuccacgugugcauuacaggggaugacaagaacgcaaccgccagcuucaucuacaauggaaggcugguagauuccguugugucauggaguaaagagauccugcggacgcaggaaagcgagugugucugcauuaacggcacuuguacaguggugaugaccgacggcucugcuuccgggaaggcagauacuaaaauacucuuuaucgaggaaggaaagauuguccauacaucaaccuuaagcgguagugcccaacacguugaggaaugcucuugcuauccucgcuacccaggcgugagauguguaugcagggacaacuggaagggguccaaucggccgaucguggauauaaacauuaaagaccacagcgucgugucgucuuacguuuguuccggacuggugggcgacacgccccgcaagaaugauucaaguagcuccucucauugccuugacccuaacaaugaggaaggugggcacggagucaaaggcugggcuuucgaugacggcaacgauguguggauggggcgaaccaucagcgagaagucaagauugggauaugagacauuuaaaguaaucgaagguuggaguaaucauaaguccaaacugcagauuaacaggcagguuaucguggaccggggcaaucguagcggguacucuggaauuuucucagucgagggcaagaguuguauaaaccgcugcuuuuauguggaacuaaucagagguaggaaggaggaaacugagguccucuggaccagcaauuccauugugguuuucugugggacaucuggcacuuacggaaccggcucguggccagauggggccgaccugaaccuuaugcccaucuga

SEQ ID NO: 140948 - RNA, 1410 nt, Artificial Sequence; identical to SEQ ID NO: 139921
  derived and/or modified sequence opt3 from neuraminidase__InfluenzaA__ADI75887

SEQ ID NO: 140949 - RNA, 1413 nt, Artificial Sequence; identical to SEQ ID NO: 139477
  derived and/or modified sequence opt3 from neuraminidase__InfluenzaA__ADI75909

SEQ ID NO: 140950 - RNA, 1410 nt, Artificial Sequence; identical to SEQ ID NO: 140500
  derived and/or modified sequence opt3 from neuraminidase__InfluenzaA__ADI75920

SEQ ID NO: 140951 - RNA, 1413 nt, Artificial Sequence; identical to SEQ ID NO: 139477
  derived and/or modified sequence opt3 from neuraminidase__InfluenzaA__ADI77352

SEQ ID NO: 140952 - RNA, 1410 nt, Artificial Sequence; identical to SEQ ID NO: 138754
  derived and/or modified sequence opt3 from neuraminidase__InfluenzaA__ADI77363

SEQ ID NO: 140953 - RNA, 1410 nt, Artificial Sequence; identical to SEQ ID NO: 139931
  derived and/or modified sequence opt3 from neuraminidase__InfluenzaA__ADI99500

SEQ ID NO: 140954 - RNA, 1410 nt, Artificial Sequence
  derived and/or modified sequence opt3 from neuraminidase__InfluenzaA__ADI99553
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagacucugugaaacuggccggaaauucgucauugugcccugucagcggaugggcgauauacaguaaggauaacuccauuagaaucggcucuaaaggugacguguuuguuauuagggagccauucaucagcuguuccccguuagaaugccggaccuuuuuccugacacagggggcucuacucaaugauaagcauucaaacggaaccaucaaagaccgcagucccuaucgaacucugaugagcuguccuauuggcgaggugccaucucccuacaacucccguuuugaaucagucgccuggagcgcaagugccugccacgauggcauaaauuggcuuacaaucgggauuucuggaccugacaacggugcuguggcaguacugaaguauaauggcaucauaaccgauacgauuaaguccuggagaaacaauaucuugaggacucaagagagcgagugugccugcguuaacgggucguguuucaccgugaugacagacggaccaucugauggccaggcuuccuacaaaaucuuucggauugaaaaggguaaaaucgucaagucaguggagaugaaugcccccaacuaucauuacgaagagugcaguuguuacccugacagcuccgagauuacuugcgugugccgcgauaauuggcacgggucuaacagaccaugggucagcuucaaucagaaccucgaauaucagauaggauacaucuguucaggcauuuuuggcgacaauccgaggcccaacgauaaaaccgggaguugcggaccuguuuccagcaauggugcgaacggcgugaagggguucucuuuuaaguauggaaacggcguauggaucggucggacaaaaucaaucaguagccgcaauggguucgagaugauuugggacccaaacggcuggaccggaacggacaauaacuuuuccauaaagcaagauaucgugggcauuaaugaauggucuggguacucggggagcuucguccagcaucccgagcugacuggucuggacuguauccgaccuugcuucuggguggaacucauuagaggcaggccaaaagagaacacaaucuggaccuccgggucaaguauaucuuuuuguggaguuaauagcgauacugugggcugguccuggcccgacggugcagaguuaccguucacaaucgauaaguga

SEQ ID NO: 140955 - RNA, 1410 nt, Artificial Sequence
  derived and/or modified sequence opt3 from neuraminidase__InfluenzaA__ADI99563
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggaggucaaugcccccaacuaucauuacgaagagugcaguuguuacccugauagcuccgagauuacuugcguuugccgcgacaauuggcacgggucuaacagaccaugggugagcuucaaucagaaccucgaauaucagauaggauacaucuguucaggcauuuuuggcgauaauccgaggcccaacgacaaaaccgggaguugcggaccuguauccagcaauggugcgaacggcgugaagggguucucuuuuaaguauggaaacggcgucuggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguucagcaucccgagcugacuggucuggauuguauccgaccuugcuucuggguggaacucauuagaggcaggccaaaagagaacacaaucuggaccuccgggucaaguauaucuuuuuguggagucaauagcgacacugugggcugguccuggcccgauggugcagaguuaccguucacaaucgacaaguga

SEQ ID NO: 140956 - RNA, 1410 nt, Artificial Sequence; identical to SEQ ID NO: 140955
  derived and/or modified sequence opt3 from neuraminidase__InfluenzaA__ADI99573

SEQ ID NO: 140957 - RNA, 1410 nt, Artificial Sequence; identical to SEQ ID NO: 140955
  derived and/or modified sequence opt3 from neuraminidase__InfluenzaA__ADI99583

SEQ ID NO: 140958 - RNA, 1410 nt, Artificial Sequence; identical to SEQ ID NO: 140105
  derived and/or modified sequence opt3 from neuraminidase__InfluenzaA__ADI99593

SEQ ID NO: 140959 - RNA, 1410 nt, Artificial Sequence
  derived and/or modified sequence opt3 from neuraminidase__InfluenzaA__ADI99613
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaauaaucaguuuuuguggagucaauucugacacugugggcuggagcuggcccgauggugcagaguuaccguucacaauugacaaguga

SEQ ID NO: 140960 - RNA, 1410 nt, Artificial Sequence
  derived and/or modified sequence opt3 from neuraminidase__InfluenzaA__ADI99623
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucuaugaaacuggccggaaauucgucauugugcccugucagcgggugggcgauauacaguaaggacaacuccauuagaaucggcucuaaaggugauguguuuguuauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggugccaucucccuacaacucccguuuugaaucagucgccuggagcgcaagugccugccacgacggcauaaauuggcuuacaaucgggauuucuggaccugauaacggugcuguggcaguacugaaguauaauggcaucauaaccgacacgauuaaguccuggagaaacaauaucuugaggacucaagagagcgagugugccugcguuaacgggucguguuucaccgugaugacagauggaccaucugacggccaggcuuccuacaaaaucuuucggauugaaaaggguaaaaucgucaagucaguggagaugaaugcccccaacuaucauuacgaagagugcaguuguuacccugauagcaaugagauuacuugcgugugccgcgacaacuggcacggguccaauagaccaugggucucuuucaaccagaaucucgaauaucagauaggauacaucuguagcggcauuuuuggcgauaacccgaggcccaaugacaaaaccgggucaugcggaccuguuaguuccaacggugcgaacggcgugaagggguucagcuuuaaguauggaaauggcguauggaucggucggacaaaaucuaucucaagucgcaacggguucgagaugauuugggauccaaauggcuggaccggaacggacaacaauuuuagcauaaagcaagacaucgugggcauuaacgaaugguccggguacucuggaucguucguccagcaucccgagcugacuggucuggauuguauccgaccuugcuucuggguggaacucauuagaggcaggccaaaagagaauacaaucuggaccagcggguccucaauaaguuuuuguggaguuaacucugacacugugggcuggagcuggcccgauggugcagaguuaccguucacaaucgacaaguga

SEQ ID NO: 140961 - RNA, 1410 nt, Artificial Sequence; identical to SEQ ID NO: 140042
  derived and/or modified sequence opt3 from neuraminidase__InfluenzaA__ADI99633

SEQ ID NO: 140962 - RNA, 1410 nt, Artificial Sequence; identical to SEQ ID NO: 140105
  derived and/or modified sequence opt3 from neuraminidase__InfluenzaA__ADI99643

SEQ ID NO: 140963 - RNA, 1410 nt, Artificial Sequence; identical to SEQ ID NO: 138754
  derived and/or modified sequence opt3 from neuraminidase__InfluenzaA__ADI99653

SEQ ID NO: 140964 - RNA, 1410 nt, Artificial Sequence; identical to SEQ ID NO: 138754
  derived and/or modified sequence opt3 from neuraminidase__InfluenzaA__ADI99663

SEQ ID NO: 140965 - RNA, 1410 nt, Artificial Sequence; identical to SEQ ID NO: 138754
  derived and/or modified sequence opt3 from neuraminidase__InfluenzaA__ADI99673

SEQ ID NO: 140966 - RNA, 1410 nt, Artificial Sequence; identical to SEQ ID NO: 138754
  derived and/or modified sequence opt3 from neuraminidase__InfluenzaA__ADI99683

SEQ ID NO: 140967 - RNA, 1410 nt, Artificial Sequence; identical to SEQ ID NO: 140216
  derived and/or modified sequence opt3 from neuraminidase__InfluenzaA__ADI99703

SEQ ID NO: 140968 - RNA, 1410 nt, Artificial Sequence; identical to SEQ ID NO: 138754
  derived and/or modified sequence opt3 from neuraminidase__InfluenzaA__ADI99713

SEQ ID NO: 140969 - RNA, 1410 nt, Artificial Sequence; identical to SEQ ID NO: 138754
  derived and/or modified sequence opt3 from neuraminidase__InfluenzaA__ADI99723

SEQ ID NO: 140970 - RNA, 1410 nt, Artificial Sequence; identical to SEQ ID NO: 138754
  derived and/or modified sequence opt3 from neuraminidase__InfluenzaA__ADI99733

SEQ ID NO: 140971 - RNA, 1410 nt, Artificial Sequence; identical to SEQ ID NO: 138909
  derived and/or modified sequence opt3 from neuraminidase__InfluenzaA__ADJ00487

SEQ ID NO: 140972 - RNA, 1410 nt, Artificial Sequence; identical to SEQ ID NO: 138909
  derived and/or modified sequence opt3 from neuraminidase__InfluenzaA__ADJ00488

SEQ ID NO: 140973 - RNA, 1410 nt, Artificial Sequence; identical to SEQ ID NO: 138909
  derived and/or modified sequence opt3 from neuraminidase__InfluenzaA__ADJ00489

SEQ ID NO: 140974 - RNA, 1410 nt, Artificial Sequence; identical to SEQ ID NO: 138909
  derived and/or modified sequence opt3 from neuraminidase__InfluenzaA__ADJ00490

SEQ ID NO: 140975 - RNA, 1410 nt, Artificial Sequence; identical to SEQ ID NO: 138909
  derived and/or modified sequence opt3 from neuraminidase__InfluenzaA__ADJ00491

SEQ ID NO: 140976 - RNA, 1410 nt, Artificial Sequence; identical to SEQ ID NO: 138754
  derived and/or modified sequence opt3 from neuraminidase__InfluenzaA__ADJ18160

SEQ ID NO: 140977 - RNA, 1410 nt, Artificial Sequence; identical to SEQ ID NO: 138754
  derived and/or modified sequence opt3 from neuraminidase__InfluenzaA__ADJ18161

SEQ ID NO: 140978 - RNA, 1410 nt, Artificial Sequence
  derived and/or modified sequence opt3 from neuraminidase__InfluenzaA__ADJ18162
augauccccaaccagaagauuauaaccaucggcagcgugugcaugacaauugggauggccaaucugauccuccaaauuggaaacaucauauccaucuggauuucucacucaauccagcuugguaaucagaaccagauugagacuuguaaucaaagugucaucacguacgaaaacaauaccuggguuaaccagacauaugugaauauaagcaacacuaauuucgcugcaggccaguccguagugucugucaaacuggccgggaacucgucauugugcccugugagcggaugggcgauuuacaguaaggacaauuccaucagaauuggcucuaaaggugauguuuuugugaucaggaagccauucaucagcuguuccccguuagagugccggaccuuuuuccugacacagggggcucuacucaacgacaaacauucaaauggaaccauuaaggaucgcagucccuaucgaacucugaugagcuguccuauaggcgaagucccaucucccuacaacucccguuuugagucaguggccuggagcgcaagugccugccacgacggcaucaacuggcuuacaauugggaucucuggaccugauaauggugcuguagcaguucugaaguauaacggcauaauuaccgacacgaucaaauccuggagaaauaacaucuugaggacucaagaaagcgagugugccugcgugaaugggucguguuucaccgucaugacagauggaccaucugacggccaggcuuccuacaagauuuuucggaucgagaaagguaagauugugaaaucaguggaaaugaacgcccccaauuaucauuacgaggaaugcaguuguuacccugauagcuccgagauaacuugcgucugccgcgacaacuggcacgggucuaauagaccauggguuagcuucaaccagaaucucgaguaucagaucggauacauuuguucaggcaucuuuggcgauaacccgaggcccaaugacaagaccgggaguugcggaccuguguccagcaacggugcgaauggcguaaagggguucucuuuuaaauauggaaacggcguguggaucggucggacaaagucaauuaguagccgcaacggguucgaaaugauaugggauccaaauggcuggaccggaacggacaacaauuuuuccaucaaacaagacauugucggcaucaacgaguggucuggguacucggguagcuucgugcagcaucccgaacugacuggacuggauuguauucgaccuugcuucuggguugagcucaucagaggcaggccaaaggaaaauacaauauggaccuccgggucaaguaucucuuuuuguggagugaacagcgacacugucggcugguccuggcccgauggugcagaguuaccguucacaauugacaaauga

SEQ ID NO: 140979 - RNA, 1410 nt, Artificial Sequence
  derived and/or modified sequence opt3 from neuraminidase__InfluenzaA__ADJ18164
augaaccccaagcagaaaaucauuaccauaggcagcgugugcaugacaaucgggauggccaaucugauucuccaaaucggaaacauuaucuccauauggaucucucacucaauucagcuugguaaucagaaccagaucgagacuuguaaucaaagugucauuacguacgaaaacaauaccuggguuaaccagacauaugugaauaucagcaacacuaauuucgcugcaggccaguccguagugucugucaagcuggccgggaacucgucauugugcagcgugaguggaugggcgauauacuccaaagacaauucuauuagaaucggcagcaagggugauguuuuugugauuagggagccuuucaucuccuguucaccauuagaaugccggaccuuuuuccugacacagggggcucuacucaacgacaaacauaguaauggaaccaucaaggaucgcagcccguaucgaacucugaugucuugucccauuggcgaggucccuuccccauacaacucacguuuugaaagcguggccuggagugcaucugccugccacgacggcauaaacuggcuuacaaucgggauuuccggacccgauaauggugcuguagcaguucugaaguauaacggcaucauaaccgacacgauuaaaagcuggagaaauaacaucuugaggacucaagagucggagugugccugcgugaaugggucuuguuucaccgucaugacagauggaccuuccgacggccaggcuucauacaagaucuuucggauugaaaaagguaagaucgugaaaaguguggagaugaacgccccaaauuaucauuacgaagagugcagcuguuaccccgauuccucugagauuacuugcgucugccgcgacaacuggcacgggagcaauagaccuuggguuucauucaaccagaaucucgaauaucagauaggauacaucuguaguggcauuuuuggcgauaacccaaggccgaaugacaagaccggguccugcggacccgugagcucuaacggugcgaauggcguaaagggguucucauuuaaauauggaaacggcguguggaucggucggacaaagaguaucagcucccgcaacggguucgagaugauuugggauccuaauggcuggaccggaacggacaacaauuuuucuauaaaacaagacaucgucggcauuaacgaauggucgggguacagcggauccuucgugcagcauccagagcugacuggucuggauuguauccgacccugcuucuggguugaacucauuagaggcaggccuaaggagaauacaaucuggaccucagggaguucuaucagcuuuuguggagugaacuccgacacugucggcuggucauggccagauggugcagaguuacccuucacaauagacaaauga

SEQ ID NO: 140980 - RNA, 1410 nt, Artificial Sequence; identical to SEQ ID NO: 138754
  derived and/or modified sequence opt3 from neuraminidase__InfluenzaA__ADJ18166

SEQ ID NO: 140981 - RNA, 1410 nt, Artificial Sequence; identical to SEQ ID NO: 138754
  derived and/or modified sequence opt3 from neuraminidase__InfluenzaA__ADJ18168

SEQ ID NO: 140982 - RNA, 1410 nt, Artificial Sequence; identical to SEQ ID NO: 138754
  derived and/or modified sequence opt3 from neuraminidase__InfluenzaA__ADJ18170

SEQ ID NO: 140983 - RNA, 1410 nt, Artificial Sequence
  derived and/or modified sequence opt3 from neuraminidase__InfluenzaA__ADJ18172
augaaccccaaucagaagaucauuaccauaggcagcgugugcaugacaaucgggauggccaaccugauucucagaaucggaaauauuaucuccauauggaucucucacucaauucaacuugguaaccagaaucagaucgagacuuguaaccagagugucauuacguacgaaaauaacaccuggguuaaucaaacauaugugaacaucagcaauacuaacuucgcugcaggccaguccguagugucugucaaacuggccggaaauucgucauugugcccugugagcgggugggcgauauacaggaaggacaacaguauucggaucggcuccaaaggugauguuuuugugauucgcgagccauucaucucuuguagcccguuagaaugccgaaccuuuuuccugacacagggggcucuacucaaugacaagcauuccaacggaaccaucaaagaucguucacccuauagaacucugaugaguuguccuauuggcgaggucccaagccccuacaacucuagguuugaauccguggccuggucagcaagcgccugccacgacggcauaaauuggcuuacaaucgggauuaguggaccugauaacggugcuguagcaguucugaaguauaauggcaucauaaccgacacgauuaagucuuggcggaacaauaucuugcgcacucaggaguccgagugugccugcgugaacgggagcuguuucaccgucaugacagauggaccaucggacggccaggcuucuuacaaaaucuuuagaauugaaaaggguaaaaucgugaaguccguggagaugaaugcccccaacuaucauuacgaagagugcucauguuacccugauaguagcgagauuacuugcgucugcagggacaauuggcacggguccaaccggccauggguuucuuucaaucaaaaccucgaauaucagauaggauacaucuguagcggcauuuuuggcgauaauccgcgccccaacgacaaaaccgggucaugcggaccugugaguuccaauggugcgaacggcguaaagggguucagcuuuaaguauggaaacggcguguggaucggucgaacaaaaucuaucucaaguagaaauggguucgagaugauuugggauccaaacggcuggaccggaacggacaauaacuuuagcauaaagcaggacaucgucggcauuaaugaaugguccggguacucuggaucguucgugcaacaucccgagcugacuggucuggauuguaucaggccuugcuucuggguugaacucauucggggccguccaaaagagaacacaaucuggaccagcggguccucaauaaguuuuuguggagucaauucugacacugugggcuggagcuggcccgauggugcagaguuaccguucacaaucgacaaguga

SEQ ID NO: 140984 - RNA, 1410 nt, Artificial Sequence; identical to SEQ ID NO: 138754
  derived and/or modified sequence opt3 from neuraminidase__InfluenzaA__ADJ18174

SEQ ID NO: 140985 - RNA, 1410 nt, Artificial Sequence
  derived and/or modified sequence opt3 from neuraminidase__InfluenzaA__ADJ18176
augaaccccaaucagaagaucauuaccauaggcagcgugugcaugacaaucgggauggccaaccugauucuccaaaucggaaauauuaucuccauauggaucucucuuucaauucagcuggguaaccagaaucagaucgagacuuguaaccaaagugucauuacguacgaaaauaacaccuggguuaaucagacauaugugaacaucagcaauacuaacuucgcugcaggccaguccguagugucugucaaauuggccggaaauucgucauuaugcccugugagcggaugggcgauauacaguaaggacaacuccauuagaaucggcucuaaaggugauguuuuugugauuagggagccauucaucagcuguuccccgcuggaaugccggaccuuuuuccuaacacagggggcucuccugaaugacaagcacucaaacggaaccaucaaagaucgcagucccuaucgaacucuuaugagcuguccuauuggcgaggucccaucucccuacaacucccguuuugaaucaguggccuggagcgcaagugccugccaugacggcauaaauuggcugacaaucgggauuucuggaccugauaacggugcuguagcaguuuugaaguauaauggcaucauaaccgacacgauuaaguccuggagaaacaauauccucaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucacuacgaagagugcaguuguuacccugauagcuccgagauuacuugcgucugccgcgacaauuggcaugggucuaacagaccauggguuagcuucaaucagaaccuggaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaccccgagcugacuggucucgauuguauccgaccuugcuucuggguugaauuaauuagaggcaggccaaaagagaacacaaucuggaccuccgggucaaguauaucuuuuuguggagugaauagcgacacugucggcugguccuggcccgauggugcagagcugccguucacaaucgacaaguga

SEQ ID NO: 140986 - RNA, 1410 nt, Artificial Sequence; identical to SEQ ID NO: 138527
  derived and/or modified sequence opt3 from neuraminidase__InfluenzaA__ADJ37250

SEQ ID NO: 140987 - RNA, 1410 nt, Artificial Sequence
  derived and/or modified sequence opt3 from neuraminidase__InfluenzaA__ADJ37252
augaaccccaaucagaagaucauuaccauaggcagcgugucccugacaaucucuacuauuugcuucuuuaugcaaaucgccauucucgucacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaauaacaucguucgagaucguaccccauauagaacacugcuuaugaaugaacugggagugcccuuucacuugggcacuaagcaggucugcauugcuuggagcaguuccucuugucaugacgguaaagccuggcuccacgugugcaucaccggggaugacaagaacgcaacagccagcuucaucuacaauggaaggcugguagauuccguugugucauggaguaaagacauucugcggacccaggagagcgaaugugucugcauaaacggcacguguacuguggugaugacagauggcucugcuuccgggaaggcagacaccaaaauccucuuuauugaggagggaaagaucguccauacuucaacauuaagcgguagugcccaacacguugaagagugcucuugcuauccucgcuacccaggcgugagauguguaugcagggauaacuggaagggguccaaucggccgauaguggacauuaacaucaaagaccacagcaucgucucgucuuacguguguuccggacugguuggcgauacgccccgcaagaaugacucaaguagcuccucucauugccuugauccuaacaaugaagagggugggcacggagugaaaggcugggcuuucgacgauggcaacgacgucuggauggggcgaaccauuagcgaaaagucaagauugggauaugagaccuuuaaagugaucgaggguuggaguaauccaaaguccaaacugcagauuaacaggcagguaauaguugaucggggcaaucguagcggguacucuggaaucuucucaguggaaggcaagaguuguauuaaccgcugcuuuuaugucgagcuaaucagagguaggaaggaagagacagaagugcucuggacuagcaauuccaucgucguguucugugggaccucuggcacauacggaacuggcucguggcccgacggggccaacauuaaucugaugccuauauga

SEQ ID NO: 140988 - RNA, 1410 nt, Artificial Sequence; identical to SEQ ID NO: 138754
  derived and/or modified sequence opt3 from neuraminidase__InfluenzaA__ADJ37263

SEQ ID NO: 140989 - RNA, 1410 nt, Artificial Sequence; identical to SEQ ID NO: 138744
  derived and/or modified sequence opt3 from neuraminidase__InfluenzaA__ADJ37273

SEQ ID NO: 140990 - RNA, 1410 nt, Artificial Sequence; identical to SEQ ID NO: 138754
  derived and/or modified sequence opt3 from neuraminidase__InfluenzaA__ADJ40447

SEQ ID NO: 140991 - RNA, 1410 nt, Artificial Sequence; identical to SEQ ID NO: 138754
  derived and/or modified sequence opt3 from neuraminidase__InfluenzaA__ADJ40457

SEQ ID NO: 140992 - RNA, 1410 nt, Artificial Sequence; identical to SEQ ID NO: 140105
  derived and/or modified sequence opt3 from neuraminidase__InfluenzaA__ADJ40467

SEQ ID NO: 140993 - RNA, 1410 nt, Artificial Sequence
  derived and/or modified sequence opt3 from neuraminidase__InfluenzaA__ADJ40477
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuauuacuacgaagagugcaguuguuauccugauagcuccgagauuacuugcgucugccgcgacaauuggcaugggucuaacagaccauggguuagcuucaaucagaaccucgaauaccagauaggauauaucuguucaggcauuuuuggcgauaauccgaggcccaacgacaaaaccgggaguugcggaccuguguccagcaauggugcgaacggcguaaagggguucucuuuuaaguacggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguauucggggagcuucgugcagcaccccgagcugacuggucuggauuguauccgaccuugcuucuggguugaacucauuagaggcaggccaaaagagaacacaaucuggaccuccgggucaaguauaucuuuuuguggagugaauagcgacacuaugggcugguccuggcccgauggugcagaguuaccguucacaaucgacaaguga

SEQ ID NO: 140994 - RNA, 1410 nt, Artificial Sequence; identical to SEQ ID NO: 138754
  derived and/or modified sequence opt3 from neuraminidase__InfluenzaA__ADJ40487

SEQ ID NO: 140995 - RNA, 1410 nt, Artificial Sequence; identical to SEQ ID NO: 138754
  derived and/or modified sequence opt3 from neuraminidase__InfluenzaA__ADJ40507

SEQ ID NO: 140996 - RNA, 1410 nt, Artificial Sequence; identical to SEQ ID NO: 138754
  derived and/or modified sequence opt3 from neuraminidase__InfluenzaA__ADJ40517

SEQ ID NO: 140997 - RNA, 1410 nt, Artificial Sequence; identical to SEQ ID NO: 138754
  derived and/or modified sequence opt3 from neuraminidase__InfluenzaA__ADJ40527

SEQ ID NO: 140998 - RNA, 1410 nt, Artificial Sequence
  derived and/or modified sequence opt3 from neuraminidase__InfluenzaA__ADJ40537
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccgggguaucugugaaacuggccggaaauucgucauugugcccugucagcggcugggcgauauacaguaaggacaacuccauuagaaucgguucuaaaggggauguguuuguuauuagggagccauucaucagcuguuccccguuagaaugccggaccuuuuuccugacacagggagcucuacucaaugacaagcauucaaacggcaccaucaaagaucgcagucccuaucgaacucugaugagcuguccuauuggcgaggugccaucucccuacaacucccguuuugaaucagucgccuggagcgcaagugccugccacgacgggauaaauuggcuuacaaucggaauuucugguccugauaacggcgcuguggcaguacugaaguauaaugggaucauaaccgacacgauuaaguccuggagaaacaauaucuugaggacucaagagagcgagugugccugcguuaacggaucguguuucaccgugaugacagauggcccaucugacggucaggcuuccuacaaaaucuuucggauugaaaaggggaaaaucgucaagucaguggagaugaaugcccccaacuaucauuacgaagagugcaguuguuacccugauagcuccgagauuacuugcgugugccgcgacaauuggcacggaucuaacagaccaugggucagcuucaaucagaaccucgaauaucagauaggcuacaucuguucaggcauuuuuggggauaauccgaggcccaacgacaaaaccggaaguugcgguccuguuuccagcaauggcgcgaacggggugaagggauucucuuuuaaguauggcaacgguguauggaucgggcggacaaaaucaaucaguagccgcaauggcuucgagaugauuugggauccaaacggauggaccggcacggacaauaacuuuuccauaaagcaagacaucguggggauuaaugaauggucuggauacucggguagcuucguccagcaucccgagcugacuggccuggauuguauccgaccuugcuucuggguggaacucauuagagggaggccaaaagagaacacaaucuggaccuccggaucaaguauaucuuuuuguggcguuaauagcgacacuguggguugguccuggcccgauggggcagaguuaccguucacaaucgacaaguga

SEQ ID NO: 140999 - RNA, 1410 nt, Artificial Sequence
  derived and/or modified sequence opt3 from neuraminidase__InfluenzaA__ADJ40547
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucauuaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaauggguucgagaugauaugggauccaaacggcuggaccggaacggacaauaacuuuuccaucaagcaagacauuaucggcauuaaugaauggucuggguacucggggagcuucgugcagcaucccgagcugacuggucuggauuguauccgaccuugcuucugggucgaacucauaagaggcaggccaaaagagaacacaaucuggaccuccgggucaaguauuucuuuuuguggagugaauagcgacacuguuggcugguccuggcccgauggugcagaguuaccguucacaaucgacaaguga

SEQ ID NO: 141000 - RNA, 1410 nt, Artificial Sequence; identical to SEQ ID NO: 138754
  derived and/or modified sequence opt3 from neuraminidase__InfluenzaA__ADJ40557

SEQ ID NO: 141001 - RNA, 1410 nt, Artificial Sequence; identical to SEQ ID NO: 138754
  derived and/or modified sequence opt3 from neuraminidase__InfluenzaA__ADJ40577

SEQ ID NO: 141002 - RNA, 1410 nt, Artificial Sequence; identical to SEQ ID NO: 138754
  derived and/or modified sequence opt3 from neuraminidase__InfluenzaA__ADJ40587

SEQ ID NO: 141003 - RNA, 1410 nt, Artificial Sequence
  derived and/or modified sequence opt3 from neuraminidase__InfluenzaA__ADJ40597
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuucugauaaagcaagacaucgucggcauuaaugaaugguccggguacucuggaucguucgugcagcaucccgagcugacuggucucgauuguauccgaccuugcuucuggguugaauuaauuagaggcaggccaaaagagaacacaaucuggaccagcggguccucaauaaguuuuuguggagucaauucugacacugugggcuggagcuggcccgauggugcagagcugccguucacaaucgacaaguga

SEQ ID NO: 141004 - RNA, 1410 nt, Artificial Sequence; identical to SEQ ID NO: 138754
  derived and/or modified sequence opt3 from neuraminidase__InfluenzaA__ADJ40607

SEQ ID NO: 141005 - RNA, 1410 nt, Artificial Sequence; identical to SEQ ID NO: 138754
  derived and/or modified sequence opt3 from neuraminidase__InfluenzaA__ADJ40617

SEQ ID NO: 141006 - RNA, 1410 nt, Artificial Sequence; identical to SEQ ID NO: 139108
  derived and/or modified sequence opt3 from neuraminidase__InfluenzaA__ADJ40627

SEQ ID NO: 141007 - RNA, 1410 nt, Artificial Sequence; identical to SEQ ID NO: 138754
  derived and/or modified sequence opt3 from neuraminidase__InfluenzaA__ADJ40637

SEQ ID NO: 141008 - RNA, 1410 nt, Artificial Sequence; identical to SEQ ID NO: 138754
  derived and/or modified sequence opt3 from neuraminidase__InfluenzaA__ADJ40657

SEQ ID NO: 141009 - RNA, 1410 nt, Artificial Sequence; identical to SEQ ID NO: 138754
  derived and/or modified sequence opt3 from neuraminidase__InfluenzaA__ADJ40667

SEQ ID NO: 141010 - RNA, 1410 nt, Artificial Sequence; identical to SEQ ID NO: 138754
  derived and/or modified sequence opt3 from neuraminidase__InfluenzaA__ADJ40677

SEQ ID NO: 141011 - RNA, 1410 nt, Artificial Sequence
  derived and/or modified sequence opt3 from neuraminidase__InfluenzaA__ADJ41819
augaaccccaaucagaagaucauuaccauaggcagcgugucccugacaaucgccacuauuugcuuccucaugcaaaucgcuauucuugucacgaccguuacacugcacuuuaaacaguacgaguguucuucaccuccaaacaaucaggugguaccgugcgaacccaucauaaucgagagaaacauuacugaaaucguguauuugaccaauacaaccauugagaaggaaaucuguccuaaauuagucgaguacaggaacuggaguaagccacagugcaaaauaacuggguucgcacccuuuagcaaggacaauuccauucggcugucugccggaggugauaucugggugacacgcgagccuuauguuucgugugacccaggcaagugcuaccaauucgcgcuagggcagggaaccacgcucgauaacaaacauucaaaugacacuauucacgaucgaacccccuaucguacacugcuuaugaacgaacugggcgugccuuuucauuuggguacuagacaggucuguaucgcuuggagcaguuccucuugccacgacgggaaggccuggcuccauguguguaucaccggauacgauaaaaaugcaacagccagcuucauuuaugacggcaggcugguagauuccauaggcucauggaguaagaacauccugcggacccaggagagcgaaugcguuuguauuaaugggacgugcacuguggucaugacagacggaucugcuuccgagcgcgcagauaccaaaauccucuuuauagaggaagguaagauugugcacaucucaccauuaagcggcagugcccaacacguggaggaaugcucuuguuacccgagauaccccggggucaggugcguuugucgggacaacuggaagggauccaaucgcccugugguagauaucaacgugaaagacuauagcauugucucgucuuacgugugcuccggccugguuggugacacuccacgaaagaacgauagaucaaguagcuccuauuguaggaaucccaacaaugagaaagggaaccauggagugaagggcugggcuuucgacgauggcaaugacgucuggauggggcggacaaucucugaagagagccguucaggauacgagaccuuuaaagugauugguggcuggaguacgccuaacuccaaacuucagauaaaucgccagguaaucguugauagcgggaacagaucuggauauucaggcauuuucaguguggaagguaagagcugcaucaauagguguuuuuacgucgaguugauccgggggcgagaacaggagacccgcgugugguggacauccaacucuauugucguguucugcggcacuucgggaaccuauggcacagggagcuggccagacggagccgauauaaaucugaugcccaucuga

SEQ ID NO: 141012 - RNA, 1410 nt, Artificial Sequence; identical to SEQ ID NO: 138754
  derived and/or modified sequence opt3 from neuraminidase__InfluenzaA__ADJ56642

SEQ ID NO: 141013 - RNA, 1410 nt, Artificial Sequence; identical to SEQ ID NO: 138754
  derived and/or modified sequence opt3 from neuraminidase__InfluenzaA__ADJ56652

SEQ ID NO: 141014 - RNA, 1410 nt, Artificial Sequence; identical to SEQ ID NO: 138754
  derived and/or modified sequence opt3 from neuraminidase__InfluenzaA__ADJ80637

SEQ ID NO: 141015 - RNA, 1410 nt, Artificial Sequence; identical to SEQ ID NO: 139772
  derived and/or modified sequence opt3 from neuraminidase__InfluenzaA__ADJ80647

SEQ ID NO: 141016 - RNA, 1410 nt, Artificial Sequence; identical to SEQ ID NO: 139772
  derived and/or modified sequence opt3 from neuraminidase__InfluenzaA__ADJ80657

SEQ ID NO: 141017 - RNA, 1410 nt, Artificial Sequence; identical to SEQ ID NO: 138754
  derived and/or modified sequence opt3 from neuraminidase__InfluenzaA__ADJ80667

SEQ ID NO: 141018 - RNA, 1410 nt, Artificial Sequence; identical to SEQ ID NO: 140667
  derived and/or modified sequence opt3 from neuraminidase__InfluenzaA__ADJ80677

SEQ ID NO: 141019 - RNA, 1410 nt, Artificial Sequence; identical to SEQ ID NO: 140042
  derived and/or modified sequence opt3 from neuraminidase__InfluenzaA__ADJ80687

SEQ ID NO: 141020 - RNA, 1410 nt, Artificial Sequence
  derived and/or modified sequence opt3 from neuraminidase__InfluenzaA__ADJ80697
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguaauaucugugaaacuggccggaaauucgucauugugcccugucagcggaugggcgauuuacaguaaggacaacuccgugagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 141021 - RNA, 1410 nt, Artificial Sequence
  derived and/or modified sequence opt3 from neuraminidase__InfluenzaA__ADJ80717
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgguuuacaguaaggacaacuccauaagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcagaguuaccguucacaauagacaaguga

SEQ ID NO: 141022 - RNA, 1410 nt, Artificial Sequence
  derived and/or modified sequence opt3 from neuraminidase__InfluenzaA__ADJ80727
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggauggguuauauacaguaaggacaacuccauuagaaucggcucuaaaggugauguguuugucauuagggagccauucaucagcuguuccccguuagaaugccggaccuuuuuccugacacagggggcgcuacucaaugacaagcauucaaacggaaccaucaaagaucgcagucccuaucgaacucugaugagcuguccuauuggcgaggugccaucucccuacaacucccguuuugaaucaguagcuuggagcgccagugcaugccacgacggcauaaauuggcuuacaaucgggauuucuggaccugauaacggugccguugcugugcugaaguauaauggcaucauaaccgacacgauuaaguccuggagaaacaauaucuugaggacucaagagagcgagugugcaugcgucaacgggucguguuucaccgugaugacagauggaccaucugacggccaggccuccuacaaaaucuuucggauugaaaaggguaaaaucgugaagucagucgagaugaaugcucccaacuaucauuacgaagagugcaguuguuacccugauagcuccgagauuacuugcguuugccgcgacaauuggcacgggucuaacagaccaugggugagcuucaaucagaaccucgaauaucagauaggauacaucuguucaggcauuuuuggcgauaauccgaggcccaacgacaaaaccgggaguugcggaccuguauccagcaauggugccaacggcgugaagggguucucuuuuaaguauggaaacggcgucuggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguucagcaucccgagcugacuggucuggauuguauccgaccuugcuucuggguggaacucauuagaggcaggccaaaagagaacacaaucuggaccuccgggucaaguauaucuuuuuguggagucaauagcgacacugugggcugguccuggcccgauggugcggaguuaccguucacaaucgacaaguga

SEQ ID NO: 141023 - RNA, 1410 nt, Artificial Sequence; identical to SEQ ID NO: 139521
  derived and/or modified sequence opt3 from neuraminidase__InfluenzaA__ADJ80737

SEQ ID NO: 141024 - RNA, 1410 nt, Artificial Sequence
  derived and/or modified sequence opt3 from neuraminidase__InfluenzaA__ADJ80747
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggucgagcagcuugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccgucaugacagauggaccauccgacggccaggcuucauacaaaaucuuucggauugaacgcgguaagaucgugaaaaguguggagaugaacgcccccaauuaucauuacgaagagugcagcuguuacccugauuccucugagauuacuugcgucugcagagacaacuggcacgggagcaauaggccauggguuucauucaaccagaaucucgaauaucagauaggauacaucuguaguggcauuuuuggcgauaacccgcggcccaaugacaagaaaggguccugcggaccugugagcucuaacggugcgaauggcguaaagggguucucauuuaaguauggaaacggcguguggaucggucgcaccaaaaguaucagcucccgaaacggguucgagaugauuugggauccaaauggcuggacaggaaccgacaacaauuuuucuauaaagcaagacaucgucgaaauuaacgaguggucgggcuacagcggguccuucgugcagcaucccgaacugacgggacuggauuguaucagaccuugcuucuggguugagcucauuaggggucggccaaaagagaauacuaucuggacaucaggcaguucuauaucauuuuguggggugaacuccgacaccgucggauggucauggcccgauggcgcagaauuaccguucacuaucgacaaguga

SEQ ID NO: 141025 - RNA, 1410 nt, Artificial Sequence; identical to SEQ ID NO: 138754
  derived and/or modified sequence opt3 from neuraminidase__InfluenzaA__ADJ80757

SEQ ID NO: 141026 - RNA, 1410 nt, Artificial Sequence; identical to SEQ ID NO: 138754
  derived and/or modified sequence opt3 from neuraminidase__InfluenzaA__ADJ80767

SEQ ID NO: 141027 - RNA, 1410 nt, Artificial Sequence; identical to SEQ ID NO: 139337
  derived and/or modified sequence opt3 from neuraminidase__InfluenzaA__ADJ80777

SEQ ID NO: 141028 - RNA, 1410 nt, Artificial Sequence; identical to SEQ ID NO: 138754
  derived and/or modified sequence opt3 from neuraminidase__InfluenzaA__ADJ80787

SEQ ID NO: 141029 - RNA, 1410 nt, Artificial Sequence
  derived and/or modified sequence opt3 from neuraminidase__InfluenzaA__ADJ80797
augaaccccaaucagaagaucauuaccauaggcagcgugugcaugacaaucgggauggccaaccugauucuccaaaucggaaauauuaucuccauauggaucucucacucaauucagcuugguaacaaaaaucagaucgagacuuguaaccagagugucauuacguacgaaaauaacaccuggguuaaucaaacauaugugaacaucagcaauacuaacuucgcugcaggccaguccguagugucugucaagcuggccggaaauucgucauugugcccugugagcggaugggcgauauacaguaaagacaacuccauuagaaucggcucuaagggugauguuuuugugauuagggagccauucaucagcuguuccccguuagaaugccggaccuuuuuccugacacagggggcucuacucaaugacaaacauucaaacggaaccaucaaggaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaauccuggagaaacaauaucuugaggacucaggagagcgagugugccugcgugaacgggucguguuucaccgucaugacagauggaccaucugacggccaggcuuccuacaagaucuuucggauugaaaaagguaagaucgugaaaucaguggagaugaaugcccccaacuaucauuacgaagagugcaguuguuacccugauagcuccgagauuacuugcgucugccgcgacaauuggcacgggucuaacagaccauggguuagcuucaaucaaaaccucgaauaucagauaggauacaucuguucaggcauuuuuggcgauaauccgaggcccaacgacaagaaggggaguugcggaccuguguccagcaauggugcgaacggcguaaaaggguucucuuuuaaguauggaaacggcguguggaucggucggaccaaaucaaucaguagccgcaauggguucgagaugauuugggauccaaacggcuggacaggaaccgacaauaacuuuuccauaaagcaggacaucgucggcauuaaugaauggucuggguacucggggagcuucgugcaacaucccgagcugacgggucuggauuguauccgaccuugcuucuggguugaacucauuagaggcaggccaaaagagaacacuaucuggacauccgggucaaguauaucuuuuuguggagugaauagcgacaccgucggcugguccuggcccgauggugcagaguuaccguucacuaucgacaaguga

SEQ ID NO: 141030 - RNA, 1410 nt, Artificial Sequence; identical to SEQ ID NO: 139772
  derived and/or modified sequence opt3 from neuraminidase__InfluenzaA__ADJ80807

SEQ ID NO: 141031 - RNA, 1410 nt, Artificial Sequence; identical to SEQ ID NO: 138754
  derived and/or modified sequence opt3 from neuraminidase__InfluenzaA__ADJ80817

SEQ ID NO: 141032 - RNA, 1410 nt, Artificial Sequence; identical to SEQ ID NO: 138754
  derived and/or modified sequence opt3 from neuraminidase__InfluenzaA__ADJ80827

SEQ ID NO: 141033 - RNA, 1410 nt, Artificial Sequence; identical to SEQ ID NO: 140267
  derived and/or modified sequence opt3 from neuraminidase__InfluenzaA__ADJ80837

SEQ ID NO: 141034 - RNA, 1410 nt, Artificial Sequence; identical to SEQ ID NO: 140765
  derived and/or modified sequence opt3 from neuraminidase__InfluenzaA__ADJ80851

SEQ ID NO: 141035 - RNA, 1410 nt, Artificial Sequence
  derived and/or modified sequence opt3 from neuraminidase__InfluenzaA__ADJ80861
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccccaaauggugcgaacggcguaaagggguucagcuuuaaguauggaaacggcguguggaucggucggacaaaaucuaucucaagucgcaauggguucgagaugauuugggaucccaacggcuggaccggaacggacaauaacuuuagcauaaagcaagacaucgucggcauuaaugaaugguccggguacucuggaucguucgugcagcauccugagcugacuggucuggauuguauccgaccaugcuucuggguugaacucauuagaggcaggcccaaagagaacacaaucuggaccagcggguccucaauaaguuuuuguggagucaauucugacacugugggcuggagcuggccggauggugcagaguuaccuuucacaaucgacaaguga

SEQ ID NO: 141036 - RNA, 1410 nt, Artificial Sequence; identical to SEQ ID NO: 141029
  derived and/or modified sequence opt3 from neuraminidase__InfluenzaA__ADJ80871

SEQ ID NO: 141037 - RNA, 1410 nt, Artificial Sequence; identical to SEQ ID NO: 138754
  derived and/or modified sequence opt3 from neuraminidase__InfluenzaA__ADJ80886

SEQ ID NO: 141038 - RNA, 1410 nt, Artificial Sequence
  derived and/or modified sequence opt3 from neuraminidase__InfluenzaA__ADJ80896
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaaguauuaucacguacgaaaauaacaccugggucaaucagacauauguuaacauaagcaauacuaacuucgcugcaggccaguccgugguaucugugaaacugaccggaaauucgucauugugcccugucagcggaugggccauuuacaguaaggacaacuccaucagaauuggcucuaaaggugauguguuuguuaucagggagccauucaucagcuguuccccguuagaaugccggacauuuuuccugacccagggggcgcuacucaaugacaagcauucaaacggaacuauuaaagaucgcagucccuaucgaacacugaugagcuguccuauaggcgaggugccaucucccuacaacucccguuuugaaucagucgcuuggagcgccagugcaugccacgacggcaucaauuggcuuaccauugggaucucuggaccugauaacggugccguggcuguacugaaguauaauggcauaauuacggacacuaucaaguccuggagaaacaauaucuugaggacccaagagagcgagugugcaugcguuaacgggucguguuucacagugaugacugauggaccaucugacggccaggccuccuacaaaauuuuucggaucgaaaaggguaaaauugucaagucaguggagaugaaugcucccaacuaucauuacgaagagugcaguuguuacccugauagcuccgagauaaccugcgugugccgcgacaauuggcacgggucuaacagaccaugggucagcuucaaucagaaccucgaauaucagaucggauacauuuguucaggcaucuuuggcgauaauccgaggcccaacgacaaaacagggaguugcggaccuguuuccagcaauggugccaacggcgugaagggguucucuuuuaaguauggaaacggcguauggaucggucggaccaaaucaauuaguagccgcaauggguucgagaugauaugggauccaaacggcuggacgggaacugacaauaacuuuuccaucaagcaagacauugugggcaucaaugaauggucuggguacucggggagcuucguccagcaucccgagcugacaggucuggauuguauucgaccuugcuucuggguggaacucaucagaggcaggccaaaagagaacaccauauggacuuccgggucaaguaucucuuuuuguggaguuaauagcgacacagugggcugguccuggcccgauggugcggaguuaccguucaccauugacaaguga

SEQ ID NO: 141039 - RNA, 1410 nt, Artificial Sequence
  derived and/or modified sequence opt3 from neuraminidase__InfluenzaA__ADJ80913
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggucgucaucauugugcccugugaguggaugggcgauauacuccaaggacaauucuauuagaaucggcagcaaaggugauguuuuugugauuagggagccauucaucuccuguucaccguuagaaugccggaccuuuuuccugacacagggggcucuacucaacgacaagcauaguaauggaaccaucaaagaucgcagccccuaucgaacucugaugucuuguccuauuggcgaggucccaucccccuacaacucacguuuugaaagcguggccuggagugcaucugccugccacgacggcauaaacuggcuuacaaucgggauuuccggaccugauaauggugcuguagcaguucugaaguauaacggcaucauaaccgacacgauuaagagcuggagaaauaacaucuugaggacucaagagucggagugugccugcgugaaugggucuuguuucaccgucaugacagauggaccauccgacggccaggcuucauacaaaaucuuucggauugaaaaggguaaaaucgugaagaguguggagaugaacgcccccaauuaucauuacgaagagugcagcuguuacccugauuccucugagauuacuugcgucugccgcgacaacuggcacgggagcaauagaccauggguuucauucaaccagaaucucgaauaucagauaggauacaucuguaguggcauuuuuggcgauaacccgaggcccaaugacaaaaagggguccugcggaccugugagcucuaacggugcgaauggcguaaagggguucucauuuaaauauggaaacggcguguggaucggucggaccaagaguaucagcucccgcucuggguucgagaugauuugggauccaaacggcuggacaggaaccgacaauaacuuuucgauaaaacaagacaucgucggcauuaaugaauggagcggguacuccggaucauucgugcagcaucccgagcugacgggucuggauuguauccgaccuugcuucuggguugaacucauuagaggcaggccaaaggagaacacuaucuggacaagugggucuagcauauccuuuuguggagugaauagcgacaccgucggcuggagcuggcccgauggugcagaguuaccguucacuaucgacaaauga

SEQ ID NO: 141040 - RNA, 1410 nt, Artificial Sequence; identical to SEQ ID NO: 138754
  derived and/or modified sequence opt3 from neuraminidase__InfluenzaA__ADJ80930

SEQ ID NO: 141041 - RNA, 1410 nt, Artificial Sequence; identical to SEQ ID NO: 138754
  derived and/or modified sequence opt3 from neuraminidase__InfluenzaA__ADJ80950

SEQ ID NO: 141042 - RNA, 1410 nt, Artificial Sequence; identical to SEQ ID NO: 140042
  derived and/or modified sequence opt3 from neuraminidase__InfluenzaA__ADJ80960

SEQ ID NO: 141043 - RNA, 1410 nt, Artificial Sequence; identical to SEQ ID NO: 141029
  derived and/or modified sequence opt3 from neuraminidase__InfluenzaA__ADJ80970

SEQ ID NO: 141044 - RNA, 1410 nt, Artificial Sequence; identical to SEQ ID NO: 138754
  derived and/or modified sequence opt3 from neuraminidase__InfluenzaA__ADJ80980

SEQ ID NO: 141045 - RNA, 1410 nt, Artificial Sequence; identical to SEQ ID NO: 141029
  derived and/or modified sequence opt3 from neuraminidase__InfluenzaA__ADJ80996

SEQ ID NO: 141046 - RNA, 1410 nt, Artificial Sequence
  derived and/or modified sequence opt3 from neuraminidase__InfluenzaA__ADJ81006
augaaccccaaucagaagaucauuaccauaggcagcgugugcaugacaaucgggauggccaaccugauucuccaagucggaaauaucauuuccaucuggauaucucacucaauccagcuugguaaccagaaucagauugagacuuguaaccaaaguaucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaccaguagccgcaauggguucgagaugaucugggauccaaacggcuggacgggaacugacaauaacuuuuccauuaagcaagacauagucggcaucaaugaauggucuggguacucggggagcuucgugcagcaucccgagcugacaggucuggauuguauucgaccuugcuucuggguugaacucaucagaggcaggccaaaagagaacaccauuuggacuuccgggucaaguaucucuuuuuguggagugaauagcgacacagucggcugguccuggcccgauggugcagaguuaccguucaccauagacaaguga

SEQ ID NO: 141047 - RNA, 1410 nt, Artificial Sequence; identical to SEQ ID NO: 140765
  derived and/or modified sequence opt3 from neuraminidase__InfluenzaA__ADJ81016

SEQ ID NO: 141048 - RNA, 1410 nt, Artificial Sequence; identical to SEQ ID NO: 140954
  derived and/or modified sequence opt3 from neuraminidase__InfluenzaA__ADJ81026

SEQ ID NO: 141049 - RNA, 1410 nt, Artificial Sequence; identical to SEQ ID NO: 138754
  derived and/or modified sequence opt3 from neuraminidase__InfluenzaA__ADJ81036

SEQ ID NO: 141050 - RNA, 1410 nt, Artificial Sequence
  derived and/or modified sequence opt3 from neuraminidase__InfluenzaA__ADJ81046
augaaccccaaucagaagaucauuaccauaggcagcgugugcaugacagucgggauggccaaccugauccuccaaauuggaaauaucauuuccaucuggauaucucacucaauccagcuugguaaccagaaucagauugagacuuguaaccaaaguguuaucacguacgaaaauaacaccugggugaaucagacauauguaaacauuagcaauacuaacuucgcugcaggccaguccguggucucugugaaacuggccggaaauucgucauugugcccuguuagcgggugggcgaucuacaguaaggacaacuccauaagaauuggcucuaaaggugauguguuugucaucagggagccauucauuagcuguuccccguuagaaugccggaccuuuuuccugacacagggggcucuacucaaugacaagcauucaaacggaaccaucaaagaucgcagucccuaucgaacucugaugagcuguccuaucggcgaggugccaucucccuacaacucccguuuugaaucaguagccuggagcgcaagugccugccacgacggcauuaauuggcuuacaauagggaucucuggaccugauaacggugcuguugcagugcugaaguauaauggcauuaucaccgacacgauaaaguccuggagaaacaauauuuugaggacucaagagagcgagugugccugcgucaacgggucguguuucaccgugaugacagauggaccaucugacggccaggcuuccuacaaaaucuuucggaucgaaaaggguaaaauugugaagucagucgagaugaaugcccccaacuaucauuacgaagagugcaguuguuacccugauagcuccgagaucacuugcguuugccgcgacaauuggcacgggucuaacagaccaugggugagcuucaaucagaaccucgaauaucagauuggauacauauguucaggcaucuuuggcgauaauccgaggcccaacgacaaaaccgggaguugcggaccuguauccagcaauggugcgaacggcgugaagggguucucuuuuaaguauggaaacggcgucuggauuggucggacaaaaucaaucaauagucgcaacggguucgagaugaucugggauccaaauggcuggaccggaacggacaacaauuuuagcauuaagcaagacauagugggcacuaacgaaugguccggguacucuggaucguucguucagcaucccgagcugacaggucuggauuguauccgaccuugcuucuggguggaacucauuagaggcaggccaaaagagaauaccaucuggacuagcggguccucaauuaguuuuuguggagucaacucugacacagugggcuggagcuggcccgauggugcagaguuaccguucaccaucgacaaguga

SEQ ID NO: 141051 - RNA, 1410 nt, Artificial Sequence
  derived and/or modified sequence opt3 from neuraminidase__InfluenzaA__ADJ81056
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugccugucaaacuggccgggucuucgucauugugcccagugagcggaugggcgauauacaguaaggacaauuccauuagaaucggcucuaaaggugauguuuuugugauuagggagccguucaucagcuguucccccuuagaaugccggaccuuuuuccugacacagggggcucuacucaacgacaagcauucaaauggaaccaucaaagaucgcaguccuuaucgaacucugaugagcuguccaauuggcgagguccccucuccuuacaacucccguuuugaaucaguggccuggagcgcaagugccugccacgacggcauaaacuggcuuacaaucgggauuucuggaccagauaauggugcuguagcaguucugaaguauaacggcaucauaaccgacacgauuaaguccuggagaaauaacaucuugaggacucaagagagcgagugugccugcgugaaugggucguguuucaccgucaugacagauggacccucugacggccaggcuuccuacaaaaucuuucggauugaaaaggguaaaaucgugaagucaguggagaugaacgccccuaauuaucauuacgaagagugcaguuguuacccagauagcuccgagauuacuugcgucugccgcgacaacuggcacgggucuaauagaccguggguuagcuucaaccagaaucucgaauaucagauaggauacaucuguucaggcauuuuuggcgauaaccccaggccuaaugacaaaaaggggaguugcggaccaguguccagcaacggugcgaauggcguaaagggguucucuuuuaaauauggaaacggcguguggaucggucggaccaagucaaucaacagucgcaauggguucgagaugauuugggaucccaacggcuggacaggaaccgacaauaacuuuagcauaaaacaagacaucgucggcauuaaugaaugguccggguacucuggaucguucgugcagcauccugagcugacgggucuggauuguauccgaccaugcuucuggguugaacucauuagaggcaggcccaaggagaacacuaucuggacaagcggguccucaauaaguuuuuguggagucaauucugacaccgugggcuggagcuggccggauggugcagaguuaccuuucacuaucgacaaauga

SEQ ID NO: 141052 - RNA, 1410 nt, Artificial Sequence; identical to SEQ ID NO: 140042
  derived and/or modified sequence opt3 from neuraminidase__InfluenzaA__ADJ81066

SEQ ID NO: 141053 - RNA, 1410 nt, Artificial Sequence; identical to SEQ ID NO: 138615
  derived and/or modified sequence opt3 from neuraminidase__InfluenzaA__ADJ84775

SEQ ID NO: 141054 - RNA, 1410 nt, Artificial Sequence
  derived and/or modified sequence opt3 from neuraminidase__InfluenzaA__ADJ88785
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcguggucucgucuuacguguguuccggacugguuggcgacacgccccgcaagaaugauucaaguagcuccucucauugccuugacccuaacaaugaggaaggugggcacggagugaaaggcugggcuuucgaugacggcaacgaugucuggauggggcgaaccaucagcgagaagucaagauugggauaugagacauuuaaagugauugaagguuggaguaaucauaaguccaaacugcagaucaacaggcagguaauuguugaccggggcaaucguagcggguacucuggaauauucucaguggagggcaagaguuguaucaaccgcugcuuuuaugucgaacuaauuagagguaggaaggaggaaacugaggugcucuggaccagcaauuccaucgucguguucugugggacaucuggcacuuacggaaccggcucguggccagauggggccgaccugaaccuuaugcccaucuga

SEQ ID NO: 141055 - RNA, 1410 nt, Artificial Sequence; identical to SEQ ID NO: 138754
  derived and/or modified sequence opt3 from neuraminidase__InfluenzaA__ADK21716

SEQ ID NO: 141056 - RNA, 1410 nt, Artificial Sequence; identical to SEQ ID NO: 138754
  derived and/or modified sequence opt3 from neuraminidase__InfluenzaA__ADK21726

SEQ ID NO: 141057 - RNA, 1410 nt, Artificial Sequence; identical to SEQ ID NO: 138754
  derived and/or modified sequence opt3 from neuraminidase__InfluenzaA__ADK21736

SEQ ID NO: 141058 - RNA, 1410 nt, Artificial Sequence
  derived and/or modified sequence opt3 from neuraminidase__InfluenzaA__ADK21746
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaaguauuaucacguacgaacauaauaccugggucaaccagacauauguuaauauaagcaacacuaauuucgcugcaggccaguccgugguaucugugaaacuggccgggaacucgucauugugcccugucagcggaugggcgauuuacaguaaggacaauuccaucagaauuggcucuaaaggugauguguuuguuaucagggagccauucaucagcuguuccccguuagaaugccggaccuuuuuccugacacagggggcucuacucaacgacaagcacucaaauggaaccauuaaagaucgcagucccuaucgaacucugaugagcuguccuauaggcgaggugccaucucccuacaacucccguuuugaaucagucgccuggagcgcaagugccugccaugacggcaucaacuggcuuacaauugggaucucuggaccugauaauggugcuguggcaguacugaaguauaacggcauaauuaccgacacgaucaaguccuggagaaauaacaucuugaggacucaagagagcgagugugccugcguuaaugggucguguuucaccgugaugacagauggaccaucugacggccaggcuuccuacaaaauuuuucggaucgaaaaggguaaaauugucaagucaguggagaugaacgcccccaauuaucacuacgaagagugcaguuguuacccugauagcuccgagauaacuugcgugugccgcgacaacuggcaugggucuaauagaccaugggucagcuucaaccagaaucucgaauaucagaucggauacauuuguucaggcaucuuuggcgauaacccgaggcccaaugacaaaaccgggaguugcggaccuguuuccagcaacggugcgaauggcgugaagggguucucuuuuaaguauggaaacggcguauggaucggucggacaaaaucaauuaguagccgcuccggguucgagaugauaugggauccaaacggcuggaccggaacggacaauaacuuuucuaucaagcaagacauugugggcaucaaugaauggucgggguacagcggauccuucguccagcaccccgagcugacuggucuggauuguauucgaccuugcuucuggguggaacucaucagaggcaggccagaggagaacacaauauggaccucagggaguucuaucagcuuuuguggaguuaauuccgacacugugggcuggucauggcccgauggugcagaauuaccguucacaauugacaaauga

SEQ ID NO: 141059 - RNA, 1410 nt, Artificial Sequence; identical to SEQ ID NO: 138754
  derived and/or modified sequence opt3 from neuraminidase__InfluenzaA__ADK21756

SEQ ID NO: 141060 - RNA, 1410 nt, Artificial Sequence; identical to SEQ ID NO: 138754
  derived and/or modified sequence opt3 from neuraminidase__InfluenzaA__ADK21766

SEQ ID NO: 141061 - RNA, 1410 nt, Artificial Sequence; identical to SEQ ID NO: 140185
  derived and/or modified sequence opt3 from neuraminidase__InfluenzaA__ADK21776

SEQ ID NO: 141062 - RNA, 1410 nt, Artificial Sequence; identical to SEQ ID NO: 138754
  derived and/or modified sequence opt3 from neuraminidase__InfluenzaA__ADK21786

SEQ ID NO: 141063 - RNA, 1410 nt, Artificial Sequence; identical to SEQ ID NO: 138754
  derived and/or modified sequence opt3 from neuraminidase__InfluenzaA__ADK21796

SEQ ID NO: 141064 - RNA, 1410 nt, Artificial Sequence; identical to SEQ ID NO: 138754
  derived and/or modified sequence opt3 from neuraminidase__InfluenzaA__ADK21806

SEQ ID NO: 141065 - RNA, 1410 nt, Artificial Sequence; identical to SEQ ID NO: 138754
  derived and/or modified sequence opt3 from neuraminidase__InfluenzaA__ADK21816

SEQ ID NO: 141066 - RNA, 1410 nt, Artificial Sequence; identical to SEQ ID NO: 140732
  derived and/or modified sequence opt3 from neuraminidase__InfluenzaA__ADK21826

SEQ ID NO: 141067 - RNA, 1410 nt, Artificial Sequence; identical to SEQ ID NO: 140645
  derived and/or modified sequence opt3 from neuraminidase__InfluenzaA__ADK21836

SEQ ID NO: 141068 - RNA, 1410 nt, Artificial Sequence
  derived and/or modified sequence opt3 from neuraminidase__InfluenzaA__ADK21846
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccaugaagcaagacauagucggcaucaaugaauggucuggguacucggggagcuucgugcagcaucccgagcugacuggucuggauuguauucgaccuugcuucuggguugaacucaucagaggcaggccaaaagagaacacaauuugggcauccgggucaaguaucucuuuuuguggagugaauagcgacaccgucggcugguccuggcccgauggugccgaguuaccguucacuauagacaaguga

SEQ ID NO: 141069 - RNA, 1410 nt, Artificial Sequence; identical to SEQ ID NO: 138754
  derived and/or modified sequence opt3 from neuraminidase__InfluenzaA__ADK21856

SEQ ID NO: 141070 - RNA, 1410 nt, Artificial Sequence; identical to SEQ ID NO: 138754
  derived and/or modified sequence opt3 from neuraminidase__InfluenzaA__ADK21866

SEQ ID NO: 141071 - RNA, 1410 nt, Artificial Sequence; identical to SEQ ID NO: 138754
  derived and/or modified sequence opt3 from neuraminidase__InfluenzaA__ADK21876

SEQ ID NO: 141072 - RNA, 1410 nt, Artificial Sequence; identical to SEQ ID NO: 138754
  derived and/or modified sequence opt3 from neuraminidase__InfluenzaA__ADK21886

SEQ ID NO: 141073 - RNA, 1410 nt, Artificial Sequence
  derived and/or modified sequence opt3 from neuraminidase__InfluenzaA__ADK21896
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcacuaaugaauggucuggguacucggggagcuucgugcagcaucccgagcugacaggucuggauuguauucgaccuugcuucuggguugaacucaucagaggcaggccaaaagagaacaccauuuggacuuccgggucaaguaucucuuuuuguggagugagcuccgacacagucggcuggucauggcccgauggugcagaguuaccguucaccauagacaaguga

SEQ ID NO: 141074 - RNA, 1410 nt, Artificial Sequence
  derived and/or modified sequence opt3 from neuraminidase__InfluenzaA__ADK21906
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggauaucguucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauugggagucgcaauggcuucgagaugauaugggauccaaacggauggaccggcacggacaauaacuuuagcaucaagcaagacauuguggggaucaaugaaugguccggauacucugguucguucguccagcaucccgagcugacuggccuggauuguauucgaccuugcuucuggguggaacucaucagagggaggccaaaagagaacacaauauggaccagcggauccucaaucaguuuuuguggcguuaauucugacacuguggguuggagcuggcccgauggggcagaguuaccguucacaauugacaaguga

SEQ ID NO: 141075 - RNA, 1410 nt, Artificial Sequence; identical to SEQ ID NO: 138754
  derived and/or modified sequence opt3 from neuraminidase__InfluenzaA__ADK21916

SEQ ID NO: 141076 - RNA, 1410 nt, Artificial Sequence; identical to SEQ ID NO: 138754
  derived and/or modified sequence opt3 from neuraminidase__InfluenzaA__ADK21926

SEQ ID NO: 141077 - RNA, 1410 nt, Artificial Sequence; identical to SEQ ID NO: 138754
  derived and/or modified sequence opt3 from neuraminidase__InfluenzaA__ADK21936

SEQ ID NO: 141078 - RNA, 1410 nt, Artificial Sequence
  derived and/or modified sequence opt3 from neuraminidase__InfluenzaA__ADK21946
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacugguauggauuguauccgaccuugcuucuggguugaacugauuagaggcaggccaaaagagaacacaaucuggaccuccgggucaaguauaucuuuuuguggagugaauagcgacacugucggcugguccuggcccgauggugcagagcucccguucacaaucgacaaguga

SEQ ID NO: 141079 - RNA, 1410 nt, Artificial Sequence
  derived and/or modified sequence opt3 from neuraminidase__InfluenzaA__ADK21956
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuuaagauugaaaaagguaagaucgugaaaucaguggagaugaaugcccccaacuaucauuacgaagagugcaguuguuacccugauagcuccgagauuacuugcgucugccgggacaauuggcacgggucuaaccgcccauggguuagcuucaaucagaaccucgaauaucagauaggauacaucuguucaggcauuuuuggcgauaauccgagacccaacgacaagaccgggaguugcggaccuguguccagcaauggugcgaacggcguaaagggguucucuuuuaaauauggaaacggcguguggaucgguaggacaaagucaaucaguagccggaauggguucgagaugauuugggauccaaacggcuggaccggaacggacaauaacuuuuccauaaaacaagacaucgucggcauuaaugaauggucuggguacucggggagcuucgugcagcaucccgagcugacuggucuggauuguauccgcccuugcuucuggguugaacucauucgaggcagaccaaaggagaacacaaucuggaccuccgggucaaguauaucuuuuuguggagugaauagcaacacugucggcugguccuggcccgacggugcagaguuaccguucacaaucgauaaauga

SEQ ID NO: 141080 - RNA, 1410 nt, Artificial Sequence; identical to SEQ ID NO: 138754
  derived and/or modified sequence opt3 from neuraminidase__InfluenzaA__ADK32393

SEQ ID NO: 141081 - RNA, 1410 nt, Artificial Sequence; identical to SEQ ID NO: 138754
  derived and/or modified sequence opt3 from neuraminidase__InfluenzaA__ADK32403

SEQ ID NO: 141082 - RNA, 1410 nt, Artificial Sequence; identical to SEQ ID NO: 138754
  derived and/or modified sequence opt3 from neuraminidase__InfluenzaA__ADK32413

SEQ ID NO: 141083 - RNA, 1410 nt, Artificial Sequence
  derived and/or modified sequence opt3 from neuraminidase__InfluenzaA__ADK32423
augaaccccaaucagaagaucauuaccauaggcagcgugugcaugacaaucgggaugacuaaccugauucuccaaaucggaaauauuaucuccauauggaucucucacucaauucagcuugguaaccagaaucagaucgagacguguaaccaaagugucauuaccuacgaaaauaacacauggguuaaucagacuuaugugaacaucagcaauaccaacuucgccgcuggccaguccguagugucugucaaacuggcaggaaauucgucauugugcccugugagcggaugggccauauacaguaaggacaacuccauuagaaucggcucuaaaggugauguuuuugugauuagggagccauucaucagcuguuccccguuagaaugccggacauuuuuccugacccagggggcgcuacucaaugacaagcauucaaacggaacuaucaaagaucgcagucccuaucgaacacugaugagcuguccuauuggcgaggucccaucucccuacaacucccguuuugaaucaguggcuuggagcgccagugcaugccacgacggcauaaauuggcuuaccaucgggauuucuggaccugauaacggugccguagcuguucugaaguauaauggcaucauaacggacacuauuaaguccuggagaaacaauaucuugaggacccaagagagcgagugugcaugcgugaacgggucguguuucacagucaugacugauggaccaucugacggccaggccuccuacaaaaucuuucggauugaaaaggguaaaaucgugaagucaguggagaugaaugcucccaacuaucauuacgaagagugcaguuguuacccugauagcuccgagauuaccugcgucugccgcgacaauuggcacgggucuaacagaccauggguuagcuucaaucagaaccucgaauaucagauaggauacaucuguucaggcauuuuuggcgauaauccgaggcccaacgacaaaacagggaguugcggaccuguguccagcaauggugccaacggcguaaagggguucucuuuuaaguauggaaacggcguguggaucggucggaccaaaucaaucaguagccgcaauggguucgagaugauuugggauccaaacggcuggacgggaacugacaauaacuuuuccauaaagcaagacaucgucggcauuaaugaauggucuggguacucggggagcuucgugcagcaucccgagcugacaggucuggauuguauccgaccuugcuucuggguugaacucauuagaggcaggccaaaagagaacaccaucuggacuuccgggucaaguauaucuuuuuguggagugaauagcgacacagucggcugguccuggcccgauggugcggaguuaccguucaccaucgacaaguga

SEQ ID NO: 141084 - RNA, 1410 nt, Artificial Sequence; identical to SEQ ID NO: 138754
  derived and/or modified sequence opt3 from neuraminidase__InfluenzaA__ADK32433

SEQ ID NO: 141085 - RNA, 1410 nt, Artificial Sequence; identical to SEQ ID NO: 138754
  derived and/or modified sequence opt3 from neuraminidase__InfluenzaA__ADK32443

SEQ ID NO: 141086 - RNA, 1410 nt, Artificial Sequence
  derived and/or modified sequence opt3 from neuraminidase__InfluenzaA__ADK32453
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacugucggggaauagcucauugugcccugugaguggaugggccauauacuccaaggacaacucuguuagaauuggcagcaaaggugauguguuugucaucagggagccauucauuuccuguucaccguuagaaugccggaccuuuuuccugacacagggggcgcuacucaaugacaagcauaguaacggaaccaucaaagaucgcagccccuaucgaacucugaugucuuguccuaucggcgaggugccaucccccuacaacucacguuuugaaagcguagcuuggagugccucugcaugccacgacggcauuaauuggcuuacaauagggaucuccggaccugauaacggugccguugcugugcugaaguauaauggcauuaucaccgacacgauaaagagcuggagaaacaauauuuugaggacucaagagucggagugugcaugcgucaacgggucuuguuucaccgugaugacagauggaccauccgacggccaggccucauacaaaaucuuucggaucgaaaaggguaaaauugugaagagugucgagaugaaugcucccaacuaucauuacgaagagugcagcuguuacccugauuccucugagaucacuugcguuugccgcgacaauuggcacgggagcaacagaccaugggugucauucaaucagaaccucgaauaucagauuggauacauauguaguggcaucuuuggcgauaauccgaggcccaacgacaaaaccggguccugcggaccuguaagcucuaauggugccaacggcgugaagggguucucauuuaaguauggaaacggcgucuggauuggucggacaaaaaguaucagcucccgcaauggguucgagaugaucugggauccaaacggcuggaccggaacggacaauaacuuuucuauuaagcaagacauagugggcaucaaugaauggucgggguacagcggauccuucguucagcaucccgagcugacuggucuggauuguauucgaccuugcuucuggguggaacucaucagaggcaggccaaaagagaacacaauuuggaccucagggaguucuaucagcuuuuguggagucaauuccgacacugugggcuggucauggcccgauggugcggaguuaccguucacaauagacaaguga

SEQ ID NO: 141087 - RNA, 1410 nt, Artificial Sequence
  derived and/or modified sequence opt3 from neuraminidase__InfluenzaA__ADK32463
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuaaucaaugacaagcauucaaacggaaccauuaaagaucgcagucccuaucgaacucucaugagcuguccuauaggcgaggucccaucucccuacaacucccguuuugaaucaguggccuggagcgcaagugccugccacgacggcaucaauuggcugacaauugggaucucuggaccugauaacggugcuguagcaguucuuaaguauaauggcauaauuaccgacacgaucaaguccuggagaaacaauauccugaggacucaagagagcgagugugccugcgugaacgggucguguuucaccgucaugacagauggaccaucugacggccaggcuuccuacaaaauuuuucggaucgaaaaggguaaaauugugaagucaguggagaugaaugcccccaacuaucauuacgaagagugcaguuguuacccugauagcuccgagauaacuugcgucugccgcgacaauuggcacgggucuaacagaccauggguuagcuucaaucagaacuuggaauaucagaucggauacauuuguucaggcaucuuuggcgauaauccgaggcccaacgacaaaaccgggaguugcggaccuguguccagcaauggugcgaacggcguaaagggguucucuuuuaaguauggaaacggcguguggaucggucggacaaaaucaauuaguagccgcaauggguucgagaugauaugggauccaaacggcuggaccggaacggacaauaacuuuuccaucaagcaagacauugucggcaucaaugaauggucuggguacucggggagcuucgugcagcaucccgagcucacuggucuggauuguauucgaccuugcuucuggguugaacugaucagaggcaggccaaaagagaacacaauauggaccuccgggucaaguaucucuuuuuguggagugaauagcgacacugucggcugguccuggcccgauggugcagagcucccguucacaauugacaaguga

SEQ ID NO: 141088 - RNA, 1410 nt, Artificial Sequence; identical to SEQ ID NO: 138754
  derived and/or modified sequence opt3 from neuraminidase__InfluenzaA__ADK32473

SEQ ID NO: 141089 - RNA, 1410 nt, Artificial Sequence; identical to SEQ ID NO: 138754
  derived and/or modified sequence opt3 from neuraminidase__InfluenzaA__ADK32483

SEQ ID NO: 141090 - RNA, 1410 nt, Artificial Sequence; identical to SEQ ID NO: 138754
  derived and/or modified sequence opt3 from neuraminidase__InfluenzaA__ADK32493

SEQ ID NO: 141091 - RNA, 1410 nt, Artificial Sequence; identical to SEQ ID NO: 140667
  derived and/or modified sequence opt3 from neuraminidase__InfluenzaA__ADK32505

SEQ ID NO: 141092 - RNA, 1410 nt, Artificial Sequence
  derived and/or modified sequence opt3 from neuraminidase__InfluenzaA__ADK32640
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagccucugugaaacuggcgggaaauucgucauugugcccugucagcggaugggcuauauacaguaaggacaacuccauuagaaucggcucuaaaggugauguguuuguuauuagggagccauucaucagcuguuccccguuagaaugccggaccuuuuuccugacacagggggcccuacucaaugacaagcauucaaacggaaccaucaaagaucgcagucccuaucgaacucugaugagcuguccuauuggcgaggugccaucucccuacaacucccguuuugaaucagucgcauggagcgccagugcuugccacgacggcauaaauuggcuuacaaucgggauuucuggaccugauaacggugcaguggccguacugaaguauaauggcaucauaaccgacacgauuaaguccuggagaaacaauaucuugaggacucaagagagcgagugugcuugcguuaacgggucguguuucaccgugaugacagauggaccaucugacggccaggccuccuacaaaaucuuucggauugaaaaggguaaaaucgucaagucaguggagaugaaugcgcccaacuaucauuacgaagagugcaguuguuacccugauagcuccgagauuacuugcgugugccgcgacaauuggcacgggucuaacagaccaugggucagcuucaaucagaaccucgaauaucagauaggauacaucuguucaggcauuuuuggcgauaauccgaggcccaacgacaaaaccgggaguugcggaccuguuuccagcaauggugcaaacggcgugaagggguucucuuuuaaguauggaaacggcguauggaucggucggacaaaaucaaucaguagccgcaauggguucgagaugauuugggauccaaacggcuggaccggaacggacaauaacuuuuccauaaagcaagacaucgugggcauuaaugaauggucuggguacucggggagcuucguccagcaucccgagcugacuggucuggauuguauccgaccuugcuucuggguggaacucauuagaggcaggccaaaagagaacacaaucuggaccuccgggucaaguauaucuuuuuguggaguuaauagcgacacugugggcugguccuggcccgauggugccgaguuaccguucacaaucgacaaguga

SEQ ID NO: 141093 - RNA, 1410 nt, Artificial Sequence; identical to SEQ ID NO: 138754
  derived and/or modified sequence opt3 from neuraminidase__InfluenzaA__ADK32650

SEQ ID NO: 141094 - RNA, 1410 nt, Artificial Sequence; identical to SEQ ID NO: 138754
  derived and/or modified sequence opt3 from neuraminidase__InfluenzaA__ADK32660

SEQ ID NO: 141095 - RNA, 1410 nt, Artificial Sequence; identical to SEQ ID NO: 138754
  derived and/or modified sequence opt3 from neuraminidase__InfluenzaA__ADK32670

SEQ ID NO: 141096 - RNA, 1410 nt, Artificial Sequence
  derived and/or modified sequence opt3 from neuraminidase__InfluenzaA__ADK32680
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacaaaaauaacaccuggguuaaucagacauaugugaacaucagcaauacuaacuucgcugcaggccaguccguagugucugucaagcuggccggaaauucgucauugugcccugugagcggaugggcgauauacaguaaagacaacuccauuagaaucggcucuaagggugauguuuuugugauuagggaaccauucaucagcuguuccccguuagagugccggaccuuuuuccugacacagggggcucuacucaaugacaaacauucaaacggaaccaucaaggaucgcagucccuaucgaacucugaugagcuguccuauuggcgaagucccaucucccuacaacucccguuuugagucaguggccuggagcgcaagugccugccacgacggcauaaauuggcuuacaaucgggauuucuggaccugauaacggugcuguagcaguucugaaguauaauggcaucauaaccgacacgauuaaauccuggagaaacaauaucuugaggacucaagaaagcgagugugccugcgugaacgggucguguuucaccgucaugacagauggaccaucugacggccaggcuuccuacaagaucuuucggauugagaaagguaagaucgugaaaucaguggaaaugaaugcccccaacuaucauuacgaggaaugcaguuguuacccugauagcuccgagauuacuugcgucugccgcgacaauuggcacgggucuaacagaccauggguuagcuucaaucagaaccucgaguaucagauaggauacaucuguucaggcauuuuuggcgauaauccgaggcccaacgacaagaccgggaguugcggaccuguguccagcaauggugcgaacggcguaaagggguucucuuuuaaauauggaaacggcguguggaucggucggacaaagucaaucaguagccgcaauggguucgaaaugauuugggauccaaacggcuggaccggaacggacaauaacuuuuccauaaaacaagacaucgucggcauuaaugaguggucuggguacucggggagcuucgugcagcaucccgaacugacuggucuggauuguauccgaccuugcuucuggguugagcucauuagaggcaggccaaaggaaaacacaaucuggaccuccgggucaaguauaucuuuuuguggagugaauagcgacacugucggcugguccuggcccgauggugcagaguuaccguucacaaucgacaaauga

SEQ ID NO: 141097 - RNA, 1410 nt, Artificial Sequence; identical to SEQ ID NO: 138754
  derived and/or modified sequence opt3 from neuraminidase__InfluenzaA__ADK32690

SEQ ID NO: 141098 - RNA, 1410 nt, Artificial Sequence; identical to SEQ ID NO: 138754
  derived and/or modified sequence opt3 from neuraminidase__InfluenzaA__ADK32700

SEQ ID NO: 141099 - RNA, 1410 nt, Artificial Sequence; identical to SEQ ID NO: 138754
  derived and/or modified sequence opt3 from neuraminidase__InfluenzaA__ADK32779

SEQ ID NO: 141100 - RNA, 1410 nt, Artificial Sequence; identical to SEQ ID NO: 138754
  derived and/or modified sequence opt3 from neuraminidase__InfluenzaA__ADK33614

SEQ ID NO: 141101 - RNA, 1410 nt, Artificial Sequence; identical to SEQ ID NO: 138754
  derived and/or modified sequence opt3 from neuraminidase__InfluenzaA__ADK33624

SEQ ID NO: 141102 - RNA, 1410 nt, Artificial Sequence; identical to SEQ ID NO: 138754
  derived and/or modified sequence opt3 from neuraminidase__InfluenzaA__ADK33634

SEQ ID NO: 141103 - RNA, 1410 nt, Artificial Sequence
  derived and/or modified sequence opt3 from neuraminidase__InfluenzaA__ADK33644
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggauccgauaacggugcuguagcaguucugaaguauaauggcaucauaaccgacacgauuaagagcuggagaaacaauaucuugaggacucaagagucggagugugccugcgugaacgggucuuguuucaccgucaugacagauggaccuuccgacggccaggcuucauacaaaaucuuucggauugaaaaggguaaaaucgugaagaguguggagaugaaugccccaaacuaucauuacgaagagugcagcuguuaccccgauuccucugagauuacuugcgucugccgcgacaauuggcacgggagcaacagaccuuggguuucauucaaucagaaccucgaauaucagauaggauacaucuguaguggcauuuuuggcgauaauccaaggccgaacgacaaaaccggguccugcggacccgugagcucuaauggugcgaacggcguaaagggguucucauuuaaguauggaaacggcguguggaucggucggacaaaaaguaucagcucccgcaauggguucgagaugauuugggauccuaacggcuggaccggaacggacaauaacuuuucuauaaagcaagacaucgucggcauuaaugaauggucgggguacagcggauccuucgugcagcauccagagcugacuggucuggauuguauccgacccugcuucuggguugaacucauuagaggcaggccuaaagagaacacaaucuggaccucagggaguucuauaucguuuuguggagucaauuccgacacugugggcuggucauggccagauggugcagaguuacccuucacaaucgacaaguga

SEQ ID NO: 141104 - RNA, 1410 nt, Artificial Sequence; identical to SEQ ID NO: 140485
  derived and/or modified sequence opt3 from neuraminidase__InfluenzaA__ADK33654

SEQ ID NO: 141105 - RNA, 1410 nt, Artificial Sequence; identical to SEQ ID NO: 140485
  derived and/or modified sequence opt3 from neuraminidase__InfluenzaA__ADK33664

SEQ ID NO: 141106 - RNA, 1410 nt, Artificial Sequence; identical to SEQ ID NO: 138754
  derived and/or modified sequence opt3 from neuraminidase__InfluenzaA__ADK33674

SEQ ID NO: 141107 - RNA, 1410 nt, Artificial Sequence; identical to SEQ ID NO: 138754
  derived and/or modified sequence opt3 from neuraminidase__InfluenzaA__ADK33684

SEQ ID NO: 141108 - RNA, 1410 nt, Artificial Sequence; identical to SEQ ID NO: 140105
  derived and/or modified sequence opt3 from neuraminidase__InfluenzaA__ADK33694

SEQ ID NO: 141109 - RNA, 1410 nt, Artificial Sequence; identical to SEQ ID NO: 138754
  derived and/or modified sequence opt3 from neuraminidase__InfluenzaA__ADK33704

SEQ ID NO: 141110 - RNA, 1410 nt, Artificial Sequence; identical to SEQ ID NO: 138754
  derived and/or modified sequence opt3 from neuraminidase__InfluenzaA__ADK33714

SEQ ID NO: 141111 - RNA, 1410 nt, Artificial Sequence; identical to SEQ ID NO: 138754
  derived and/or modified sequence opt3 from neuraminidase__InfluenzaA__ADK33744

SEQ ID NO: 141112 - RNA, 1410 nt, Artificial Sequence
  derived and/or modified sequence opt3 from neuraminidase__InfluenzaA__ADK33754
augaaccccaaucagaagaucauuaccauaggcagcgugugcaugacaaucgggauggccaacuucauucugcaaaucggaaauauuaucuccauauggaucucucacucaauucagcucgguaaccagaaucagaucgagacuuguaaccaaagugucauuacguacgaaaauaacaccuggguuaaucagacauaugugaacaucagcaauacuaacuuugcugcaggccaguccguagugucugucaaacuugccggaaauucgucacugugcccugugagcggaugggcgauauacaguaaggacaacuccauuagaaucggcucuaaaggugauguuuucgugauuagggagccauuuaucagcuguuccccguuggaaugccggaccuucuuuuuaacacagggggcucugcuaaaugacaagcauucaaacggaaccaucaaagaucgcagucccuaucgaacucucaugagcuguccuauuggcgaggucccaucucccuacaacucccguuucgaaucaguggccuggagcgcaagugccugccacgacggcauaaauuggcugacaaucgggauuucuggaccugauaacggugcuguagcaguucuuaaguauaauggcaucauaaccgacacgauuaaguccuggagaaacaauauccugaggacucaagagagcgagugugccugcgugaacgggucguguuuuaccgucaugacagauggaccaucugacggccaggcuuccuacaaaaucuuccggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuuuaaucagaacuuggaauaucagauaggauacaucuguucaggcauuuucggcgauaauccgaggcccaacgacaaaaccgggaguugcggaccuguguccagcaauggugcgaacggcguaaagggguuuucuuucaaguauggaaacggcguguggaucggucggacaaaaucaaucaguagccgcaauggguuugagaugauuugggauccaaacggcuggaccggaacggacaauaacuucuccauaaagcaagacaucgucggcauuaaugaauggucuggguacucggggagcuucgugcagcaucccgagcucacuggucuggauuguauccgaccuugcuuuuggguugaacugauuagaggcaggccaaaagagaacacaaucuggaccuccgggucaaguauaucuuucuguggagugaauagcgacacugucggcugguccuggcccgauggugcagagcucccguuuacaaucgacaaguga

SEQ ID NO: 141113 - RNA, 1410 nt, Artificial Sequence
  derived and/or modified sequence opt3 from neuraminidase__InfluenzaA__ADK33764
augaaccccaaucagaagaucauuaccauaggcagcgugugcaugacaaucgggauggccaacuucauucugcaaaucggaaauauuaucuccauauggaucucucacucaauucagcucgguaaccagaaucagaucgagacuuguaaccaaagugucauuacguacgaaaauaacaccuggguuaaucagacauaugugaacaucagcaauacuaacuuugcugcaggccaguccguagugucugucaaacuugccggaaauucgucacugugcccugugagcggaugggcgauauacaguaaggacaacuccauuagaaucggcucuaaaggugauguuuucgugauuagggagccauuuaucagcuguuccccguuggaaugccggaccuucuuuuuaacacagggggcucugcuaaaugacaagcauucaaacggaaccaucaaagaucgcagucccuaucgaacucucaugagcuguccuauuggcgaggucccaucucccuacaacucccguuucgaaucaguggccuggagcgcaagugccugccacgacggcauaaauuggcugacaaucgggauuucuggaccugauaacggugcuguagcaguucuuaaguauaauggcaucauaaccgacacgauuaaguccuggagaaacaauauccugaggacucaagagagcgagugugccugcgugaacgggucguguuuuaccgucaugacagauggaccaucugacggccaggcuuccuacaaaaucuuccggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuuuaaucagaacuuggaauaucagaugggauacauauguucaggcaucuucggcgauaauccgaggcccaacgacaaaaccgggaguugcggaccuguguccagcaauggugcgaacggcguaaagggguuuucuuucaaguauggaaacggcguguggauuggucggacaaaaucaaucaguagccgcaauggguuugagaugaucugggauccaaacggcuggaccggaacggacaauaacuucuccauuaagcaagacauagucggcaucaaugaauggucuggguacucggggagcuucgugcagcaucccgagcucacuggucuggauuguauucgaccuugcuuuuggguugaacugaucagaggcaggccaaaagagaacacaauuuggaccuccgggucaaguaucucuuucuguggagugaauagcgacacugucggcugguccuggcccgauggugcagagcucccguuuacaauagacaaguga

SEQ ID NO: 141114 - RNA, 1410 nt, Artificial Sequence
  derived and/or modified sequence opt3 from neuraminidase__InfluenzaA__ADK33774
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggugggaaauucgucauugugcccuguuagcggaugggccauauacaguaaggacaacuccauuagaaucggcucuaaaggugauguguuugucauuagggagccauucaucagcuguuccccguuagaaugccggaccuuuuuccugacacagggggcgcuacucaaugacaagcauucaaacggaaccaucaaagaucgcagucccuaucgaacucugaugagcuguccuauuggcgaggugccaucucccuacaacucccguuuugaaucaguagcuuggagcgccagugcaugccacgacggcauaaauuggcuuacaaucgggauuucuggaccugauaacggugccguugcugugcugaaguauaauggcaucauaaccgacacgauuaaguccuggagaaacaauaucuugaggacucaagagagcgagugugcaugcgucaacgggucguguuucaccgugaugacagauggaccaucugacggccaggccuccuacaaaaucuuucggauugaaaaggguaaaaucgugaagucagucgagaugaaugcucccaacuaucauuacgaagagugcaguuguuacccugauagcuccgagauuacuugcguuugccgcgacaauuggcacgggucuaacagaccaugggugagcuucaaucagaaccucgaauaucagaugggauacauauguucaggcaucuuuggcgauaauccgaggcccaacgacaaaaccgggaguugcggaccuguauccagcaauggugccaacggcgugaagggguucucuuuuaaguauggaaacggcgucuggauuggucggacaaaaucaaucaguagccgcaauggguucgagaugaucugggauccaaacggcuggaccggaacggacaauaacuuuuccauuaagcaagacauagugggcaucaaugaauggucuggguacucggggagcuucguucagcaucccgagcugacuggucuggauuguauucgaccuugcuucuggguggaacucaucagaggcaggccaaaagagaacacaauuuggaccuccgggucaaguaucucuuuuuguggagucaauagcgacacugugggcugguccuggcccgauggugcggaguuaccguucacaauagacaaguga

SEQ ID NO: 141115 - RNA, 1410 nt, Artificial Sequence; identical to SEQ ID NO: 139728
  derived and/or modified sequence opt3 from neuraminidase__InfluenzaA__ADK33784

SEQ ID NO: 141116 - RNA, 1410 nt, Artificial Sequence; identical to SEQ ID NO: 138754
  derived and/or modified sequence opt3 from neuraminidase__InfluenzaA__ADK33794

SEQ ID NO: 141117 - RNA, 1410 nt, Artificial Sequence; identical to SEQ ID NO: 138754
  derived and/or modified sequence opt3 from neuraminidase__InfluenzaA__ADK33804

SEQ ID NO: 141118 - RNA, 1410 nt, Artificial Sequence
  derived and/or modified sequence opt3 from neuraminidase__InfluenzaA__ADK33814
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaauaaaacauaugugaacaucagcaauacuaacuucgcugcaggccaguccguagugucugucaagcuggccggaaauucgucauugugcccugugagcggaugggcgauauacaguaaagacaacuccauuagaaucggcucuaagggugauguuuuugugauuagggagccauucaucagcuguuccccguuagaaugccggaccuuuuuccugacacagggggcucuacucaaugacaaacauucaaacggaaccaucaaggaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaauccuggagaaacaauaucuugaggacucaggagagcgagugugccugcgugaacgggucguguuucaccgucaugacagauggaccaucugacggccaggcuuccuacaagaucuuucggauugaaaaagguaagaucgugaaaucaguggagaugaaugcccccaacuaucauuacgaagagugcaguuguuacccugauagcuccgagauuacuugcgucugccgcgacaauuggcacgggucuaacagaccauggguuagcuucaaucaaaaccucgaauaucagaugggauacauauguucaggcaucuuuggcgauaauccgaggcccaacgacaagaccgggaguugcggaccuguguccagcaauggugcgaacggcguaaagggguucucuuuuaaauauggaaacggcguguggauuggucggacaaagucaaucaguagccgcaauggguucgagaugaucugggauccaaacggcuggaccggaacggacaauaacuuuuccauuaaacaggacauagucggcaucaaugaauggucuggguacucggggagcuucgugcaacaucccgagcugacuggucuggauuguauucgaccuugcuucuggguugaacucaucagaggcaggccaaaggagaacacaauuuggaccuccgggucaaguaucucuuuuuguggagugaauagcgacacugucggcugguccuggcccgauggugcagaguuaccguucacaauagacaaauga

SEQ ID NO: 141119 - RNA, 1410 nt, Artificial Sequence
  derived and/or modified sequence opt3 from neuraminidase__InfluenzaA__ADK33824
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauauaucaacauaagcaauacuaacuucgcugcaggccaguccgugguaucugugaaacuggccggaaauucgucauugugcccugucagcggaugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaauggguucgagaugauaugggauccaaacggcuggaccggaacggacaauaacuuuuccaucaagcaagacauugugggcaucaaugaauggucuggguacucggggagcuucguccagcaucccgagcugacuggucuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 141120 - RNA, 1410 nt, Artificial Sequence; identical to SEQ ID NO: 139931
  derived and/or modified sequence opt3 from neuraminidase__InfluenzaA__ADK33834

SEQ ID NO: 141121 - RNA, 1410 nt, Artificial Sequence
  derived and/or modified sequence opt3 from neuraminidase__InfluenzaA__ADK33844
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugccaaacuggcgggaaauucgccuuugugcccagucucagggugggcuauauacagcaaggacaacaguauuagaaucggcuccaaaggugauguguuuguuauuagggagccguucaucucuuguagccccuuagaaugccggaccuuuuuccugacacagggggcccuacucaaugacaagcauuccaacggaaccaucaaagaucgcucaccuuaucgaacucugaugaguuguccaauuggcgaggugcccagcccuuacaacucucguuuugaauccgucgcauggucagccagcgcuugccacgacggcauaaauuggcuuacaaucgggauuaguggaccagauaacggugcaguggccguacugaaguauaauggcaucauaaccgacacgauuaagucuuggagaaacaauaucuugaggacucaagaguccgagugugcuugcguuaacgggagcuguuucaccgugaugacagauggacccucggacggccaggccucuuacaaaaucuuucggauugaaaaggguaaaaucgucaaguccguggagaugaaugcgccuaacuaucauuacgaagagugcucauguuacccagauaguagcgagauuacuugcgugugccgcgacaauuggcacggguccaacagaccgugggucucuuucaaucagaaccucgaauaucagauaggauacaucuguagcggcauuuuuggcgauaaucccaggccuaacgacaaaaccgggucaugcggaccaguuaguuccaauggugcaaacggcgugaagggguucagcuuuaaguauggaaacggcguauggaucggucggacaaaaucuaucucaagucgcaauggguucgagaugauuugggaucccaacggcuggaccggaacggacaauaacuuuagcauaaagcaagacaucgugggcauuaaugaaugguccggguacucuggaucguucguccagcauccugagcugacuggucuggauuguauccgaccaugcuucuggguggaacucauuagaggcaggcccaaagagaacacaaucuggaccagcggguccucaauaaguuuuuguggaguuaauucugacacugugggcuggagcuggccggauggugccgaguuaccuuucacaaucgacaaguga

SEQ ID NO: 141122 - RNA, 1410 nt, Artificial Sequence; identical to SEQ ID NO: 139931
  derived and/or modified sequence opt3 from neuraminidase__InfluenzaA__ADK33854

SEQ ID NO: 141123 - RNA, 1410 nt, Artificial Sequence; identical to SEQ ID NO: 140645
  derived and/or modified sequence opt3 from neuraminidase__InfluenzaA__ADK33864

SEQ ID NO: 141124 - RNA, 1410 nt, Artificial Sequence
  derived and/or modified sequence opt3 from neuraminidase__InfluenzaA__ADK33874
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauaccuguguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucucgauuguauucgaccuugcuucuggguugaauuaaucagaggcaggccaaaagagaacacaauuuggaccuccgggucaaguaucucuuuuuguggagugaauagcgacacugucggcugguccuggcccgauggugcagagcugccguucacaauagacaaguga

SEQ ID NO: 141125 - RNA, 1410 nt, Artificial Sequence; identical to SEQ ID NO: 138754
  derived and/or modified sequence opt3 from neuraminidase__InfluenzaA__ADK33884

SEQ ID NO: 141126 - RNA, 1410 nt, Artificial Sequence; identical to SEQ ID NO: 139931
  derived and/or modified sequence opt3 from neuraminidase__InfluenzaA__ADK33894

SEQ ID NO: 141127 - RNA, 1410 nt, Artificial Sequence; identical to SEQ ID NO: 139931
  derived and/or modified sequence opt3 from neuraminidase__InfluenzaA__ADK33904

SEQ ID NO: 141128 - RNA, 1410 nt, Artificial Sequence; identical to SEQ ID NO: 140711
  derived and/or modified sequence opt3 from neuraminidase__InfluenzaA__ADK33914

SEQ ID NO: 141129 - RNA, 1410 nt, Artificial Sequence
  derived and/or modified sequence opt3 from neuraminidase__InfluenzaA__ADK33924
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcaacacugucggcugguccuggcccgacggugcagaguuaccguucacaaucgauaaguga

SEQ ID NO: 141130 - RNA, 1410 nt, Artificial Sequence; identical to SEQ ID NO: 138754
  derived and/or modified sequence opt3 from neuraminidase__InfluenzaA__ADK33934

SEQ ID NO: 141131 - RNA, 1410 nt, Artificial Sequence; identical to SEQ ID NO: 138754
  derived and/or modified sequence opt3 from neuraminidase__InfluenzaA__ADK33944

SEQ ID NO: 141132 - RNA, 1410 nt, Artificial Sequence; identical to SEQ ID NO: 140711
  derived and/or modified sequence opt3 from neuraminidase__InfluenzaA__ADK33954

SEQ ID NO: 141133 - RNA, 1410 nt, Artificial Sequence; identical to SEQ ID NO: 138754
  derived and/or modified sequence opt3 from neuraminidase__InfluenzaA__ADK33964

SEQ ID NO: 141134 - RNA, 1410 nt, Artificial Sequence; identical to SEQ ID NO: 139861
  derived and/or modified sequence opt3 from neuraminidase__InfluenzaA__ADK33974

SEQ ID NO: 141135 - RNA, 1410 nt, Artificial Sequence; identical to SEQ ID NO: 138754
  derived and/or modified sequence opt3 from neuraminidase__InfluenzaA__ADK33984

SEQ ID NO: 141136 - RNA, 1410 nt, Artificial Sequence
  derived and/or modified sequence opt3 from neuraminidase__InfluenzaA__ADK39016
augaaccccaaucagaagaucauuaccauaggcagcgugugcaucacaauugggauggccaaccugauccuccaaauuggaaauaucauauccaucuggauuucucacucaauccagcuugguaaccagaaucagauugagacuuguaaccaaagugucaucacguacgaaaauaacaccuggguuaaucagacauaugugaacauaagcaauacuaacuucgcugcaggccaguccguagugucugucaaacuggccggaaauucgucauugugcccugugagcgggugggcgauuuacaguaaggacaacuccaucagaauuggcucuaaaggugauguuuuugugaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggucccaucucccuacaacucccguuuugaaucaguggccuggagcgcaagugccugccacgacggcaucucuuggcuuacaauugggaucuccggaccugauaauggugcuguagcaguucugaaguauaacggcauaauuaccgacacgaucaagagcuggagaaauaacaucuugaggacucaagagucggagugugccugcgugaaugggucuuguuucaccgucaugacagauggaccauccgacggccaggcuucauacaaaauuuuucggaucgaaaaggguaaaauugugaagaguguggagaugaacgcccccaauuaucauuacgaagagugcagcuguuacccugauuccucugagauaacuugcgucugccgcgacaacuggcacgggagcaauagaccauggguuucauucaaccagaaucucgaauaucagaucggauacauuuguaguggcaucuuuggcgauaacccgaggcccaaugacaaaaccggguccugcggaccugugagcucuaacggugcgaauggcguaaagggguucucauuuaaguauggaaacggcguguggaucggucggacaaaaaguauuagcucccgcaacggguucgagaugauaugggauccagacggcuggaccggaacggacaauaacuuuucuaucaagcaagauauugucggcaucaaugaauggucgggguacagcggauccuucgugcagcaucccgagcugacuggucuggacuguauucgaccuugcuucuggguugaacucaucagaggcaggccaaaagagaacacaauauggaccucagggaguucuaucagcuuuuguggagucaauuccgauacugugggcuggucauggcccgacggugcagaguuaccguucacaauugauaaguga

SEQ ID NO: 141137 - RNA, 1410 nt, Artificial Sequence; identical to SEQ ID NO: 138615
  derived and/or modified sequence opt3 from neuraminidase__InfluenzaA__ADK45315

SEQ ID NO: 141138 - RNA, 1410 nt, Artificial Sequence
  derived and/or modified sequence opt3 from neuraminidase__InfluenzaA__ADK45413
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcuguaugaaccgacuauaaucgagagaaauauuaccgaaaucguguacuugacaaacaccacuauugagaaggaaaucugucccaaauuagcugaguauaggaauuggaguaagccucagugcgacauaacaggguucgcaccauuuagcaaagauaacuccauucggcugucugccggaggugacaucuggguaacccgcgagcccuacgugucgugugauccugacaagugcuaucaauucgcgcuaggccaggggacgacucucaauaacguccauucaaauaacaccgugcgagaucguacaccauacagaacucugcuuaugaaugaacugggaguucccuuucacuugggcaccaaacagguguguauugcuuggagcaguuccucuugccaugacgguaaggccuggcuccacgucuguaucacaggggaugacaagaacgcaaccgccagcuucaucuauaauggaaggcugguggauuccguaguuucauggaguaaagacauucugcggacgcaggagagcgaaugcguguguauaaacggcacuugcacagucgugaugaccgauggcucugcuuccgggaaggcagacacuaaaauccucuuuauugaggagggaaagaucgugcauacaucaaccuuaagcgguagugcccaacacgucgaagaguguucuugcuacccucgcuacccaggcguuagaugcguguguagggauaacuggaagggguccaaucggccgauaguagacauuaacaucaaagaccacagcaucgcuucgucuuaugugugcuccggacuggucggcgauacgccccgcaagaaugacucaaguagcuccucucauugucuugauccuaacaaugaagagggugggcacggagugaaaggcugggccuucgacgauggcaacgacguuuggauggggcgaaccauuagcgaaaagucaagauugggauacgagacauuuaaagugaucgaggguuggaguaauccaaaguccaaacugcagauuaacaggcaggucauaguggaucggggcaaucguagcggguauucuggaaucuucucaguagaaggcaagaguugcauuaaccgcuguuuuuacguugagcuaaucagagguaggaaggaagagacugaagugcucuggaccagcaauuccaucgucguguucugcgggacaucuggcacuuauggaaccggcucguggcccgacggggcgaacauuaaucugaugccuauauga

SEQ ID NO: 141139 - RNA, 1410 nt, Artificial Sequence
  derived and/or modified sequence opt3 from neuraminidase__InfluenzaA__ADK45424
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuaccuguguuccggacuugucggcgacacgccccgcaagaaugauucaaguagcuccucucauugcuuggacccuaacaaugaggaaggugggcacggagugaaaggcugggcuuucgaugacggcaacgauguuuggauggggcgaaccauuagcgagaagucaagacugggauaugagacauuuaaagugaucgaagguuggaguaauccaaaguccaaacuacagauuaacaggcaggucauaguggaccggggcaaucguagcggguacucuggaaucuucucaguagagggcaagaguuguauuaaccgcugcuuuuauguugaacucaucagagguaggaaggaggaaacugaggugcuguggaccagcaauuccaucgucguguucugugggacaucuggcacuuacggaaccggcucguggcccgauggggccgacauuaaccuuaugccuauauga

SEQ ID NO: 141140 - RNA, 1410 nt, Artificial Sequence; identical to SEQ ID NO: 139921
  derived and/or modified sequence opt3 from neuraminidase__InfluenzaA__ADK45446

SEQ ID NO: 141141 - RNA, 1410 nt, Artificial Sequence
  derived and/or modified sequence opt3 from neuraminidase__InfluenzaA__ADK45457
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaagugguagcucccauugccuugacccuaacaaugaggaagggggacacggcguuaaaggcugggcuuucgaugacgggaacgauguguggaugggacgaaccauuucugaaaagagcagauuggguuaugagacauuuaaagucaucgagggcuggucaaauccaaagaguaaacugcagauuaacaggcaagugauaguagaccgggggaaucguuccggauacagcggcaucuucucuguugaggguaagucauguauuaaccgcugcuuuuauguggaacuaaucagagggaggaaggaggaaacugagguccucuggaccaguaauagcaucguggucuucuguggcacauccggaacuuacggcaccgggucuuggcccgauggagccgacauuaaccugaugccuauauga

SEQ ID NO: 141142 - RNA, 1410 nt, Artificial Sequence
  derived and/or modified sequence opt3 from neuraminidase__InfluenzaA__ADK45479
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagacauucugcggacgcaggagagcgaaugugugugcauaaacggcacuuguacagucgugaugaccgauggcucugcuuccgggaaggcagacacuaaaauccucuuuauugaggagggaaaggugguccauacaucaaccuuaagcgguagugcccaacacguugaagagugcucuugcuauccucgcuacccaggcgugagauguguaugcagggauaacuggaagggguccaaucggccgaucguggacauaaacauuaaagaccacagcaucgucucgucuuacguguguuccggacugguuggcgauacgccccgcaagaaugacucaaguagcuccucucauugccuugauccuaacaaugaagagggugggcacggagugaaaggcugggcuuucgacgauggcaacgacgucuggauggggcgaaccaucagcgaaaagucaagauugggauaugagacauuuaaagugauugaggguuggaguaaucauaaguccaaacugcagaucaacaggcagguaauuguugaucggggcaaucguagcggguacucuggaauauucucaguggaaggcaagaguuguaucaaccgcugcuuuuaugucgagcuaauuagagguaggaaggaagaggccgaagugcucuggacuagcaauuccaucgucguguucugugggaccucuggcacauacggaacuggcucguggccagacggggcggaucugaaccuuaugcccaucuga

SEQ ID NO: 141143 - RNA, 1410 nt, Artificial Sequence; identical to SEQ ID NO: 138754
  derived and/or modified sequence opt3 from neuraminidase__InfluenzaA__ADK48799

SEQ ID NO: 141144 - RNA, 1410 nt, Artificial Sequence; identical to SEQ ID NO: 140667
  derived and/or modified sequence opt3 from neuraminidase__InfluenzaA__ADK62686

SEQ ID NO: 141145 - RNA, 1410 nt, Artificial Sequence; identical to SEQ ID NO: 140105
  derived and/or modified sequence opt3 from neuraminidase__InfluenzaA__ADK62696

SEQ ID NO: 141146 - RNA, 1410 nt, Artificial Sequence; identical to SEQ ID NO: 139337
  derived and/or modified sequence opt3 from neuraminidase__InfluenzaA__ADK64994

SEQ ID NO: 141147 - RNA, 1410 nt, Artificial Sequence
  derived and/or modified sequence opt3 from neuraminidase__InfluenzaA__ADK65002
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaccggcucuaaaggugauguuuuugugaucagggagccauucauuagcuguuccccguuagaaugccggacauuuuuccugacccagggggcucuacucaaugacaagcauucaaacggaacuaucaaagaucgcagucccuaucgaacacugaugagcuguccuaucggcgaggucccaucucccuacaacucccguuuugaaucaguggccuggagcgcaagugccugccacgacggcauuaauuggcuuaccauagggaucucuggaccugauaacggugcuguagcaggccugaaguauaaugggauuaucacggacacuauaaaguccuggagaaacaauauuuugaggacccaagagagcgagugugccugcguuaacggaucguguuucacagugaugacugauggcccaucugacggucaggcuuccuacaaaaucuuucggaucgaaaaggggaaaauugucaagucaguggagaugaaugcccccaacuaucauuacgaagagugcaguuguuacccugauagcuccgagauuaccugcgugugccgcgacaauuggcacggaucuaacagaccaugggucagcuucaaucagaaccucgaauaucagaucggcuacauauguucaggcaucuuuggggauaauccgaggcccaacgacaaaacaggaaguugcgguccuguuuccagcaauggcgcgaacggggugaagggauucucuuuuaaguauggcaacgguguauggauugggcggaccaaaucaaucaguagccgcaauggcuucgagaugaucugggauccaaacggauggacgggcacugacaauaacuuuuccauuaagcaagacauaguggggaucaaugaauggucuggauacucggguagcuucguccagcaucccgagcugacaggccuggauuguauucgaccuugcuucuggguggaacucaucagagggaggccaaaagagaacaccauuuggacuuccggaucaaguaucucuuuuuguggcguuaauagcgacacaguggguugguccuggcccgauggggcagaguuaccguucaccauagacaaguga

SEQ ID NO: 141148 - RNA, 1410 nt, Artificial Sequence; identical to SEQ ID NO: 138754
  derived and/or modified sequence opt3 from neuraminidase__InfluenzaA__ADK65010

SEQ ID NO: 141149 - RNA, 1410 nt, Artificial Sequence
  derived and/or modified sequence opt3 from neuraminidase__InfluenzaA__ADK65018
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggccugcaagcgccugccacgacggcauaaauuggcuuacaaucgggauuaguggaccagauaacggugcuguagcaguucugaaguauaauggcaucauaaccgacacgauuaagucuuggagaaacaauaucuugaggacucaagaguccgagugugccugcgugaacgggagcuguuucaccaucaugacagauggacccucggacggccaggcuucuuacaaaauuuuucggaucgaaaaggguaaaauugucaaguccauagagaugaaugccccuaacuaucauuacgaagagugcucauguuacccagauaguagcgagaucacuugcgugugccgcgacaauuggcacggguccaacagaccgugggugucuuucaaucagaaccucgaauaucagauuggauacaucuguagcggcaucuuuggcgauaaucccaggccuaacgacaaaaccgggucaugcggaccagucaguuccaauggugcgaacggcguuaagggguucagcuuuaaguauggaaacggcguguggauuggucggacaaaaucuauaucaagucgcaauggguucgagaugaucugggaucccaacggcuggaccggaacggacaauaacuuuagcauuaagcaagacaucguaggcauuaaugaaugguccggguacucuggaucguucgugcagcauccugagcugacuggucuggauuguauccgaccaugcuucugggucgaacucauaagaggcaggcccaaagagaacacaaucuggaccagcggguccucaauuaguuuuuguggaguuaauucugacacugugggcuggagcuggccggauggugcagaguuaccuuucacaaucgacaaguga

SEQ ID NO: 141150 - RNA, 1410 nt, Artificial Sequence
  derived and/or modified sequence opt3 from neuraminidase__InfluenzaA__ADK87290
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcauauacuaaaauccucuuuauugaggaaggaaagaucgugcauacaucaaccuuaagcgguagugcccaacacgucgaggaaugcucuugcuacccucgcuacccaggcguuagaugugugugcagggauaacuggaagggguccaaucggccgauaguagacauuaacaucaaagaucacagcaucgugucgucuuaugucuguuccggacuggugggcgacacgccccgcaagaaugacucaaguagcuccucucauugccuugauccuaacaaugaggaaggugggcacggaguuaaaggcugggcuuucgacgauggcaacgacguguggauggggcgaaccauuagcgagaagucaagauugggauacgagacauuuaaagucaucgaagguuggaguaauccaaaguccaaacugcagauuaacaggcaagugauaguagaucggggcaaucguagcggguauucuggaaucuucucaguugagggcaagaguuguauuaaccgcugcuuuuacguggaacuaaucagagguaggaaggaggaaacugagguccucuggaccagcaauuccaucguggucuucugugggacaucuggcacuuauggaaccggcucguggcccgacggggccgauauuaaccugaugccuguguga

SEQ ID NO: 141151 - RNA, 1410 nt, Artificial Sequence
  derived and/or modified sequence opt3 from neuraminidase__InfluenzaA__ADK87292
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgcuuguuccggacuggucggcgacacgccccgcaagaaugauucaaguagcuccucucauugccuugacccuaacaaugaggaaggugggcacggagugaaaggcugggccuucgaugacggcaacgauguuuggauggggcgaaccauuagcgagaagucaagauugggauaugagacauuuaaagugaucgaagguuggaguaauccaaaguccaaacugcagauuaacaggcaggucauaguggaccggggcaaucguagcggguacucuggaaucuucucaguagagggcaagaguuguauuaaccgcugcuuuuauguugaacuaaucagagguaggaaggaggaaacugaggugcucuggaccagcaauuccaucgucguguucugugggacaucuggcacuuacggaaccggcucguggcccgauggggcggacauuaaccugaugccugucuga

SEQ ID NO: 141152 - RNA, 1410 nt, Artificial Sequence
  derived and/or modified sequence opt3 from neuraminidase__InfluenzaA__ADK87294
augaaccccaaucagaagaucauugccauaggcagcgugucccugaccaucucuacaauuugcuucuuucuccaaaucgcuauucuuaucacuacggucacccugcacuucaaacaguacgaguuuaacucaccuccaaauaaccagguuauguugugugaaccgacaauaaucgagagaaauauuacugaaaucguguauuuaaccaacacaaccauugagaaggaaaucugccccaaacuggcagaguacaggaauuggaguaagccucagugugacauaacuggguucgccccauuuagcaaagauaacuccauucggcuaucugcgggaggugacaucuggguaacacgcgagcccuaugugucgugcgauccugacaaguguuaccaauucgcucucggccaggggaccacgcugaauaacguccauucaaauaacacugugcgagaucguaccccauauagaacacuucugaugaaugaauugggaguucccuuucaccucggcacuaaacaggugugcauugccuggagcaguuccucuuguagggacgguaaggcauggcugcaugucugcaucaccggggaugacaagaacgccacagcuagcuucaucuacaauggacggcugguggauuccguaguuucauggaguaaagagauucuccgcacccaggaaagcgagugugugugcauaaacggcacguguacugucgugaugacagacggcucugcauccgggaaggccgauaccaaaaucuuauuuauugaggaaggaaagaucgugcacacuucaacacugagcgguagugcucaacaugucgaggaaugcucuugcuauccuagauacccaggcguuaggugugugugccgggacaccgggaagggauccaaccgcccgauaguagauauuaauaucaaagaccacagcaucgugucgucuuacgucuguuccggccuugugggugacacgccccgaaagaacgauucaaguagcuccucucacugcuuggacccuaauaacgaggaagggggacauggcguuaaaggcugggccuucgaugacgggaaugauguguggaugggaagaaccauuagcgagaagucaaggcuggguuaugagacauuuaaagucaucgaaggcuggaguaacccaaaguccaaacuacagauuaaucgucaggugauaguagaccgggggaaccgcagcggauacucuggcaucuucucaguugaggguaagaguuguauuaauagaugcuuuuauguggaacucaucagggggcggaaggaggaaacugagguccuguggaccagcaacaauaucguggucuucuguggcacauccggaacuuacggcaccgggucuuggcccgauggagcggacauuaaccuuaugccuguguga

SEQ ID NO: 141153 - RNA, 1410 nt, Artificial Sequence
  derived and/or modified sequence opt3 from neuraminidase__InfluenzaA__ADK87297
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaaaaccgcagucccuaucgaacucugaugagcuguccuauuggcgaggucccaucucccuacaauucccguuuugaaucaguggccuggagcgcaagugccugccacgauggcauaaacuggcuuacaaucgggauuucuggaccugacaauggugcuguagcaguucugaaguauaacggcaucauaaccgauacgauuaaguccuggagaaauaacaucuugaggacucaagagagcgagugugccugcgugaaugggucguguuucaccgucaugacagacggaccaucugauggccaggcuuccuacaaaaucuuucggauugaaaaggguaaaaucgugaagucaguggagaugaacgcccccaauuaucauuacgaagagugcaguuguuacccugacagcuccgagauuacuugcgucugccgcgauaacuggcacgggucuaauagaccauggguuagcuucaaccagaaucucgaauaucagauaggauacaucuguucaggcauuuuuggcgacaacccgaggcccaaugauaaaaccgggaguugcggaccuguguccagcaacggugcgaacggcguaaagggguucucuuuuaaguauggaaauggcguguggaucggucggacaaaaucaaucaguagccgcaacggguucgagaugauuugggacccaaauggcuggaccggaacggauaacaauuuuuccauaaagcaagacaucgucggcauuaacgaauggucuggguacucggggagcuucgugcagcaucccgagcugacuggucuggacuguauccgaccuugcuucuggguugaacucauuagaggcaggccaaaagagaauacaaucuggaccuccgggucaaguauaucuuuuuguggagugaacagcgauacugucggcugguccuggcccgacggugcagaguuaccguucacaaucgauaaguga

SEQ ID NO: 141154 - RNA, 1410 nt, Artificial Sequence
  derived and/or modified sequence opt3 from neuraminidase__InfluenzaA__ADK87299
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuuuaaaaucuuccggauugaaaaggguaaaaucgugaagucaguggagaugaaugcccccaacuaccauuaugaagagugcaguuguuacccugauagcuccgagauuacuugcgucugccgcgacaauuggcacgggucuaacagaccauggguuagcuuuaaucagaaccucgaauaccagauaggauauaucuguucaggcauuuucggcgauaauccgaggcccaacgacaaaaccgggaguugcggaccuguguccagcaauggugcgaacggcguaaagggguuuucuuucaaguacggaaacggcguguggaucggucggacaaaaucaaucaguagccgcaauggguuugagaugauuugggauccaaacggcuggaccggaacggacaauaacuucuccauaaagcaagacaucgucggcauuaaugaauggucuggguauucggggagcuucgugcagcaucccgagcugacuggucuggauuguauccgaccuugcuuuuggguugaacucauuagaggcaggccaaaagagaacacaaucuggaccuccgggucaaguauaucuuucuguggagugaauagcgacacugucggcugguccuggcccgauggugcagaguuaccguuuacaaucgacaaguga

SEQ ID NO: 141155 - RNA, 1410 nt, Artificial Sequence
  derived and/or modified sequence opt3 from neuraminidase__InfluenzaA__ADK87301
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgcuaugaccgacggcucugcauccgggaaggccgauacuaaaauccucuuuauugaggaaggaaagaucgugcauacaucaaccuuaagcgguagugcucaacacguggaggaaugcucuugcuauccucgcuacccaggcgucagauguguuugcagggacaacuggaagggguccaaucggccgauaguggauauuaacaucaaagaccacagcaucguaucgucuuacguguguuccggacuggucggcgacacgccccgcaagaaugauucaaguagcuccucucauugccuugacccuaacaaugaggaaggugggcacggagugaaaggcugggccuucgaugacggcaacgauguuuggauggggcgaaccauuagcgagaagucaagauugggauaugagacauuuaaagugaucgaagguuggaguaauccaaaguccaaacugcagauuaacaggcaggucauaguggaccggggcaaucguagcggguacucuggaaucuucucaguagagggcaagaguuguauuaaccgcugcuuuuauguugaacuaaucagagguaggaaggaggaaacugaggugcucuggaccagcaauuccaucgucguguucugugggacaucuggcacuuacggaaccggcucguggcccgauggggcggacauuaaccugaugccuauauga

SEQ ID NO: 141156 - RNA, 1410 nt, Artificial Sequence; identical to SEQ ID NO: 138615
  derived and/or modified sequence opt3 from neuraminidase__InfluenzaA__ADK87303

SEQ ID NO: 141157 - RNA, 1410 nt, Artificial Sequence
  derived and/or modified sequence opt3 from neuraminidase__InfluenzaA__ADK87305
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaauccaaaguccaaacugcagauuaacaggcaagugauaguaggccgggggaaucguagcggauacucuggcaucuucucaguugaggguaagaguuguauuaaccgcugcuuuuauguggaacuaaucagagggaggaaggaggaaacugagguccucuggaccagcaauuccaucguggucuucuguggcacaucuggaacuuacggcaccgggucguggcccgacggagccgauauuaaccugaugccuguguga

SEQ ID NO: 141158 - RNA, 1410 nt, Artificial Sequence
  derived and/or modified sequence opt3 from neuraminidase__InfluenzaA__ADK87307
augaaccccaaucagaaggugaucaccauuggcagcgucucccugacaauaucuacuaucugcuucuuuaugcaaauugccauccucauuacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcaucgcuuggagcaguuccucuugucaugacgguaaagccuggcuccacgugugcauuacaggggaugacaagaacgcaaccgccagcuucaucuacaauggaaggcugguagauuccguugugucauggaguaaagagauccugcggacgcaggaaagcgagugugucugcauuaacggcacuuguacaguggugaugaccgacggcucugcuuccgggaaggcagauacuaaaauacucuuuaucgaggaaggaaagauuguccauacaucaaccuuaagcgguagugcccaacacguugaggaaugcucuugcuauccucgcuacccaggcgugagauguguaugcagggacaacuggaagggguccaaucggccgaucguggauauaaacauuaaagaccacagcaucgucucgucuuacguguguuccggacugguuggcgacacgccccgcaagaaugauucaaguagcuccucucauugccuugacccuaacaaugaggaaggugggcacggagugaaaggcugggcuuucgaugacggcaacgaugucuggauggggcgaaccaucagcgagaagucaagauugggauaugagacauuuaaagugauugaagguuggaguaauccaaaguccaaacugcagaucaacaggcagguaauuguuggccgggggaaucguagcggauacucuggcauauucucaguggaggguaagaguuguaucaaccgcugcuuuuaugucgaacuaauugggggcagaaaggaggaaacugaggugcucuggaccagcaauuccaucgucguguucuguggaacaucuggcacuuacgggaccggaucguggcccgacggugccgauaucaaccugaugccuguuuga

SEQ ID NO: 141159 - RNA, 1410 nt, Artificial Sequence
  derived and/or modified sequence opt3 from neuraminidase__InfluenzaA__ADK87312
augaaccccaaucagaccaucauuacaauaggcagcgugugcaugacuaucgggauggccaaccugauucuccaaaucggaaauauuaucuccauauggaucucucacucaauucagcuugguaaccagaaucagaucgagacguguaaccaaagugucauuaccuacgaaaauaacacauggguuaaucagacuuaugugaacaucagcaauaccaacuucgcugcaggccaguccguaauaucugugaagcuggccggaaauucgucauugugcccugucagcgggugggcgauuuacaguaaagacaacaauaucagaauuggcuccaagggugauguguuuguuaucagggagccauucaucucuuguagcccguuagaaugccggacauuuuuccugacccagggggcucuacucaacgacaaacauuccaacggaacuauuaaggaucgcucacccuaucgaacacugaugaguuguccuauaggcgaggugccaagccccuacaauucucguuuugaauccgucgccuggucagcaagcgccugccacgacggcaucaacuggcuuaccauugggaucaguggaccugauaauggugcuguggcaguacugaaauauaacggcauaauuacggacacuaucaagucuuggagaaauaacaucuugaggacccaagaguccgagugugccugcguuaaugggagcuguuucacagugaugacugauggaccaucggacggccaggcuucuuacaagauuuuucggaucgaaaaagguaagauugucaaauccguggagaugaacgcccccaauuaucauuacgaagagugcucauguuacccugauaguagcgagauaaccugcgugugccgcgacaacuggcacggguccaauagaccaugggucucuuucaaccagaaucucgaauaucagaucggauacauuuguagcggcaucuuuggcgauaacccgaggcccaaugacaagacagggucaugcggaccuguuaguuccaacggugcgaacggcgugaaaggguucagcuuuaaguauggaaauggcguauggaucggucggaccaagucuauuucaagucgcaacggguucgagaugauaugggauccaaauggcuggacgggaacugacaacaauuuuagcaucaaacaagacauugugggcaucaacgaaugguccggguacucuggaucguucguccagcaucccgagcugacaggucuggauuguauucgaccuugcuucuggguggaacucaucagaggcaggccaaaggagaauaccauauggacuagcggguccucaaucaguuuuuguggaguuaacucugacacagugggcuggagcuggcccgauggugcagaguuaccguucaccauugacaaauga

SEQ ID NO: 141160 - RNA, 1410 nt, Artificial Sequence
  derived and/or modified sequence opt3 from neuraminidase__InfluenzaA__ADK87314
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgaggggaauauuaccgaaaucguguauuugacaaacaccacuauugagaaggaaaugugccccaaauuagcugaguacagaaauuggaguaagccucagugugacaucacaggauucgcaccauuuagcaaagauaacuccauaaggcugucugccgguggcgacauuuggguaacccgggagcccuaugugucgugcgauccugacaaguguuaccaauucgcgcuagggcagggaacgacucucaauaacguccauucaaauaacaccgugcgcgaucgaacaccauaucguacucugcuuaugaaugaacugggcguucccuuucacuuggguaccaaacaggugugcaucgcuuggagcaguuccucuugucaugacgggaaggccuggcuccacgucugcauuacaggagaugacaagaacgcaaccgccagcuucaucuacaauggcagacugguggauuccguaguuucauggaguaaagagauccugaggacgcaggaaagcgagugugugugcauuaacggcacuuguacagucgugaugaccgacgggucugcuuccggaaaggcagauacuaaaauacucuuuaucgaggaagguaagauugugcauacaucaaccagcaguggcucugcccaacacgucgaggaaugcuccugcuauccucgguacccagggguucgcugugugugcagagacaacuggaagggaagcaauaggccgaucguagauauaaacauuaaagaccacucgaucgugucuuccuacgucuguucaggcuuagugggugacacgccccggaagaaugauaguagcuccucuagccauugccuggacccuaacaaugaggaagggggacacggcguuaaaggcugggcuuucgaugacgggaacgauguguggaugggacgcaccaucucagagaagagucgacuugguuaugagacauuuaaagucauugaaggcugguccaauccaaagagcaaauugcagaucaacagacaggugauuguagacagggggaaucggucuggauacucaggcauauucaguguugaggguaagagcuguaucaaccguugcuuuuauguggaacugauucgcgggagaaaggaggaaacugagguccuauggaccuccaauucuaucguggucuucuguggcacaucgggaacuuacggcaccgggagcuggcccgauggagccgacaucaaccucaugccuguguga

SEQ ID NO: 141161 - RNA, 1410 nt, Artificial Sequence
  derived and/or modified sequence opt3 from neuraminidase__InfluenzaA__ADK87316
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagaucacuggucuggauuguauucgaccuugcuucuggguugaacugaucagaggcaggccaaaagagaacacaauauggaccuccgggucaaguaucucuuuuuguggagugaauagcgacacugucggcugguccuggcccgauggugcagagcucccguucacaauugacaaguga

SEQ ID NO: 141162 - RNA, 1410 nt, Artificial Sequence
  derived and/or modified sequence opt3 from neuraminidase__InfluenzaA__ADK87318
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuccuggguugaacucauuagaggcaggccaaaagagaacacaaucuggaccucagggaguucuacuagcuucuguggagucaauuccgacacagugggcuggucauggcccgauggugcagaguuaccguuuaccauagacaaguga

SEQ ID NO: 141163 - RNA, 1410 nt, Artificial Sequence
  derived and/or modified sequence opt3 from neuraminidase__InfluenzaA__ADK87320
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguucaucagacauaugugaauaucagcaacacuaauuucgcugcaggccaguccguagugucugucaaacuggccgggaacucgucauugugcccugugagcggaugggcgauauacaguaaggacaauuccauuagaaucggcucuaaaggugauguuuuugugauuagggagccauucaucagcuguuccccguuagaaugccggaccuuuuuccugacacagggggcucuacucaacgacaagcacucaaauggaaccaucaaagaucgcagucccuaucgaacucugaugagcuguccuauuggcgaggucccaucucccuacaacucccguuuugaaucaguggccuggagcgcaagugccugccaugacggcauaaacuggcuuacaaucgggauuucuggaccugauaauggugcuguagcaguucugaaguauaacggcaucauaaccgacacgauuaaguccuggagaaauaacaucuugaggacucaagagagcgagugugccugcgugaaugggucguguuucaccgucaugacagauggaccaucugacggccaggcuuccuacaaaaucuuucggauugaaaaggguaaaaucgugaagucaguggagaugaacgcccccaauuaucacuacgaagagugcaguuguuacccugauagcuccgagauuacuugcgucugccgcgacaacuggcaugggucuaauagaccauggguuagcuucaaccagaaucucgaauaucagauaggauacaucuguucaggcauuuuuggcgauaacccgaggcccaaugacaaaaccgggaguugcggaccuguguccagcaacggugcgaauggcguaaagggguucucuuuuaaguauggaaacggcguguggaucggucggacaaaaucaaucaguagccgcaacggguucgagaugauuugggauccaaauggcuggaccggaacggacaacaauuuuuccauaaagcaagacaucgucggcauuaacgaauggucuggguacucggguagcuucgugcagcaccccgagcugacuggacugaauuguauccgaccuugcuucuggguugaacucauuagaggcaggccaaaagagaacacaaucuggaccuccgggucaaguauaucuuuuuguggagugaauagcgauacugucggcugguccuggcccgacggugcagaguuaccguucacaaucgauaaguga

SEQ ID NO: 141164 - RNA, 1410 nt, Artificial Sequence
  derived and/or modified sequence opt3 from neuraminidase__InfluenzaA__ADK87324
augaaccccaaucagaagaucauuaccauaggcagcgugucccugacaaucucuacuauuugcuuccucaugcagaucgccauucuuaucacgaccgucacacugcacuuuaaacaguacgaguucaacucaccuccaaauaaccagguuauguugugugaaccgacuauaaucgagagaaauauuaccgaaaucguguauuuaacaaacaccacuauugagaaggaaaucugccccaaacuggcugaguacaggaauuggaguaagccucagugugacauaacaggguuugcaccauucagcaaagauaacuccauucggcuaucugccggaggugacaucuggguaacccgcgagcccuaugugucgugcgauccuggcaaguguuaccaauuugcgcucgggcagggaacgacucugaauaacguccauucaaauaacaccgugcgagaccguacaccauauagaacucuucugaugaaugaauugggcguucccuuccaccucgguaccaaacaggugugcauugcuuggagcaguuccucuugucaugaugggaaggccuggcugcacgucugcaucacaggagacgaugagaacgcaaccgccagcuuuaucuacaauggcaggcugguggacuccguaguuucauggaguaaggaaauucuccggacgcaggagagcgagugugugugcauaaacggcacuuguacagucgugaugaccgaugggucugcuuccggaaaagcagacacuaagaucuuauucauugaagaggguaaaaucgugcauacaucaacccugagcggcagugcccaacacgucgaagagugcucuugcuauccucgcuacccagggguuagaugugugugcagggauaacuggaagggauccaaucggccgauaguagacauuaacaucaaggaucacagcaucgugucgucuuacgucuguuccggccuugugggugacacgccccgcaaaaaugacucaaguagcuccucucauugcuuggauccuaacaaugaagaagggggacacggcguuaagggcugggcuuuugacgaugggaacgacguguggaugggacgaaccauuagcgagaaaucaagacuggguuaugagacauucaaggucaucgagggcuggaguaauccaaaauccaagcuacagauuaacaggcaagugauaguagaucgggggaaucguagcggauacucuggcaucuuuucaguugaagguaaaaguuguauuaaccgcugcuucuauguggagcucaucagagggaggaaggaagagacugagguccuguggaccagcaauuccaucguggucuuuuguggcacaucuggaacuuacggcaccgggucguggcccgacggagccgauauuaaccuuaugccuguguga

SEQ ID NO: 141165 - RNA, 1410 nt, Artificial Sequence
  derived and/or modified sequence opt3 from neuraminidase__InfluenzaA__ADK87327
augaaccccaaucagaagaucaugaccauuggcagcgugucccugacaauaucuacuaucugcuucuuuaugcaaauugccauccucauuacgaccgucacacuucacuucaaacaguacgaguuuaacucaccuccaaauaaccagguuaugcugugugaaccgacuaucauagagagaaauaucaccgaaauuguguauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcaucgcuuggagcaguuccucuugucaugacgguaaggccuggcuccacgucugcauuacaggggaugacaagaacgcaaccgccagcuucaucuacaauggaaggcugguggauuccguaguuucauggaguaaagagauccugcggacgcaggaaagcgagugugugugcauuaacggcacuuguacagucgugaugaccgacggcucugcuuccgggaaggcagauacuaaaauacucuuuaucgaggaaggaaagauugugcauacaucaaccuuaagcgguagugcccaacacgucgaggaaugcucuugcuauccucgcuacccaggcguuagaugugugugcagggacaacuggaagggguccaaucggccgaucguagauauaaacauuaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccaucagcgagagaucaagguugggauaugagacauuuaaggucauugaagguuggaguaauccaaaauccaagcugcagaucaaccgucaggugauuguagaccggggcaaucgcagcggguacucuggaauauucucaguugagggcaaaaguuguaucaacagaugcuuuuauguggaacuaauuaggggucggaaggaggaaacugagguccucuggaccagcaauuccaucguggucuucugugggacaucuggcacuuacggaaccggcucguggcccgauggggccgacaucaaccugaugccuguguga

SEQ ID NO: 141166 - RNA, 1410 nt, Artificial Sequence; identical to SEQ ID NO: 138754
  derived and/or modified sequence opt3 from neuraminidase__InfluenzaA__ADK87329

SEQ ID NO: 141167 - RNA, 1410 nt, Artificial Sequence
  derived and/or modified sequence opt3 from neuraminidase__InfluenzaA__ADK87330
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucugggcauccgggucaaguauaucuuuuuguggagugaauagcgacaccgucggcugguccuggcccgauggugccgaguuaccguucacuaucgacaaguga

SEQ ID NO: 141168 - RNA, 1410 nt, Artificial Sequence; identical to SEQ ID NO: 138754
  derived and/or modified sequence opt3 from neuraminidase__InfluenzaA__ADK87331

SEQ ID NO: 141169 - RNA, 1410 nt, Artificial Sequence
  derived and/or modified sequence opt3 from neuraminidase__InfluenzaA__ADK87332
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaagcauaauggcaucauaaccgacacgauuaaguccuggagaaacaauaucuugaggacucaagagagcgagugugccugcgugaacgggucguguuucaccgucaugacagauggaccaucugacggccaggcuuccuauaaaaucuuucggauugaaaaggguaaaaucgugaagucaguggagaugaaugcccccaacuaccacuaugaagagugcaguuguuacccugauagcuccgagauuacuugcgucugccgcgacaauuggcaugggucuaacagaccauggguuagcuucaaucagaaccucgaauaccagauaggauauaucuguucaggcauuuuuggcgauaauccgaggcccaacgacaaaaccgggaguugcggaccuguguccagcaauggugcgaacggcguaaagggguucucuuuuaaguacggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguauucggggagcuucgugcagcaccccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 141170 - RNA, 1410 nt, Artificial Sequence
  derived and/or modified sequence opt3 from neuraminidase__InfluenzaA__ADK87333
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccuuauagcuccgagauuacuugcgucugccgcgauaauuggcacgggucuaacagaccauggguuagcuucaaucagaaccucgaauaccagauaggauauaucuguucaggcauuuuuggcgacaauccgaggcccaacgauaaaaccgggaguugcggaccuguguccagcaauggugcgaacggcguaaagggguucucuuuuaaguacggaaacggcguguggaucggucggacaaaaucaaucaguagccgcaauggguucgagaugauuugggacccaaacggcuggaccggaacggauaauaacuuuuccauaaagcaagacaucgucggcauuaaugaauggucuggguauucggggagcuucgugcagcaucccgagcugacuggucuggacuguauccgaccuugcuucuggguugaacucauuagaggcaggccaaaagagaacacaaucuggaccuccgggucaaguauaucuuuuuguggagugaauagcgauacugucggcugguccuggcccgacggugcagaguuaccguucacaaucgauaaguga

SEQ ID NO: 141171 - RNA, 1410 nt, Artificial Sequence
  derived and/or modified sequence opt3 from neuraminidase__InfluenzaA__ADK87335
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugaccgacguuaccaauucgcgcuaggccaggggacgacucucaauaacguccauucagauaauaccgugagagacaggacaccauaucggacucugcuuaugaacgaacugggaguucccuuucacuugggcaccaaacagguguguauugcuuggagcaguuccucuugccaugaugguaaggccuggcuccacgucuguaucacaggggacgauaaaaaugcaaccgccagcuucaucuacaacggacgccugguggacuccguaguuucauggaguaaggagauucugagaacgcaggaaagcgagugcguguguauaaauggcacuugcacagucgugaugaccgauggcucugcuuccgggaaagcagacacuaagauccucuuuauugaggaaggaaaaaucgugcauacaucaaccuuaagcgguaacgcccaacacgucgaggaauguaguugcuauccuagguacccaggcguucggugcgugugucgcgauaacuggaaggggucuaaucgaccgauaguagacauuaacaucaaggaccacuccaucgugagcucguacgucugcucuggacuggugggcgauacgcccagaaagaaugacuccucaaguagcucccauugucuugauccuaacaaugaggaaggugggcacggaguuaagggcugggcuuucgacgauggcaacgacguguggauggggaggaccauuucugagaaaagccgguugggauaugagacauuuaaggucaucgaagguuggucaaauccaaaaaguaagcugcagauuaaccgucaggugauaguagaucgcggcaauagauccggguacagcggaaucuucucuguugagggcaaaucaugcauuaacagguguuuuuauguggaacuaauccggggucgaaaggaggaaacugagguccucuggaccaguaauagcaucguggucuucugcgggacauccggcacuuacggaaccggcucuuggcccgacggggccgauauuaaccugaugccuauauga

SEQ ID NO: 141172 - RNA, 1410 nt, Artificial Sequence
  derived and/or modified sequence opt3 from neuraminidase__InfluenzaA__ADK87337
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacgcugugcgagaucguaccccauauagaacacugcuuaugaaugaacugggaguucccuuucacuugggcacuaaacaggugugcauugccuggagcaguuccucuugucaugacgguaaggcauggcuccacgucugcaucaccggggaugacaagaacgccacagcuagcuucaucuacaauggaaggcugguggauuccguaguuucauggaguaaagagauucugcggacccaggaaagcgagugugugugcauaaacggcacguguacugucgugaugacagacggcucugcauccgggaaggccgauaccaaaauccucuuuauugaggaaggaaagaucgugcauacuucaacauuaagcgguaacgcucaacacgucgaggaaugcaguugcuauccucgcuacccaggcguuagaugugugugcagggacaauuggaaggggucuaaccggccgauaguagauauuaauaucaaagaccacuccaucgugagcucguacgucuguucuggacuggugggcgacacccccaggaagaacgauuccucaaguagcucccauugccuugacccuaauaacgaggaaggugggcacggaguuaaaggcugggccuucgaugacggcaaugauguguggauggggcgaacgauuucugagaagaguagauugggauaugagaccuuuaaagucaucgaagguuggucaaacccaaagaguaaacugcagauuaaucgccaggugauaguagaccggggcaaccguuccggguacagcggaaucuucucuguugagggcaagucauguauuaaucgcugcuuuuauguggaacuaaucagagguaggaaggaggaaacagagguccucuggacuagcaacagcaucguggucuucugugggaccuccggcacauacggaacuggcucuuggcccgauggggcggacauuaaucugaugccuauauga

SEQ ID NO: 141173 - RNA, 1410 nt, Artificial Sequence
  derived and/or modified sequence opt3 from neuraminidase__InfluenzaA__ADK87339
augaaccccaaucagaagaucauuaccauaggcagcaucugcaugacaauugggauggccaaccugauccuccaaauuggaaauaucauauccaucuggauuucucacucaauccagcuugguaaccagaaucagauugagacuuguaaccaaagugugaucacguacgaaaauaacaccugggucaaucagacauauguuaacauaagcaauacuaacuucgcugcaggccaguccgugguaucugugaaacuggccggaaauucgucauugugcccugucagcggaugggcgauuuacaguaaggacaacuccaucagaauuggcucuaaaggugauguguuuguuaucagggagccauucaucagcuguuccccguuagaaugccggaccuuuuuccugacacagggggcucuacucaaugacaagcauucaaacggaaccauuaaagaucgcagucccuaucgaacucugaugagcuguccuauaggcgaggugccaucucccuacaacucccguuuugaaucagucgccuggagcgcaagugccugccacgacggcaucaauuggcuuacaauugggaucucuggaccugauaacggugcuguggcaguacugaaguauaauggcauaauuaccgacacgaucaaguccuggagaaacaauaucuugaggacucaagagagcgagugugccugcguuaacgggucguguuucaccgugaugacagauggaccaucugacggccaggcuuccuacaaaauuuuucggaucgaaaaggguaaaauugucaagucaguggagaugaaugcccccaacuaucauuacgaagagugcaguuguuacccugauagcuccgagauaacuugcgugugccgcgacaauuggcacgggucuaacagaccaugggucagcuucaaucagaaccucgaauaucagaucggauacauuuguucaggcaucuuuggcgauaauccgaggcccaacgacaaaaccgggaguugcggaccuguuuccagcaauggugcgaacggcgugaagggguucucuuuuaaguauggaaacggcguauggaucggucggacaaaaucaauuaguagccgcaauggguucgagaugauaugggauccaaacggcuggaccggaacggacaauaacuuuuccaucaagcaagacauugugggcaucaaugaauggucuggguacucggggagcuucguccagcaucccgagcugacuggucuggauuguauucgaccuugcuucuggguggaacucaucagaggcaggccaaaagagaacacaauauggaccuccgggucaaguaucucuuuuuguggaguuaauagcgacacugugggcugguccuggcccgauggugcagaguuaccguucacaauugacaaguga

SEQ ID NO: 141174 - RNA, 1410 nt, Artificial Sequence; identical to SEQ ID NO: 138754
  derived and/or modified sequence opt3 from neuraminidase__InfluenzaA__ADK90209

SEQ ID NO: 141175 - RNA, 1410 nt, Artificial Sequence; identical to SEQ ID NO: 138754
  derived and/or modified sequence opt3 from neuraminidase__InfluenzaA__ADK90213

SEQ ID NO: 141176 - RNA, 1410 nt, Artificial Sequence; identical to SEQ ID NO: 138754
  derived and/or modified sequence opt3 from neuraminidase__InfluenzaA__ADK90217

SEQ ID NO: 141177 - RNA, 1410 nt, Artificial Sequence; identical to SEQ ID NO: 140733
  derived and/or modified sequence opt3 from neuraminidase__InfluenzaA__ADK90221

SEQ ID NO: 141178 - RNA, 1410 nt, Artificial Sequence; identical to SEQ ID NO: 140733
  derived and/or modified sequence opt3 from neuraminidase__InfluenzaA__ADK90225

SEQ ID NO: 141179 - RNA, 1410 nt, Artificial Sequence; identical to SEQ ID NO: 138754
  derived and/or modified sequence opt3 from neuraminidase__InfluenzaA__ADK90229

SEQ ID NO: 141180 - RNA, 1410 nt, Artificial Sequence; identical to SEQ ID NO: 138754
  derived and/or modified sequence opt3 from neuraminidase__InfluenzaA__ADK90233

SEQ ID NO: 141181 - RNA, 1410 nt, Artificial Sequence
  derived and/or modified sequence opt3 from neuraminidase__InfluenzaA__ADK90241
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaaugcuaacuucgcagccggccaguccguagugucugucaaacuggcgggaaauucgucauugugcccugugagcggaugggcuauauacaguaaggacaacuccauuagaaucggcucuaaaggugauguuuuugugauuagggagccauucaucagcuguuccccguuagaaugccggaccuuuuuccugacucagggggcccuacucaaugacaagcauucaaacggaacaaucaaagaucgcaguccccaccgaacccugaugagcuguccuauuggcgaggucccaucucccuauaacucccguuuugaaucaguggcauggagcgccagugcuugccaugacggcauaaauuggcuuacuaucgggauuucuggaccugauaacggugcaguagccguucugaaguacaauggcaucauaacagacaccauuaaguccuggagaaacaauaucuugaggacgcaagagagcgagugugcuugcgugaacgggucguguuucacugucaugaccgauggaccaucugacggccaggccuccuauaaaaucuuucggauugaaaaggguaaaaucgugaagucaguggagaugaaugcgcccaacuaccacuaugaagagugcaguuguuacccugauagcuccgagauuacaugcgucugccgcgacaauuggcaugggucuaacagaccauggguuagcuucaaucagaaccucgaauaccagauaggauauaucuguucaggcauuuuuggcgauaauccgaggcccaacgacaaaacugggaguugcggaccuguguccagcaauggugcaaacggcguaaagggguucucuuuuaaguacggaaacggcguguggaucggucggaccaaaucaaucaguagccgcaauggguucgagaugauuugggauccaaacggcuggacaggaaccgacaauaacuuuuccauaaagcaagacaucgucggcauuaaugaauggucuggguauucggggagcuucgugcagcaccccgagcugacgggucuggauuguauccgaccuugcuucuggguugaacucauuagaggcaggccaaaagagaacacuaucuggacauccgggucaaguauaucuuuuuguggagugaauagcgacaccgucggcugguccuggcccgauggugccgaguuaccguucacuaucgacaaguga

SEQ ID NO: 141182 - RNA, 1410 nt, Artificial Sequence; identical to SEQ ID NO: 140733
  derived and/or modified sequence opt3 from neuraminidase__InfluenzaA__ADK90245

SEQ ID NO: 141183 - RNA, 1410 nt, Artificial Sequence
  derived and/or modified sequence opt3 from neuraminidase__InfluenzaA__ADK90249
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccaugaagcaagacauagucggcaucaaugaauggucuggguacucggggagcuucgugcagcaucccgagcugacuggucuggauuguauucgaccuugcuucuggguugaacucaucagaggcaggccaaaagagaacacaauuuggaccuccgggucaaguaucucuuuuuguggagugaauagcgacacugucggcugguccuggcccgauggugcagaguuaccguucacaauagacaaguga

SEQ ID NO: 141184 - RNA, 1410 nt, Artificial Sequence; identical to SEQ ID NO: 141183
  derived and/or modified sequence opt3 from neuraminidase__InfluenzaA__ADK90253

SEQ ID NO: 141185 - RNA, 1410 nt, Artificial Sequence
  derived and/or modified sequence opt3 from neuraminidase__InfluenzaA__ADK90257
augaaccccaaucagaagaucauuauaaucggcagcgugugcaugaccauugggauggccaaccugauccuccaaauuggaaauaucauauccaucuggauuucucacucaauccagcuugguaaccagaaucagauugagacauguaaccaaagugucaucacuuacgaaaauaacacguggguuaaucagaccuaugugaacauaagcaauacaaacuucgcugcaggccaguccguagugucugucaaacuggccggaaauucgucauugugcccugugagcggaugggcgauuuacaguaaggacaacuccaucagaauuggcucuaaaggugauguuuuugugaucagggagccauucaucagcuguuccccguuagaaugccggaccuuuuuccugacucagggggcucuacucaaugacaagcauucaaacggaacaauuaaagaucgcaguccccaccgaacccugaugagcuguccuauaggcgaggucccaucucccuauaacucccguuuugaaucaguggccuggagcgcaagugccugccaugacggcaucaauuggcuuacuauugggaucucuggaccugauaacggugcuguagcaguucugaaguacaauggcauaauuacagacaccaucaaguccuggagaaacaauaucuugaggacgcaagagagcgagugugccugcgugaacgggucguguuucacugucaugaccgauggaccaucugacggccaggcuuccuauaaaauuuuucggaucgaaaaggguaaaauugugaagucaguggagaugaaugcccccaacuaccacuaugaagagugcaguuguuacccugauagcuccgagauaacaugcgucugccgcgacaauuggcaugggucuaacagaccauggguuagcuucaaucagaaccucgaauaccagaucggauauauuuguucaggcaucuuuggcgauaauccgaggcccaacgacaaaacugggaguugcggaccuguguccagcaauggugcgaacggcguaaagggguucucuuuuaaguacggaaacggcguguggaucggucggaccaaaucaauuaguagccgcaauggguucgagaugauaugggauccaaacggcuggacaggaaccgacaauaacuuuuccaucaagcaagacauugucggcaucaaugaauggucuggguauucggggagcuucgugcagcaccccgagcugacgggucuggauuguauucgaccuugcuucuggguugaacucaucagaggcaggccaaaagagaacacuauauggacauccgggucaaguaucucuuuuuguggagugaauagcgacaccgucggcugguccuggcccgauggugcagaguuaccguucacuauugacaaguga

SEQ ID NO: 141186 - RNA, 1410 nt, Artificial Sequence; identical to SEQ ID NO: 139108
  derived and/or modified sequence opt3 from neuraminidase__InfluenzaA__ADK90261

SEQ ID NO: 141187 - RNA, 1410 nt, Artificial Sequence
  derived and/or modified sequence opt3 from neuraminidase__InfluenzaA__ADK90265
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagaugggauacauauguucaggcaucuuuggcgauaauccgaggcccaacgacaaaaccgggaguugcggaccuguguccagcaauggugcgaacggcguaaagggguucucuuuuaaguauggaaacggcguguggauuggucggacaaaaucaaucaguagccgcaauggguucgagaugaucugggauccaaacggcuggaccggaacggacaauaacuuuuccauuaagcaagacauagucggcaucaaugaauggucuggguacucggggagcuucgugcagcaucccgagcugacuggucuggauuguauucgaccuugcuucuggguugaacucaucagaggcaggccaaaagagaacacaauuuggaccuccgggucaaguaucucuuuuuguggagugaauagcgacacugucggcugguccuggcccgauggugcagaguuaccguucacaauagacaaguga

SEQ ID NO: 141188 - RNA, 1410 nt, Artificial Sequence
  derived and/or modified sequence opt3 from neuraminidase__InfluenzaA__ADK90269
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagaaauguaaccaaagugucauuacuuacgaaaauaacacguggguuaaucagaccuaugugaacaucagcaauacaaacuucgcugcaggccaguccguagugucugucaagcuggccggaaauucgucauugugcccugugagcggaugggcgauauacaguaaagacaacuccauuagaaucggcucuaagggugauguuuuugugauuagggagccauucaucagcuguuccccguuagaaugccggaccuuuuuccugacucagggggcucuacucaaugacaaacauucaaacggaacaaucaaggaucgcagucccuaucgaacccugaugagcuguccuauuggcgaggucccaucucccuacaacucccguuuugaaucaguggccuggagcgcaagugccugccacgacggcauaaauuggcuuacuaucgggauuucuggaccugauaacggugcuguagcaguucugaaguauaauggcaucauaacagacaccauuaaauccuggagaaacaauaucuugaggacgcaagagagcgagugugccugcgugaacgggucguguuucacugucaugaccgauggaccaucugacggccaggcuuccuacaagaucuuucggauugaaaaagguaagaucgugaaaucaauugagaugaaugcccccaacuaucauuacgaagagugcaguuguuacccugauagcuccgagauaacaugcgugugccgcgacaauuggcacgggucuaacagaccaugggucagcuucaaucagaaccucgaauaucagaucggauacauuuguucaggcaucuuuggcgauaauccgaggcccaacgacaagacugggaguugcggaccuguuuccagcaauggugcgaacggcgugaagggguucucuuuuaaauauggaaacggcguauggaucggucggaccaagucaauuaguagccgcaauggguucgagaugauaugggauccaaacggcuggacaggaaccgacaauaacuuuuccaucaaacaagacauugugggcaucaaugaauggucuggguacucggggagcuucguccagcaucccgagcugacgggucuggauuguauucgaccuugcuucuggguggaacucaucagaggcaggccaaaggagaacacuauauggacauccgggucaaucauuaguuuuuguggaguuaauucugacaccgugggcuggagcuggcccgauggugcagaguuaccguucacuaucgacaaauga

SEQ ID NO: 141189 - RNA, 1410 nt, Artificial Sequence; identical to SEQ ID NO: 138754
  derived and/or modified sequence opt3 from neuraminidase__InfluenzaA__ADK90273

SEQ ID NO: 141190 - RNA, 1410 nt, Artificial Sequence; identical to SEQ ID NO: 138754
  derived and/or modified sequence opt3 from neuraminidase__InfluenzaA__ADK90277

SEQ ID NO: 141191 - RNA, 1410 nt, Artificial Sequence; identical to SEQ ID NO: 138754
  derived and/or modified sequence opt3 from neuraminidase__InfluenzaA__ADK90281

SEQ ID NO: 141192 - RNA, 1410 nt, Artificial Sequence
  derived and/or modified sequence opt3 from neuraminidase__InfluenzaA__ADK90289
augaaccccaaucagaagaucauuaccauaggcagcgugugcaugacaaucgggauggccaaccugauucuccaaaucggaaauauuaucuccauauggaucucucacucaauucagcuugguaaccagaaucugaucgagacuuguaaccagagugucauuacguacgaaaauaacaccuggguuaaucaaacauaugugaacaucagcaauacuaacuucgcugcaggccaguccguagugucugucaaauuggccggaaauucgucauuaugcccugugagcggaugggcgauauacaguaaggacaacuccauuagaaucggcucuaaaggugauguuuuugugauuagggagccauucaucagcuguuccccgcuggaaugccggaccuuuuuccuaacacagggggcucuccugaaugacaagcauucaaacggaaccaucaaagaucgcagucccuaucgaacucuuaugagcuguccuauuggcgaggucccaucucccuacaacucccguuuugaaucaguggccuggagcgcaagugccugccacgacggcauaaauuggcugacaaucgggauuucuggaccugauaacggugcuguagcaguuuugaaguauaauggcaucauaaccgacacgauuaaguccuggagaaacaauauccucaggacucaggagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucaaaaccuggaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaggacaucgucggcauuaaugaauggucuggguacucggggagcuucgugcaacaucccgagcugacuggucucgauuguauccgaccuugcuucuggguugaauuaauuagaggcaggccaaaagagaacacaaucuggaccuccgggucaaguauaucuuuuuguggagugaauagcgacacugucggcugguccuggcccgauggugcagagcugccguucacaaucgacaaguga

SEQ ID NO: 141193 - RNA, 1410 nt, Artificial Sequence; identical to SEQ ID NO: 140733
  derived and/or modified sequence opt3 from neuraminidase__InfluenzaA__ADK90293

SEQ ID NO: 141194 - RNA, 1410 nt, Artificial Sequence; identical to SEQ ID NO: 140645
  derived and/or modified sequence opt3 from neuraminidase__InfluenzaA__ADK90297

SEQ ID NO: 141195 - RNA, 1410 nt, Artificial Sequence; identical to SEQ ID NO: 138754
  derived and/or modified sequence opt3 from neuraminidase__InfluenzaA__ADK90301

SEQ ID NO: 141196 - RNA, 1410 nt, Artificial Sequence; identical to SEQ ID NO: 140645
  derived and/or modified sequence opt3 from neuraminidase__InfluenzaA__ADK90305

SEQ ID NO: 141197 - RNA, 1410 nt, Artificial Sequence; identical to SEQ ID NO: 138754
  derived and/or modified sequence opt3 from neuraminidase__InfluenzaA__ADK90309

SEQ ID NO: 141198 - RNA, 1410 nt, Artificial Sequence
  derived and/or modified sequence opt3 from neuraminidase__InfluenzaA__ADK90313
augaaccccaaucacaagaucauuaccauaggcagcgugugcaugacaaucgggauggccaaccugauucuccagaucggaaauauuaucuccauauggaucucucauucaauucaacuugguaaccagaaucagaucgagacuuguaaccagagugucauuacguacgaaaauaacaccuggguuaaucaaacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcacucaaacggaaccaucaaagaucgcaguccccaucgaacucugaugagcuguccuauuggcgaggucccaucucccuauaacucccguuuugaaucaguggccuggagcgcaagugccugccacgacggcauaaauuggcuuacaaucgggauuucuggaccugauaacggugcuguagcaguucugaaguacaauggcaucauaaccgacacgauuaaguccuggagaaacaauaucuugaggacucaggagagcgagugugccugcgugaacgggucguguuucaccgucaugacagauggaccaucugacggccaggcuuccuauaaaaucuuucggauugaaaaggguaaaaucgugaagucaguggagaugaaugcccccaacuaccauuaugaagagugcaguuguuacccugauagcuccgagauuacuugcgucugccgcgacaauuggcacgggucuaacagaccauggguuagcuucaaucaaaaccucgaauaccagauaggauauaucuguucaggcauuuuuggcgauaauccgaggcccaacgacaaaaccgggaguugcggaccuguguccagcaauggugcgaacggcguaaagggguucucuuuuaaguacggaaacggcguguggaucggucggacaaaaucaaucaguagccgcaauggguucgagaugauuugggauccaaacggcuggaccggaacggacaauaacuuuuccauaaagcaggacaucgucggcauuaaugaauggucuggguauucggggagcuucgugcaacaccccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaaucgacaaguga

SEQ ID NO: 141199 - RNA, 1410 nt, Artificial Sequence; identical to SEQ ID NO: 138754
  derived and/or modified sequence opt3 from neuraminidase__InfluenzaA__ADK90317

SEQ ID NO: 141200 - RNA, 1410 nt, Artificial Sequence; identical to SEQ ID NO: 140733
  derived and/or modified sequence opt3 from neuraminidase__InfluenzaA__ADK90321

SEQ ID NO: 141201 - RNA, 1410 nt, Artificial Sequence; identical to SEQ ID NO: 138754
  derived and/or modified sequence opt3 from neuraminidase__InfluenzaA__ADK90325

SEQ ID NO: 141202 - RNA, 1410 nt, Artificial Sequence
  derived and/or modified sequence opt3 from neuraminidase__InfluenzaA__ADK90329
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaacagaagugucauuacguacgaaaauaacaccuggguuaaucaaacauaugugaacaucagcaauacuaacuucgcugcaggccaguccguagugucugucaaacuggccggaaauucgucauugugcccugugagcgggugggcgauauacaguaaggacaacuccauuaggaucggcucuaaaggugauguuuuugugauucgggagccauucaucagcuguuccccguuagaaugccgcaccuuuuuccugacacagggggcucuacucaaugacaagcauucaaacggaaccaucaaagaucgaagucccuaucguacucugaugagcuguccuauuggcgaggucccaucucccuacaacuccagauuugaaucaguggccuggagcgcaagugccugccacgacggcauaaauuggcuuacaaucgggauuucuggaccugauaacgaggcuguagcaguucugaaguauaaugguaucauaaccgacacgauuaaguccuggaggaacaauaucuugcggacucaggagagcgaaugugccugcgugaacggcucguguuucaccgucaugacagaugggccaucugacggacaggcuuccuacaaaaucuuucgcauugagaagggcaaaaucgugaagucaguggaaaugaaugcccccaacuaucauuacgaggagugcaguuguuacccugauagcuccgaaauuacuugcgucugcagagacaauuggcacgguucuaacaggccauggguuagcuucaaucaaaaccucgaguaucagauaggguacaucuguucaggaauuuuuggcgauaauccgcggcccaacgacaaaaccggcaguugcgggccuguguccagcaauggagcgaacgguguaaagggcuucucuuuuaaguaugggaacggaguguggaucggccgcacaaaaucaaucaguagccgaaaugguuucgaaaugauuugggauccaaacggguggaccggcacggacaauaacuuuuccauaaagcaggacaucgucggaauuaaugaguggucuggcuacucggggagcuucgugcaacaucccgaacugacuggacuggauuguaucagaccuugcuucuggguugagcucauuaggggucggccaaaagagaacacaaucuggaccuccggcucaaguauaucuuuuuguggggugaauagcgacacugucggaugguccuggcccgauggcgcagaauuaccguucacaaucgacaaguga

SEQ ID NO: 141203 - RNA, 1410 nt, Artificial Sequence
  derived and/or modified sequence opt3 from neuraminidase__InfluenzaA__ADK90333
augaaccccaaucagaagaucauuaccauaggcagcgugugcaugacaaucgggauggccaaccugauucuccaaaucggaaauauuaucuccauauggaucucucacucaauucagcuugguaacaaaaaucagaucgagacuuguaaccagagugucauuacguacgaaaauaacaccuggguuaaucaaacauaugugaacaucagcaauacuaacuucgcugcaggccaguccguagugucugucaagcuggccggaaauucgucauugugcccugugagcggaugggcgauauacaguaaagacaacuccauuagaaucggcucuaagggugauguuuuugugauuagggagccauucaucagcuguuccccguuagaaugccggaccuuuuuccugacacagggggcucuacucaaugacaaacauucaaacggaaccaucaaggaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaauccuggagaaacaauaucuugaggacucaggagagcgagugugccugcgugaacgggucguguuucaccgucaugacagauggaccaucugacggccaggcuuccuacaagaucuuucggauugaaaaagguaagaucgugaaaucaguggagaugaaugcccccaacuaucauuacgaagagugcaguuguuacccugauagcuccgagauuacuugcgucugccgcgacaauuggcacgggucuaacagaccauggguuagcuucaaucaaaaccucgaauaucagauaggauacaucuguucaggcauuuuuggcgauaauccgaggcccaacgacaagaccgggaguugcggaccuguguccagcaauggugcgaacggcguaaagggguucucuuuuaaauauggaaacggcguguggaucggucggacaaagucaaucaguagccgcaauggguucgagaugauuugggauccaaacggcuggaccggaacggacaauaacuuuuccauaaaacaggacaucgucggcauuaaugaauggucuggguacucggggagcuucgugcaacaucccgagcugacuggucuggauuguauccgaccuugcuucuggguugaacucauuagaggcaggccaaaggagaacacaaucuggaccuccgggucaaguauaucuuuuuguggagugaauagcgacacugucggcugguccuggcccgauggugcagaguuaccguucacaaucgacaaauga

SEQ ID NO: 141204 - RNA, 1410 nt, Artificial Sequence; identical to SEQ ID NO: 140733
  derived and/or modified sequence opt3 from neuraminidase__InfluenzaA__ADK90337

SEQ ID NO: 141205 - RNA, 1410 nt, Artificial Sequence; identical to SEQ ID NO: 139813
  derived and/or modified sequence opt3 from neuraminidase__InfluenzaA__ADK90341

SEQ ID NO: 141206 - RNA, 1410 nt, Artificial Sequence; identical to SEQ ID NO: 139813
  derived and/or modified sequence opt3 from neuraminidase__InfluenzaA__ADK90345

SEQ ID NO: 141207 - RNA, 1410 nt, Artificial Sequence; identical to SEQ ID NO: 139813
  derived and/or modified sequence opt3 from neuraminidase__InfluenzaA__ADK90349

SEQ ID NO: 141208 - RNA, 1410 nt, Artificial Sequence; identical to SEQ ID NO: 140733
  derived and/or modified sequence opt3 from neuraminidase__InfluenzaA__ADK90353

SEQ ID NO: 141209 - RNA, 1410 nt, Artificial Sequence; identical to SEQ ID NO: 138754
  derived and/or modified sequence opt3 from neuraminidase__InfluenzaA__ADK90357

SEQ ID NO: 141210 - RNA, 1410 nt, Artificial Sequence; identical to SEQ ID NO: 140733
  derived and/or modified sequence opt3 from neuraminidase__InfluenzaA__ADK90361

SEQ ID NO: 141211 - RNA, 1410 nt, Artificial Sequence; identical to SEQ ID NO: 139728
  derived and/or modified sequence opt3 from neuraminidase__InfluenzaA__ADK90365

SEQ ID NO: 141212 - RNA, 1410 nt, Artificial Sequence; identical to SEQ ID NO: 138754
  derived and/or modified sequence opt3 from neuraminidase__InfluenzaA__ADK90369

SEQ ID NO: 141213 - RNA, 1410 nt, Artificial Sequence; identical to SEQ ID NO: 138754
  derived and/or modified sequence opt3 from neuraminidase__InfluenzaA__ADK90373

SEQ ID NO: 141214 - RNA, 1410 nt, Artificial Sequence
  derived and/or modified sequence opt3 from neuraminidase__InfluenzaA__ADK90377
augaaccccaaucagaagaucauuaccauaggcagcgugugcaugacaaucgggaugacuaaccugauucuccaaaucggaaauauuaucuccauauggaucucucacucaauucagcuugguaaccagaaucagaucgagacguguaaccaaagugucauuaccuacgaaaauaacacauggguuaaucagacuuaugugaacaucagcaauaccaacuucgccgcuggccaguccguagugucugucaaacuggcaggaaauucgucauugugcccugugagcggaugggccauauacaguaaggacaacuccauuagaaucggcucuaaaggugauguuuuugugauuagggagccauucaucagcuguuccccguuagaaugccggacauuuuuccugacccagggggcgcuacucaaugacaagcauucaaacggaacuaucaaagaucgcaguccccaccgaacacugaugagcuguccuauuggcgaggucccaucucccuauaacucccguuuugaaucaguggcuuggagcgccagugcaugccaugacggcauaaauuggcuuaccaucgggauuucuggaccugauaacggugccguagcuguucugaaguacaauggcaucauaacggacacuauuaaguccuggagaaacaauaucuugaggacccaagagagcgagugugcaugcgugaacgggucguguuucacagucaugacugauggaccaucugacggccaggccuccuauaaaaucuuucggauugaaaaggguaaaaucgugaagucaguggagauggaugcucccaauuaccacuaugaagagugcaguuguuacccugacagcuccgagauuauaugcgucugccgcgauaacuggcaugggucuaauagaccauggguuagcuucaaccagaaucucgaauaccagaucggauauauuuguucaggcaucuuuggcgacaacccgaggcccaaugauaaaaccgggaguugcggaccuguguccagcaacggugccaauggcguaaagggguucucuuuuaaguacggaaacggcguguggaucggucggacaaaaucaauuaguagccgcaacggguucgagaugauaugggacccaaauggcuggaccggaacggacaacaauuuuuccaucaagcaagauauugucggcaucaacgaauggucuggguauucggggagcuucgugcagcaccccgagcugacuggucuggacuguauucgaccuugcuucuggguugaacucaucagaggcaggccaaaagagaauacaauauggaccuccgggucaaguaucucuuuuuguggagugaacagcgauacugucggcugguccuggcccgacggugcggaguuaccguucacaauugauaaguga

SEQ ID NO: 141215 - RNA, 1410 nt, Artificial Sequence; identical to SEQ ID NO: 140733
  derived and/or modified sequence opt3 from neuraminidase__InfluenzaA__ADK90381

SEQ ID NO: 141216 - RNA, 1410 nt, Artificial Sequence
  derived and/or modified sequence opt3 from neuraminidase__InfluenzaA__ADK90385
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacugucggggaauagcagcuugugcccugugaguggaugggccauauacuccaaggacaacucuauuagaaucggcagcaaaggugauguuuuugugauuagggagccauucaucuccuguucaccguuagaaugccggaccuuuuuccugacacagggggcgcuacucaaugacaagcauaguaacggaaccaucaaagaucgcagcccccaccgaacucugaugucuuguccuauuggcgaggucccaucccccuauaacucacguuuugaaagcguggcuuggagugccucugcaugccaugacggcauaaauuggcuuacaaucgggauuuccggaccugauaacggugccguagcuguucugaaguacaauggcaucauaaccgacacgauuaagagcuggagaaacaauaucuugaggacucaagagucggaguguaccugcgugaacgggucuuguuucacagucaugacugauggaccauccgacggccaggcaucauauaaaaucuuucggauugaaaaggguaaaaucgugaagaguguggagaugaaugcccccaacuaccacuaugaagagugcagcuguuacccugauuccucugagauuaccugcgucugccgcgacaauuggcaugggagcaacagaccauggguuucauucaaucagaaccucgaauaccagauaggauauaucuguaguggcauuuuuggcgauaauccgaggcccaacgacaaaacaggguccugcggaccugugagcucuaauggugcuaacggcguaaagggguucucauuuaaguacggaaacggcguguggaucggucggaccaaaaguaucagcucccgcaauggguucgagaugauuugggauccaaacggcuggacgggaacugacaauaacuuuucuauaaagcaagacaucgucggcauuaaugaauggucgggguauagcggauccuucgugcagcaccccgagcugacaggucuggauuguauccgaccuugcuucuggguugaacucauuagaggcaggccaaaagagaacaccaucuggacuucagggaguucuauaucauuuuguggagucaauuccgacacagugggcuggucauggcccgauggugccgaguuaccguucaccaucgacaaguga

SEQ ID NO: 141217 - RNA, 1410 nt, Artificial Sequence; identical to SEQ ID NO: 138754
  derived and/or modified sequence opt3 from neuraminidase__InfluenzaA__ADK90389

SEQ ID NO: 141218 - RNA, 1410 nt, Artificial Sequence; identical to SEQ ID NO: 140733
  derived and/or modified sequence opt3 from neuraminidase__InfluenzaA__ADK90393

SEQ ID NO: 141219 - RNA, 1410 nt, Artificial Sequence; identical to SEQ ID NO: 140645
  derived and/or modified sequence opt3 from neuraminidase__InfluenzaA__ADK90397

SEQ ID NO: 141220 - RNA, 1410 nt, Artificial Sequence; identical to SEQ ID NO: 138754
  derived and/or modified sequence opt3 from neuraminidase__InfluenzaA__ADK90401

SEQ ID NO: 141221 - RNA, 1410 nt, Artificial Sequence
  derived and/or modified sequence opt3 from neuraminidase__InfluenzaA__ADK90405
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcaguccccaccgaacucugaugagcuguccuauuggcgaggucccaucucccuauaacucccguuuugaaucaguggccuggagcgcaagugccugccaugacggcauaaauuggcuuacaaucgggauuucuggaccugauaacggugcuguagcaguucugaaguacaauggcaucauaaccgacacgauuaaguccuggagaaacaauaucuugaggacucaagagagcgaguguaccugcgugaacgggucguguuucacagucaugacugauggaccaucugacggccaggccuccuauaaaaucuuucggauugaaaaggguaaaaucgugaagucaguggagaugaaugcucccaacuaccacuaugaagagugcaguuguuacccugauagcuccgagauuaccugcgucugccgcgacaauuggcaugggucuaacagaccauggguuagcuucaaucagaaccucgaauaccagauaggauauaucuguucaggcauuuuuggcgauaauccgaggcccaacgacaaaacagggaguugcggaccuguguccagcaauggugccaacggcguaaagggguucucuuuuaaguacggaaacggcguguggaucggucggaccaaaucaaucaguagccgcaauggguucgagaugauuugggauccaaacggcuggacgggaacugacaauaacuuuuccauaaagcaagacaucgucggcauuaaugaauggucuggguauucggggagcuucgugcagcaccccgagcugacaggucuggauuguauccgaccuugcuucuggguugaacucauuagaggcaggccaaaagagaacaccaucuggacuuccgggucaaguauaucuuuuuguggagugaauagcgacacagucggcugguccuggcccgauggugcggaguuaccguucaccaucgacaaguga

SEQ ID NO: 141222 - RNA, 1410 nt, Artificial Sequence; identical to SEQ ID NO: 138754
  derived and/or modified sequence opt3 from neuraminidase__InfluenzaA__ADK90409

SEQ ID NO: 141223 - RNA, 1410 nt, Artificial Sequence
  derived and/or modified sequence opt3 from neuraminidase__InfluenzaA__ADK90413
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcaguccccaccgaacucugaugagcuguccuauuggcgaggucccaucucccuauaacucccguuuugaaucaguggccuggagcgcaagugccugccaugacggcauaaauuggcuuacaaucgggauuucuggaccugauaacggugcuauggcaguacugaaguacaauggcaucauaaccgacacgauuaaguccuggagaaacaauaucuugaggacucaagagagcgagugugccugcguuaacgggucguguuucaccgugaugacagauggaccaucugacggccaggcuuccuauaaaaucuuucggauugaaaaggguaaaaucgucaagucaguggagaugaaugcccccaacuaccacuaugaagagugcaguuguuacccugauagcuccgagauuacuugcgugugccgcgacaauuggcaugggucuaacagaccaugggucagcuucaaucagaaccucgaauaccagauaggauauaucuguucaggcauuuuuggcgauaauccgaggcccaacgacaaaaccgggaguugcggaccuguuuccagcaauggugcgaacggcgugaagggguucucuuuuaaguacggaaacggcguauggaucggucggacaaaaucaaucaguagccgcaauggguucgagaugauuugggauccaaacggcuggaccggaacggacaauaacuuuuccauaaagcaagacaucgugggcauuaaugaauggucuggguauucggggagcuucguccagcaccccgagcugacuggucuggauuguauccgaccuugcuucuggguggaacucauuagaggcaggccaaaagagaacacaaucuggaccuccgggucaaguauaucuuuuuguggaguuaauagcgacacugugggcugguccuggcccgauggugcagaguuaccguucacaaucgacaaguga

SEQ ID NO: 141224 - RNA, 1410 nt, Artificial Sequence; identical to SEQ ID NO: 138754
  derived and/or modified sequence opt3 from neuraminidase__InfluenzaA__ADK90417

SEQ ID NO: 141225 - RNA, 1410 nt, Artificial Sequence; identical to SEQ ID NO: 138754
  derived and/or modified sequence opt3 from neuraminidase__InfluenzaA__ADK90421

SEQ ID NO: 141226 - RNA, 1410 nt, Artificial Sequence; identical to SEQ ID NO: 138754
  derived and/or modified sequence opt3 from neuraminidase__InfluenzaA__ADK90425

SEQ ID NO: 141227 - RNA, 1410 nt, Artificial Sequence; identical to SEQ ID NO: 138754
  derived and/or modified sequence opt3 from neuraminidase__InfluenzaA__ADK90429

SEQ ID NO: 141228 - RNA, 1410 nt, Artificial Sequence; identical to SEQ ID NO: 138615
  derived and/or modified sequence opt3 from neuraminidase__InfluenzaA__ADK94194

SEQ ID NO: 141229 - RNA, 1410 nt, Artificial Sequence; identical to SEQ ID NO: 138615
  derived and/or modified sequence opt3 from neuraminidase__InfluenzaA__ADK94205

SEQ ID NO: 141230 - RNA, 1410 nt, Artificial Sequence; identical to SEQ ID NO: 139921
  derived and/or modified sequence opt3 from neuraminidase__InfluenzaA__ADK94216

SEQ ID NO: 141231 - RNA, 1410 nt, Artificial Sequence; identical to SEQ ID NO: 138615
  derived and/or modified sequence opt3 from neuraminidase__InfluenzaA__ADK94227

SEQ ID NO: 141232 - RNA, 1410 nt, Artificial Sequence; identical to SEQ ID NO: 138615
  derived and/or modified sequence opt3 from neuraminidase__InfluenzaA__ADK94238

SEQ ID NO: 141233 - RNA, 1410 nt, Artificial Sequence; identical to SEQ ID NO: 141139
  derived and/or modified sequence opt3 from neuraminidase__InfluenzaA__ADK94260

SEQ ID NO: 141234 - RNA, 1410 nt, Artificial Sequence; identical to SEQ ID NO: 141139
  derived and/or modified sequence opt3 from neuraminidase__InfluenzaA__ADK94271

SEQ ID NO: 141235 - RNA, 1410 nt, Artificial Sequence; identical to SEQ ID NO: 138615
  derived and/or modified sequence opt3 from neuraminidase__InfluenzaA__ADK94293

SEQ ID NO: 141236 - RNA, 1410 nt, Artificial Sequence; identical to SEQ ID NO: 138615
  derived and/or modified sequence opt3 from neuraminidase__InfluenzaA__ADK94304

SEQ ID NO: 141237 - RNA, 1410 nt, Artificial Sequence
  derived and/or modified sequence opt3 from neuraminidase__InfluenzaA__ADK94326
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacauucauucaaauaacaccguccgagaucguacaccauauagaacucugcuuaugaaugaacugggagugcccuuucacuugggcaccaagcagguuugcaucgcuuggagcaguuccucuugucaugacgguaaagccuggcuccacgugugcaucacaggggaugacaagaacgcaaccgccagcuucauuuacaauggaaggcuggucgauuccgugguaucauggaguaaagagauacugcggacgcaggaaagcgaguguguuugcaucaacggcacuuguacaguggucaugaccgacggcucugcuuccgggaaggcagauacuaaaauucucuuuaucgaggaaggaaagauagugcauacaucaaccuuaagcgguagugcccaacacguggaggaaugcucuugcuauccucgcuacccaggcgucagauguguuugcagggacaacuggaagggguccaaucggccgauuguggauaucaacaucaaagaccacagcauuguaucgucuuacguguguuccggacuggucggcgacacgccccgcaagaaugauucaaguagcuccucucauugccuugacccuaacaaugaggaaggugggcacggagugaaaggcugggcuuucgaugacggcaacgauguuuggauggggcgaaccaucagcgagaagucaagauugggauaugagacauuuaaagugauugaagguuggaguaauccaaaguccaaacugcagauaaacaggcaggucaucguggaccggggcaaucguagcggguacucuggaauuuucucaguagagggcaagaguuguaucaaccgcugcuuuuauguugaacuaaucagagguaggaaggaggaaacugaggugcucuggaccagcaauuccauugucguguucugugggacaucuggcacuuacggaaccggcucguggcccgauggggccgacauaaaccugaugccuaucuga

SEQ ID NO: 141238 - RNA, 1410 nt, Artificial Sequence; identical to SEQ ID NO: 139921
  derived and/or modified sequence opt3 from neuraminidase__InfluenzaA__ADK94337

SEQ ID NO: 141239 - RNA, 1410 nt, Artificial Sequence; identical to SEQ ID NO: 138615
  derived and/or modified sequence opt3 from neuraminidase__InfluenzaA__ADK94444

SEQ ID NO: 141240 - RNA, 1410 nt, Artificial Sequence
  derived and/or modified sequence opt3 from neuraminidase__InfluenzaA__ADK94479
augaaccccaaucagaagaucauuaccauaggcagcgugucccugacaaucucuacuauuugcuuccucaugcaaaucgccauucuuacgaccacagucacucugcacuuuaaacaguacgaguucaacucaccuccaaauaaccagguuauguugugugaaccgaccacaaucgagagaaauauaaccgaaaucguguauuuaacuaacacaaccauugagaaggaaaucugccccaaacuggcugaguacaggaauuggaguaagccucagugugacauuacgggguuugcaccauucagcaaagauaacuccauccggcuaucugccggaggugacauauggguaacucgcgagcccuaugugucgugcgauccugacaaguguuaccaauuugcgcucggccaggggaccacacugaauaacguccauucaaauaacacugugcgagaucguaccccauauagaacacuucugaugaaugaauugggaguucccuuccaccucggcaccaaacaggugugcauugcuuggagcaguuccucuugucaugacgguaaggccuggcugcacgucugcaucacgggggaugacaagaacgcaacugccagcuuuauuuacaauggaaaacugguggauuccguaguuucauggaguaaggagauccucaggacacaggaaagcgagugugugugcaucaacggcaccuguacugucgugaugacagacggcucugcuuccgggaaagcagauaccaagauuuuauucauagaggaaggaaagaucgugcauacgucaacccugagcgguagugcccaacacgucgaggaaugcucuugcuauccucgguacccaggcguucgcugugugugcagagacaacuggaaaggguccaauaggccgauuguagauaucaacauaaaggaccacagcauugugucgucuuaccuuuguuccggauuggucggcgacacaccccggaaaaaugauucaaguagcuccucucauugccuggacccuaacaaugaggaaggugggcacggagugaagggcugggcuuuugaugacggcaacgauguuuggauggggcgcacuaucagcgagaaaucacgacuaggauaugagaccuucaaggugaucgaagguuggaguaauccaaaauccaagcuccagauuaacagacaggucaucguggacaggggcaaucggagcggguacucuggaauauuuucaguagagggcaagaguuguauuaaccguugcuucuauguugaacugauccgcgguagaaaagaggaaacaggggugcuuuggacuagcaauuccauugucguguuuuguggcaccucuggaacauacggcaccgggucguggcccgauggagccgacaucaaccugaugccuaucuga

SEQ ID NO: 141241 - RNA, 1410 nt, Artificial Sequence; identical to SEQ ID NO: 138615
  derived and/or modified sequence opt3 from neuraminidase__InfluenzaA__ADK94490

SEQ ID NO: 141242 - RNA, 1410 nt, Artificial Sequence; identical to SEQ ID NO: 138615
  derived and/or modified sequence opt3 from neuraminidase__InfluenzaA__ADK94501

SEQ ID NO: 141243 - RNA, 1410 nt, Artificial Sequence
  derived and/or modified sequence opt3 from neuraminidase__InfluenzaA__ADK94512
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggacgcaucgugcauacaucaaccuuaagcgguagugcccaacacgucgaggaaugcucuugcuauccuagauacccaggcguuaggugugugugccgggacaacuggaagggguccaaucgcccgauaguagauauuaacaucaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggagaaccauuagcgagaaaucaagguugggauaugagacauuuaaggucaucgaagguuggaguaauccaaaauccaagcugcagauuaaccgacaggugauaguagaccguggcaaucgcagcggguacucuggaaucuucucaguugagggcaaaaguuguauuaacagaugcuuuuauguggaacuaaucaggggucggaaggaggaaacugagguccucuggaccagcaauuccaucguggucuucugugggacaucuggcacuuacggaaccggcucguggcccgauggggccgacauuaaccugaugccuauauga

SEQ ID NO: 141244 - RNA, 1410 nt, Artificial Sequence; identical to SEQ ID NO: 138615
  derived and/or modified sequence opt3 from neuraminidase__InfluenzaA__ADK94534

SEQ ID NO: 141245 - RNA, 1410 nt, Artificial Sequence; identical to SEQ ID NO: 141139
  derived and/or modified sequence opt3 from neuraminidase__InfluenzaA__ADK94556

SEQ ID NO: 141246 - RNA, 1410 nt, Artificial Sequence; identical to SEQ ID NO: 138615
  derived and/or modified sequence opt3 from neuraminidase__InfluenzaA__ADK94567

SEQ ID NO: 141247 - RNA, 1410 nt, Artificial Sequence; identical to SEQ ID NO: 138615
  derived and/or modified sequence opt3 from neuraminidase__InfluenzaA__ADK94578

SEQ ID NO: 141248 - RNA, 1410 nt, Artificial Sequence; identical to SEQ ID NO: 138615
  derived and/or modified sequence opt3 from neuraminidase__InfluenzaA__ADK94589

SEQ ID NO: 141249 - RNA, 1410 nt, Artificial Sequence; identical to SEQ ID NO: 140305
  derived and/or modified sequence opt3 from neuraminidase__InfluenzaA__ADK98504

SEQ ID NO: 141250 - RNA, 1410 nt, Artificial Sequence
  derived and/or modified sequence opt3 from neuraminidase__InfluenzaA__ADK98506
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaaaugucauuacguacgaaaacaauaccuggguuaaccagacauaugugaauaucaguaacacuaauuucgcugcaggccagagcguaguguccgucaaacuggccgggaacucuucguugugcccugugucaggaugggcgauauacagcaaggacaauaguauuagaaucggcuccaaaggugauguuuuugugauuagggagccauucaucucuuguagcccguuagaaugccggaccuuuuuccugacacagggggcucuacucaacgacaagcauuccaacggaaccaucaaagaucgcucacccuaucgaacucugaugaguuguccuauuggcgaggucccaagccccuacaauucucguuuugaauccguggccuggucagcaagcgccugccacgacggcauaaacuggcuuacaaucgggauuaguggaccugauaauggugcuguagcaguucugaaguauaacggcaucauaaccgacacgauuaagucuuggagaaauaacaucuugaggacucaagaguccgagugugccugcgugaaugggagcuguuucaccgucaugacagauggaccaucggacggccaggcuucuuacaaaaucuuucggauugaaaaggguaaaaucgugaaguccguggagaugaacgcccccaauuaucauuacgaagagugcucauguuacccugauaguagcgagauuacuugcgucugccgcgacaacuggcacggguccaauagaccauggguuucuuucaaccagaaucucgaauaucagauaggauacaucuguagcggcauuuuuggcgauaacccgaggcccaaugacaaaaccgggucaugcggaccugugaguuccaacggugcgaacggcguaaagggguucagcuuuaaguauggaaauggcguguggaucggucggacaaaaucuaucucaagucgcaacggguucgagaugauuugggauccaaauggcuggaccggaacggacaacaauuuuagcauaaagcaagacaucgucggcauuaacgaaugguccggguacucuggaucguucgugcagcaucccgagcugacuggucuggauuguauccgaccuugcuucuggguugaacucauuagaggcaggccaaaagagaauacaaucuggaccagcggguccucaauaaguuuuuguggagugaacucugacacugucggcuggagcuggcccgauggugcagaguuaccguucacaaucgacaaguga

SEQ ID NO: 141251 - RNA, 1410 nt, Artificial Sequence
  derived and/or modified sequence opt3 from neuraminidase__InfluenzaA__ADK98626
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuaugauagagagaaauaucaccgaaauuguguauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcaucgcuuggagcaguuccucuugucaugacgguaaggccuggcuccacgucugcauuacaggggaugacaagaacgcaaccgccagcuucaucuacaauggaaggcugguggauuccguaguuucauggaguaaagagauccugcggacgcaggaaagcgagugugugugcauuaacggcacuuguacagucgugaugaccgacggcucugcuuccgggaaggcagauacuaaaauacucuuuaucgaggaaggaaagauugugcauacaucaaccuuaagcgguagugcccaacacgucgaggaaugcucuugcuauccucgcuacccaggcguuagaugugugugcagggacaacuggaagggguccaaucggccgaucguagauauaaacauuaaagaccacagcaucgugucgucuuaccuguguuccggacuugucggcgacacgccccgcaagaaugauucaaguagcuccucucauugcuuggacccuaacaaugaggaaggugggcacggagugaaaggcugggcuuucgaugacggcaacgauguuuggauggggcgaaccaucagcgagaagucaagacugggauaugagacauuuaaagugauugaagguuggaguaauccaaaguccaaacuacagaucaacaggcaggucauuguggaccggggcaaucguagcggguacucuggaauauucucaguagagggcaagaguuguaucaaccgcugcuuuuauguugaacucauuagagguaggaaggaggaaacugaggugcuguggaccagcaauuccaucgucguguucugugggacaucuggcacuuacggaaccggcucguggcccgauggggccgacaucaaccuuaugccuauuuga

SEQ ID NO: 141252 - RNA, 1410 nt, Artificial Sequence; identical to SEQ ID NO: 139921
  derived and/or modified sequence opt3 from neuraminidase__InfluenzaA__ADK98637

SEQ ID NO: 141253 - RNA, 1410 nt, Artificial Sequence
  derived and/or modified sequence opt3 from neuraminidase__InfluenzaA__ADK98648
augaaccccaaucagaagaucauuaccauaggcagcgugucccugacaaucucuacuauuugcuucuuuaugcaaaucgccauucucgucacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcaucgcuuggagcaguuccucuugucaugacgguaaagccuggcuccacgugugcauuacaggggaugacaagaacgcaaccgccagcuucaucuacaauggaaggcugguagauuccguugugucauggaguaaagacauccugcggacgcaggagagcgaaugugucugcauuaacggcacuuguacaguggugaugaccgauggcucugcuuccgggaaggcagacacuaaaauacucuuuaucgaggagggaaagauuguccauacaucaaccuuaagcgguagugcccaacacguugaagagugcucuugcuauccucgcuacccaggcgugagauguguaugcagggauaacuggaagggguccaaucggccgaucguggacauaaacauuaaagaccacagcaucgucucgucuuacguguguuccggacugguuggcgauacgccccgcaagaaugacucaaguagcuccucucauugccuugauccuaacaaugaagagggugggcgaggagugaaaggcugggcuuucgacgauggcaacgacgucuggauggggagaaccaucagcgaaaagucaagguugggauaugagacauuuaaagugauugaggguuggaguaauccaaaguccaaacugcagaucaaccggcagguaauuguugaucguggcaaucgcagcggguacucuggaauauucucaguggaaggcaagaguuguaucaacagaugcuuuuaugucgagcuaauuaggggucggaaggaagagacugaagugcucuggaccagcaauuccaucgucguguucugugggacaucuggcacuuacggaaccggcucguggcccgacggggccaacaucaaucugaugccuauuuga

SEQ ID NO: 141254 - RNA, 1410 nt, Artificial Sequence
  derived and/or modified sequence opt3 from neuraminidase__InfluenzaA__ADK98659
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccggucauugccuugacccuaacaaugaggaagggggacacggcguuaaaggcugggcuuucgaugacgggaacgauguguggaugggacgaaccauuucugaaaagagcagauuggguuaugagacauuuaaagucaucgagggcuggucaaaucauaagaguaaacugcagauuaacaggcaagugauaguagaccgggggaaucguuccggauacagcggcaucuucucuguugaggguaagucauguauuaaccgcugcuuuuauguggaacuaaucagagggaggaaggaggaaacugagguccucuggaccaguaauagcaucguggucuucuguggcacauccggaacuuacggcaccgggucuuggccagauggagccgaccugaaccuuaugcccauuuga

SEQ ID NO: 141255 - RNA, 1410 nt, Artificial Sequence; identical to SEQ ID NO: 141139
  derived and/or modified sequence opt3 from neuraminidase__InfluenzaA__ADK98670

SEQ ID NO: 141256 - RNA, 1410 nt, Artificial Sequence
  derived and/or modified sequence opt3 from neuraminidase__InfluenzaA__ADK98681
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccggggaggcagauacuaagauccucuuuauugaagagggaaaaaucgugcauacaucaaccuuaagcgguagugcccaacacgucgaagagugcucuugcuauccucgcuacccaggcguuagaugugugugcagggacaacuggaagggguccaaucggccgauaguagauauuaacaucaaggaccacagcaucgugucgucuuacgucuguuccggacuggugggcgacacgccccgcaaaaaugauucaaguagcuccucucauugccuugacccuaacaaugaagagggugggcacggaguuaagggcugggcuuucgaugacggcaacgauguguggauggggcgaaccauuagcgagaaaucaagauugggauaugaaacauuuaaggucaucgaggguuggaguaauccaaaauccaagcugcagacuaacaggcaagugauuguagaccggggcaaucguagcggguacucuggaauauucucaguugaaggcaaaaacuguaucaaucgcugcuuuuauguggagcuaauuagagguaggaaggaagagaccgagguccucuggacaaguaacagcaucguggucuucugugggacuuccggcaccuacggaacaggcucuuggcccgauggggccgacaucaaucugaugccuauuuga

SEQ ID NO: 141257 - RNA, 1410 nt, Artificial Sequence
  derived and/or modified sequence opt3 from neuraminidase__InfluenzaA__ADK98703
augaaccccaaucagaagaucauuaccauaggcagcgugucccugacaaucucuacuauuugcuucuuuaugcaaacggccauccucauuaccacagucacucuucacuucaaacaguacgaguuuaacucaccuccaaauaaccagguuaugcugugugaaccgaccaucauagagagaaauaucacagaaauuguguauuugaccaacacuacaaucgagaaggaaauuugccccaaauuagcugaguacaggaauuggaguaagccucagugugacaucaccggguucgcaccauuuagcaaagauaacuccauacggcugucugccggaggugacauuuggguaacgcgcgagcccuaugugucgugcgauccugacaaguguuaccaauucgcgcuaggccaggggacuacccucaauaacguccauucaaauaacacagugcgagaucguacuccauauagaacccugcuuaugaaugaacugggaguucccuuucacuugggcacaaaacaggugugcaucgcuuggagcaguuccucuugucaugacgguaaggccuggcuccacgucugcauuaccggggaugacaagaacgcaacggccagcuucaucuacaauggaaggcugguggauuccguaguuucauggaguaaagagauccugcggacucaggaaagcgagugugugugcauuaacggcacauguaccgucgugaugacugacggcucugcuuccggggaggcagauacaaagauacucuuuaucgaagagggaaaaauugugcauaccucaacguuaagcgguagugcccaacacgucgaagagugcucuugcuauccucgcuacccaggcguuagaugugugugcagggacaacuggaagggguccaaucggccgaucguagauauaaacauuaaggaccacagcaucgugucgucuuacgucuguuccggacuggugggcgacacccccaggaaaaaugauucaaguagcuccucucauugccuugacccuaacaaugaagagggugggcacggaguuaagggcugggcuuucgaugacggcaacgauguguggauggggcgaacaaucagcgagaaaucaagauugggauaugaaacuuuuaaggucauugaggguuggaguaauccaaaauccaagcugcagaccaaccgccaggugaucguagaccggggcaaucguagcggguacucuggaauuuucucaguugaaggcaaaaacuguauaaaucgcugcuuuuauguggagcuaaucagagguaggaaggaagagacagagguccucuggaccaguaacagcauuguggucuucugugggacuuccggcacauacggaaccggcucuuggcccgauggggccgacaucaaucugaugccuaucuga

SEQ ID NO: 141258 - RNA, 1410 nt, Artificial Sequence; identical to SEQ ID NO: 140500
  derived and/or modified sequence opt3 from neuraminidase__InfluenzaA__ADK98725

SEQ ID NO: 141259 - RNA, 1410 nt, Artificial Sequence; identical to SEQ ID NO: 141139
  derived and/or modified sequence opt3 from neuraminidase__InfluenzaA__ADK98736

SEQ ID NO: 141260 - RNA, 1410 nt, Artificial Sequence
  derived and/or modified sequence opt3 from neuraminidase__InfluenzaA__ADK98747
augaaccccaaucagaagaucauuaccauaggcagcgugucccugacaaucucuacuauuugcuucuuuaugcaaaucgccauucucgucacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcaucgcuuggagcaguuccucuugucaugacgguaaagccuggcuccacgugugcauuacaggggaugacaagaacgcaaccgccagcuucaucuacaauggaaggcugguagauuccguugugucauggaguaaagacauccugcggacgcaggagagcgaaugugucugcauuaacggcacuuguacaguggugaugaccgauggcucugcuuccgggaaggcagacacuaaaauacucuuuaucgaggagggaaagauuguccauacaucaaccuuaagcgguagugcccaacacguugaagagugcucuugcuauccucgcuacccaggcgugagauguguaugcagggauaacuggaagggguccaaucggccgaucguggacauaaacaugaaagaccacagcauugucucgucuuacguguguuccggacugguuggcgauacgccccgcaagaaugacucaaguagcuccucucauugccuugauccuaacaaugaagagggugggcacggagugaaaggcugggcuuucgacgauggcaacgacgucuggauggggcgaaccaucagcgaaaagucaagauugggauaugagacauuuaaagugaucgaggguuggaguaauccaaaguccaaacugcagauuaacaggcagguaaucguugaucggggcaaucguagcggguacucuggaauuuucucaguggaaggcaagaguuguauaaaccgcugcuuuuaugucgagcuaaucagagguaggaaggaagagacugaagugcucuggaccagcaauuccauugucguguucugugggacaucuggcacuuacggaaccggcucguggcccgacggggccaacaucaaucugaugccuaucuga

SEQ ID NO: 141261 - RNA, 1410 nt, Artificial Sequence
  derived and/or modified sequence opt3 from neuraminidase__InfluenzaA__ADK98758
augaaccccaaucagaagaucauuaccauaggcagcgugucccugacaaucucuacuauuugcuucuuuaugcaaaucgccauucucgucacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcaucgcuuggagcaguuccucuugucaugacgguaaagccuggcuccacgugugcauuacaggggaugacaagaacgcaaccgccagcuucaucuacaauggaaggcugguagauuccguugugucauggaguaaagacauccugcggacgcaggagagcgaaugugucugcauuaacggcacuuguacaguggugaugaccgauggcucugcuuccgggaaggcaaacacuaaaauacucuuuaucgaggagggaaagauuguccauacaucaaccuuaagcgguagugcccaacacguugaagagugcucuugcuauccucgcuacccaggcgugagauguguaugcagggacaauuggaagggguccaaccggccgaucguggauauaaauauuaaagaccacagcaucgucucgucuuacguguguuccggacugguuggcgacacgccccgcaagaacgauucaaguagcuccucucauugccuugacccuaauaacgaagagggugggcacggagugaaaggcugggcuuucgaugacggcaaugaugucuggauggggcgaaccaucagcgaaaagucaagauugggauaugagacauuuaaagugauugaggguuggaguaacccaaaguccaaacugcagaucaauaggcagguaauuguugaccggggcaaccguagcggguacucuggaauauucucaguggaaggcaagaguuguaucaaucgcugcuuuuaugucgagcuaauuagagguaggaaggaagagacugaagugcucuggaccagcaacuccaucgucguguucugugggacaucuggcacuuacggaaccggcucguggcccgauggggccaauaucaaccugaugccuauuuga

SEQ ID NO: 141262 - RNA, 1410 nt, Artificial Sequence; identical to SEQ ID NO: 140500
  derived and/or modified sequence opt3 from neuraminidase__InfluenzaA__ADK98769

SEQ ID NO: 141263 - RNA, 1410 nt, Artificial Sequence; identical to SEQ ID NO: 141054
  derived and/or modified sequence opt3 from neuraminidase__InfluenzaA__ADK98780

SEQ ID NO: 141264 - RNA, 1410 nt, Artificial Sequence; identical to SEQ ID NO: 140500
  derived and/or modified sequence opt3 from neuraminidase__InfluenzaA__ADK98791

SEQ ID NO: 141265 - RNA, 1410 nt, Artificial Sequence; identical to SEQ ID NO: 138615
  derived and/or modified sequence opt3 from neuraminidase__InfluenzaA__ADK98802

SEQ ID NO: 141266 - RNA, 1410 nt, Artificial Sequence
  derived and/or modified sequence opt3 from neuraminidase__InfluenzaA__ADK98813
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccggcuauaaucgagagaaauauuacugaaaucguguauuugaccaacacaaccauugagaaggaaaucugccccaaauuagcagaguacaggaauuggaguaagccucagugugacauaacuggguucgccccauuuagcaaagauaacuccauucggcugucugcgggaggugacaucuggguaacacgcgagcccuaugugucgugcgauccugacaaguguuaccaauucgcucuaggccaggggaccacgcucaauaacguccauucaaauaacacugugcgagaucguaccccauauagaacacugcuuaugaaugaacugggaguucccuuucacuugggcacuaaacaggugugcauugccuggagcaguuccucuugucaugacgguaaggcauggcuccacgucugcaucaccggggaugacaagaacgccacagcuagcuucaucuacaauggaaggcugguggauuccguaguuucauggaguaaagagauucugcggacccaggaaagcgagugugugugcauaaacggcacguguacugucgugaugacagacggcucugcauccgggaaggccgauaccaaaauccucuuuauugaggaaggaaagaucgugcauacuucaacauuaagcgguagugcucaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacccccaggaagaaugauucaaguagcuccucucauugccuugacccuaacaaugaggaaggugggcacggaguuaaaggcugggccuucgaugacggcaacgauguguggauggggcgaacgauuagcgagaagucaagauugggauaugagaccuuuaaagucaucgaagguuggaguaaucauaaguccaaacugcagauuaaccgccaggugauaguagaccggggcaaucguagcggguacucuggaaucuucucaguugagggcaagaguuguauuaaccgcugcuuuuauguggaacuaaucagagguaggaaggaggaaacagagguccucuggacuagcaauuccaucguggucuucugugggaccucuggcacauacggaacuggcucguggccagauggggcggaccugaaccuuaugcccauuuga

SEQ ID NO: 141267 - RNA, 1410 nt, Artificial Sequence; identical to SEQ ID NO: 138615
  derived and/or modified sequence opt3 from neuraminidase__InfluenzaA__ADK98824

SEQ ID NO: 141268 - RNA, 1410 nt, Artificial Sequence; identical to SEQ ID NO: 140500
  derived and/or modified sequence opt3 from neuraminidase__InfluenzaA__ADK98835

SEQ ID NO: 141269 - RNA, 1410 nt, Artificial Sequence; identical to SEQ ID NO: 141139
  derived and/or modified sequence opt3 from neuraminidase__InfluenzaA__ADK98846

SEQ ID NO: 141270 - RNA, 1410 nt, Artificial Sequence
  derived and/or modified sequence opt3 from neuraminidase__InfluenzaA__ADK98857
augaaccccaaucagaagaucauuaccauaggcagcgugucccugacaaucucuacuauuugcuucuuuaugcaaaucgccauucucgucacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcaucgcuuggagcaguuccucuugucaugacgguaaagccuggcuccacgugugcauuacaggggaugacaagaacgcaaccgccagcuucaucuacaauggaaggcugguagauuccguugugucauggaguaaagacauccugcggacgcaggagagcgaaugugucugcauuaacggcacuuguacaguggugaugaccgauggcucugcuuccgggaaggcagacacuaaaauacucuuuaucgaggagggaaagauuguccauacaucaaccuuaagcgguagugcccaacacguugaagagugcucuugcuauccucgcuacccaggcgugagauguguaugcagggauaacuggaagggguccaaucggccgaucguggacauaaacauuaaagaccacagcaucgucucgucuuacguguguuccggacugguuggcgauacgccccgcaagaaugacucaaguagcuccucucauugccuugauccuaacaaugaagagggugggcacggagugaaaggcugggcuuucgacgauggcaacgacgucuggauggggcgaaccaucagcgaaaagucaagauugggauaugagacauuuaaagugauugaggguuggaguaaucauaaguccaaacugcagaucaacaggcagguaauuguugaucggggcaaucguagcggguacucuggaauauucucaguggaaggcaagaguuguaucaaccgcugcuuuuaugucgagcuaauuagagguaggaaggaagagacugaagugcucuggaccagcaauuccaucgucguguucugugggacaucuggcacuuacggaaccggcucguggccagacggggccaacaucaaucugaugcccauuuga

SEQ ID NO: 141271 - RNA, 1410 nt, Artificial Sequence
  derived and/or modified sequence opt3 from neuraminidase__InfluenzaA__ADK98868
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaauccaaaguccaaacugcagauuaacaggcaagugauaguagaccggggcaaucguagcggguacucuggaaucuucucaguugagggcaagaguuguauuaaccgcugcuuuuauguggaacuaaucagagguaggaaggaggaaaaugagguccucuggacuagcaacuccaucguggucuucugugggaccucuggcacauacggaacuggcucguggcccgauggggccgacauuaaucugaugccuauauga

SEQ ID NO: 141272 - RNA, 1410 nt, Artificial Sequence
  derived and/or modified sequence opt3 from neuraminidase__InfluenzaA__ADK98879
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccaggcuaugcugugugaaccgacuauaaucgagagaaauauuaccgaaaucguuuauuugacaaacaccacuauugagaaggaaaucugccccaaauuagcagaguacaggaauuggaguaagccucagugugacauaacaggguucgccccauuuagcaaagauaacuccauucggcugucugcgggaggugacaucugggugacccgcgagcccuauguaucgugcgauccugacaaguguuaccaauucgcucuaggccaggggacgacucucaauaacgugcauucaaauaacaccguccgagaucguacaccauauagaacucugcuuaugaaugaacugggagugcccuuucacuugggcaccaagcagguuugcauugccuggagcaguuccucuugucaugacgguaaagcauggcuccacgugugcaucacaggggaugacaagaacgccaccgcuagcuucaucuacaauggaaggcuggucgauuccgugguaucauggaguaaagagauucugcggacgcaggaaagcgaguguguuugcauaaacggcacuuguacaguggucaugaccgacggcucugcauccgggaaggccgauacuaaaauccucuuuauugaggaaggaaagaucgugcauacaucaaccuuaagcgguagugcucaacacguggaggaaugcucuugcuauccucgcuacccaggcgucagauguguuugcagggacaacuggaagggguccaaucggccgauaguggauauuaacaucaaagaccacagcaucguaucgucuuacguguguuccggacuggucggcgacacgccccgcaagaaugauucaaguagcuccucucauugccuugacccuaacaaugaggaaggugggcacggagugaaaggcugggccuucgaugacggcaacgauguuuggauggggcgaaccauuagcgagaagucaagauugggauaugagacauuuaaagugaucgaagguuggaguaauccaaaguccaaacugcagauuaacaggcaggucauaguggaccggggcaaucguagcggguacucuggaaucuucucaguagagggcaagaguuguauuaaccgcugcuuuuauguugaacuaaucagagguaggaaggaggaaacugaggugcucuggaccagcaauuccaucgucguguucugugggacaucuggcacuuacggaaccggcucguggcccgauggggcggacauuaaccugaugccuauauga

SEQ ID NO: 141273 - RNA, 1410 nt, Artificial Sequence; identical to SEQ ID NO: 141139
  derived and/or modified sequence opt3 from neuraminidase__InfluenzaA__ADK98890

SEQ ID NO: 141274 - RNA, 1410 nt, Artificial Sequence; identical to SEQ ID NO: 140500
  derived and/or modified sequence opt3 from neuraminidase__InfluenzaA__ADK98901

SEQ ID NO: 141275 - RNA, 1410 nt, Artificial Sequence; identical to SEQ ID NO: 141054
  derived and/or modified sequence opt3 from neuraminidase__InfluenzaA__ADK98912

SEQ ID NO: 141276 - RNA, 1410 nt, Artificial Sequence; identical to SEQ ID NO: 141139
  derived and/or modified sequence opt3 from neuraminidase__InfluenzaA__ADK98923

SEQ ID NO: 141277 - RNA, 1410 nt, Artificial Sequence; identical to SEQ ID NO: 139921
  derived and/or modified sequence opt3 from neuraminidase__InfluenzaA__ADK98945

SEQ ID NO: 141278 - RNA, 1410 nt, Artificial Sequence
  derived and/or modified sequence opt3 from neuraminidase__InfluenzaA__ADK98956
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcguggucucgucuuacguguguuccggacugguuggcgacacgccccgcaagucagauaguagcuccucuagccauugccuugacccuaauaacgaggaaggugggcacggagugaaaggcugggcuuucgaugacggcaaugaugucuggauggggcgaaccaucucagagaagaguagauugggauaugagacauuuaaagugauugaagguugguccaaccauaagagcaaacugcagaucaauaggcagguaauuguugaccggggcaaccguucuggguacucaggaauauucaguguggagggcaagagcuguaucaaucgcugcuuuuaugucgaacuaauuagagguaggaaggaggaaacugaggugcucuggaccuccaacucuaucgucguguucugugggacaucgggcacuuacggaaccggcagcuggccagauggggccgaccugaaucuuaugcccaucuga

SEQ ID NO: 141279 - RNA, 1410 nt, Artificial Sequence; identical to SEQ ID NO: 140500
  derived and/or modified sequence opt3 from neuraminidase__InfluenzaA__ADK98967

SEQ ID NO: 141280 - RNA, 1410 nt, Artificial Sequence; identical to SEQ ID NO: 141139
  derived and/or modified sequence opt3 from neuraminidase__InfluenzaA__ADK98978

SEQ ID NO: 141281 - RNA, 1410 nt, Artificial Sequence; identical to SEQ ID NO: 141278
  derived and/or modified sequence opt3 from neuraminidase__InfluenzaA__ADK98989

SEQ ID NO: 141282 - RNA, 1410 nt, Artificial Sequence; identical to SEQ ID NO: 138615
  derived and/or modified sequence opt3 from neuraminidase__InfluenzaA__ADK99000

SEQ ID NO: 141283 - RNA, 1410 nt, Artificial Sequence; identical to SEQ ID NO: 141278
  derived and/or modified sequence opt3 from neuraminidase__InfluenzaA__ADK99011

SEQ ID NO: 141284 - RNA, 1410 nt, Artificial Sequence
  derived and/or modified sequence opt3 from neuraminidase__InfluenzaA__ADK99022
augaaccccaaucagaagaucauuaccauaggcagcgugucccugacaaucucuacuauuugcuucuuuaugcaaaucgccauucucgucacgaccguuacacuucacuucaaacaguacgaguuuaacucaccuccaaauaaccaggugaugcugugugacccgacuaucauagaaagaaauaucaccgagauuguauauuugacaaacaccacuaucgaaaaggagauuugccccaaauuagcugaauacaggaauuggaguaagccucagugugauaucacaggguucgcaccauuuagcaaagacaacuccauacggcugucugccggaggugauauuugggugacccgcgagcccuaugucucgugcgacccugauaaguguuaccaauucgcgcuaggccaggggacgacucucaauaacgugcauucaaauaacaccguucgagaccguacaccauauagaacucugcuuaugaaugagcugggagugcccuuucacuugggcaccaagcaggucugcaucgcuuggagcaguuccucuugucaugaugguaaagccuggcuccacgugugcauuacaggggacgauaagaacgcaaccgccagcuucaucuacaauggaaggcugguagacuccguugugucauggaguaaagauauccugcggacgcaggaaagcgagugugucugcauuaacggcacuuguacaguggugaugaccgacggcucugcuuccgggaaggcagauacuaaaauacucuuuaucgaagagggaaagauuguccauacaucaaccuuaagcgguagugcccaacacguugaggaaugcucuugcuauccucgcuacccaggcgugagauguguaugcagggacaacuggaagggguccaaucggccgaucguggacauaaacauuaaagaucacagcaucgucucgucuuacguguguuccggacugguuggcgacacgccccgcaagaaugauucaaguagcuccucucauugccuugacccuaacaaugaggaaggugggcacggagugaaaggcugggcuuucgaugacggcaacgaugucuggauggggcgaaccaucagcgagaagucaagauugggauaugaaacauuuaaagugauugaggguuggaguaauccaaaguccaaacugcagaucaacaggcagguaauuguugaccggggcaaucguagcggguacucuggaauauucucaguggagggcaagaguuguaucaaccgcugcuuuuaugucgaacuaauuagagguaggaaggaggaaacugaggugcucuggaccagcaauuccaucgucguguucugugggacaucuggcacuuacggaaccggcucguggcccgauggggccaacaucaaucugaugccuauuuga

SEQ ID NO: 141285 - RNA, 1410 nt, Artificial Sequence; identical to SEQ ID NO: 138615
  derived and/or modified sequence opt3 from neuraminidase__InfluenzaA__ADK99033

SEQ ID NO: 141286 - RNA, 1410 nt, Artificial Sequence
  derived and/or modified sequence opt3 from neuraminidase__InfluenzaA__ADK99044
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauaagaccgaaauuguguauuugacaaacaccacuaucgagaaagaaauuugccccaaguuagcugaguacaggaauuggaguaaaccucagugugacaucacaggguucgcaccauuuagcaaggauaacuccauacggcugucugccggaggugacauuuggguaacccgcgagcccuaugugucgugcgauccugacaaguguuaccaauucgcgcuaggccaggggacgacucucaauaacggacauucaaauaacaccguccgagaucguacaccauauagaacucugcuuaugaaugaacugggcgugcccuuucacuuggguaccaaacagguuugcaucgcuuggagcaguuccucuugucaugacgggaaggccuggcuccacgugugcauuacaggagaugacaaaaacgcaaccgccagcuucaucuacaauggcaagcuggucgauuccgugguaucauggaguaaagagauccugaggacgcaggaaagcgaguguguuugcauuaacggcacuuguacaguggucaugaccgacgggucugcuuccggaaaggcagauacuaagauacucuuuaucgaggaagguaaaauugugcauacaucaaccuuaagcggcagugcccaacacguggaggaaugcucuugcuauccucgguacccagggguccgcuguguuugcagagacaacuggaagggauccaauaggccgaucguggauauaaacauuaaagaccacagcaucguaucgucuuacguguguuccggccuggucggugacacgccccggaagaaugauucaaguagcuccucucauugccuugacccuaacaaugaggaagggggacacggcgugaaaggcugggcuuucgaugacgggaacgauguuuggaugggacgcaccaucagcgagaagucacgauuggguuaugagacauuuaaagugauugaaggcuggaguaaucauaaguccaagcugcagaucaacagacaggucauuguggacagggggaaucggagcggauacucuggcauauucucaguagaggguaaaaguuguaucaaccguugcuuuuauguugaacuaauucgcgggagaaaggaggaaacugaggugcucuggaccagcaauuccaucgucguguucuguggcacaucuggaacuuacggcaccgggucguggccagauggagccgaccugaaccuuaugcccaucuga

SEQ ID NO: 141287 - RNA, 1410 nt, Artificial Sequence
  derived and/or modified sequence opt3 from neuraminidase__InfluenzaA__ADK99055
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaugaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccaucagcgagaagucaagauugggauaugagacauuuaaagucauugaagguuggaguaauccaaaguccaaacugcagaucaacaggcaagugauuguagaccggggcaaucguagcggguacucuggaauauucucaguugagggcaagaguuguaucaaccgcugcuuuuauguggaacuaauuagagguaggaaggaggaaacugagguccucuggaccagcaauuccaucguggucuucugugggacaucuggcacuuacggaaccggcucguggcccgauggggccgacaucaaccugaugccuauuuga

SEQ ID NO: 141288 - RNA, 1410 nt, Artificial Sequence
  derived and/or modified sequence opt3 from neuraminidase__InfluenzaA__ADK99066
augaaccccaaucagaagaucauuaccauaggcagcgugucccugacaaucucuacuauuugcuucuuuaugcaaaucgccauucucaucacgaccgucacacuucacuucaaacagugugaguuuaacucaccuccaaauaaccagguuaugcugugcgaaccgacuauaaucgagagaaauauuaccgaaaucguguacuugacaaacaccacuauugagaagaaaaucugucccaaguuagcugaauauaggaauuggaguaaaccucagugcgacauaacaggguucgcaccauuuagcaaggauaacuccauucggcugucugccggaggugacaucuggguaacccgcgagcccuacgugucgugugauccugacaagugcuaucaauucgcgcuaggccaggggacgacucucaauaacguccauucaaauaacaccgugcgagaucguacaccauacagaacucugcuuaugaaugagcugggaguucccuuucacuugggcaccaaacagguguguauugcuuggagcaguuccucuugccaugacgguaaggccuggcuccacgucuguaucacaggggaugacaaaaacgcaaccgccagcuucaucuauaauggaaggcugguggauuccguaguuucauggaguaaggaaauucugcggacgcaggagagcgaaugcguguguauaaacggcacuugcacagucgugaugaccgacggcucugcuuccgggaaagcagauacuaagauccucuuuauugaggagggaaagaucgugcauacaucaaccuuaagcgguagugcccaacacgucgaagagugcucuuguuacccucgcuauccaggcguuagaugcguguguagggacaacuggaaaggguccaaucggccgauaguagauauuaacaucaaggaccacagcaucgugucgucuuaccugugcuccggacuugucggcgacacgccccgcaaaaaugauucaaguagcuccucucauuguuuggacccuaacaaugaagagggugggcacggagugaagggcugggcuuucgaugacggcaacgauguuuggauggggcgaaccauuagcgaaaaaucaagacugggauacgagacauuuaaggugaucgaggguuggaguaauccaaaauccaagcuacagauuaacaggcaggucauaguggaccggggcaaucguagcggguauucuggaaucuucucaguagaaggcaagaguugcauuaaccgcuguuuuuacguugagcucaucagagguaggaaagaagagacugaagugcuguggaccagcaauuccaucgucguguucugcgggacaucuggcacuuauggaaccggcucguggcccgauggggccaacauuaaucuuaugccuauauga

SEQ ID NO: 141289 - RNA, 1410 nt, Artificial Sequence
  derived and/or modified sequence opt3 from neuraminidase__InfluenzaA__ADK99077
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagacauucugcggacgcaggagagcgaaugugugugcauaaacggcacuuguacagucgugaugaccgauggcucugcuuccgggaaggcagacacuaaaauccucuuuauugaggagggaaaggugguccauacaucaaccuuaagcgguagugcccaacacguugaagagugcucuugcuauccucgcuacccaggcgugagauguguaugcagggauaacuggaagggguccaaucggccgaucguggacauaaacauuaaagaccacagcaucgucucgucuuacguguguuccggacugguuggcgauacgccccgcaagaaugacucaaguagcuccucucauugccuugauccuaacaaugaagagggugggcacggagugaaaggcugggcuuucgacgauggcaacgacgucuggauggggcgaaccaucagcgaaaagucaagauugggauaugagacauuuaaagugauugaggguuggaguaaucauaaguccaaacugcagaucaacaggcagguaauuguugaucggggcaaucguagcggguacucuggaauauucucaguggaaggcaagaguuguaucaaccgcugcuuuuaugucgagcuaauuagagguaggaaggaagagacugaagugcucuggaccagcaauuccaucgucguguucugugggacaucuggcacuuacggaaccggcucguggccagacggggccgaucugaaccuuaugcccaucuga

SEQ ID NO: 141290 - RNA, 1410 nt, Artificial Sequence; identical to SEQ ID NO: 141054
  derived and/or modified sequence opt3 from neuraminidase__InfluenzaA__ADK99088

SEQ ID NO: 141291 - RNA, 1410 nt, Artificial Sequence; identical to SEQ ID NO: 140500
  derived and/or modified sequence opt3 from neuraminidase__InfluenzaA__ADK99099

SEQ ID NO: 141292 - RNA, 1410 nt, Artificial Sequence
  derived and/or modified sequence opt3 from neuraminidase__InfluenzaA__ADK99110
augaaccccaaucagaagaucauuaccauaggcagcgugucccugacaaucucuacuauuugcuucuuuaugcaaaucgccauucucgucacgaccguuacacuucacuucaaacaguacgaguuuaacccuccaccgaauaaccaggugaugcugugugaacccacuaucauagagagaaauaucaccgaaauuguauauuugacaaacaccacuaucgagaaggaaauuugcccuaaauuagcugaguacaggaauuggucaaagccacagugugacaucacaggguucgcacccuuuaguaaagauaacagcauacggcuguccgccggaggugacauuugggugacccgcgagccuuaugucucuugcgauccagacaaguguuaccaauucgcgcuaggccaggggacgacucucaauaacgugcauucgaauaacaccguucgagaucguacacccuauagaacucugcuuaugaaugaacugggagugccuuuucacuugggcaccaagcaggucugcaucgcuuggucaagcaguuccugucaugacgguaaagccuggcuccacgugugcauuacaggggaugacaagaacgcaaccgccucuuucaucuacaauggaaggcugguagauagcguuguguccuggucaaaagacauccugcggacgcaggagagugaaugugucugcauuaacggcacuuguacaguggugaugaccgauggcagcgcuucugggaaggcagacacuaaaauacucuuuaucgaggagggaaagauuguccauacauccaccuuaucagguagcgcccaacacguugaagagugcaguugcuauccacgcuacccgggcgugagauguguaugcagggauaacuggaaggggucuaaucggcccaucguggacauaaacauuaaagaccacuccaucgucagcucguacguguguucuggacugguuggcgauacgccucgcaagaaugacuccucaaguagcucccauugccuugauccaaacaaugaagagggugggcacggagugaaaggcugggcuuucgacgauggcaacgacgucuggauggggcgaaccaucucugaaaagagcagauugggauaugagacauuuaaagugauugaggguuggucaaaucccaagaguaaacugcagaucaacaggcagguaauuguugaucggggcaaucguuccggguacagcggaauauucucuguggaaggcaagucauguaucaaccgcugcuuuuaugucgagcuaauuagagguaggaaggaagagacugaagugcucuggaccaguaauagcaucgucguguucugugggacauccggcacuuacggaaccggcucuuggccugacggggccaacaucaaucugaugccaauuuga

SEQ ID NO: 141293 - RNA, 1410 nt, Artificial Sequence; identical to SEQ ID NO: 141139
  derived and/or modified sequence opt3 from neuraminidase__InfluenzaA__ADK99121

SEQ ID NO: 141294 - RNA, 1410 nt, Artificial Sequence
  derived and/or modified sequence opt3 from neuraminidase__InfluenzaA__ADK99132
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuguagagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcaucgcuuggagcaguuccucuugucaugacgguaaagccuggcuccacgugugcauuacaggggaugacaagaacgcaaccgccagcuucaucuacaauggaaggcugguagauuccguugugucauggaguaaagagauccugcggacgcaggaaagcgagugugucugcauuaacggcacuuguacaguggugaugaccgacggcucugcuuccgggaaggcagauacuaaaauacucuuuaucgaggaaggaaagauuguccauacaucaaccuuaagcgguagugcccaacacguugaggaaugcucuugcuauccucgcuacccaggcgugagauguguaugcagggacaacuggaagggguccaaucggccgaucguggauauaaacauuaaagaccacagcaucgucucgucuuaccuguguuccggacuugugggcgacacgccccgcaagaaugauucaaguagcuccucucauugcuuggacccuaacaaugaggaaggugggcacggaguuaaaggcugggcuuucgaugacggcaacgauguguggauggggcgaaccaucagcgagaagucaagacugggauaugagacauuuaaagucauugaagguuggaguaauccaaaguccaaacuacagaucaacaggcaagugauuguagaccggggcaaucguagcggguacucuggaauauucucaguugagggcaagaguuguaucaaccgcugcuuuuauguggaacucauuagagguaggaaggaggaaacugagguccuguggaccagcaauuccaucguggucuucugugggacaucuggcacuuacggaaccggcucguggcccgauggggccgacaucaaccuuaugccuauuuga

SEQ ID NO: 141295 - RNA, 1410 nt, Artificial Sequence; identical to SEQ ID NO: 141139
  derived and/or modified sequence opt3 from neuraminidase__InfluenzaA__ADK99143

SEQ ID NO: 141296 - RNA, 1410 nt, Artificial Sequence; identical to SEQ ID NO: 138615
  derived and/or modified sequence opt3 from neuraminidase__InfluenzaA__ADK99154

SEQ ID NO: 141297 - RNA, 1410 nt, Artificial Sequence
  derived and/or modified sequence opt3 from neuraminidase__InfluenzaA__ADK99176
augaaccccaaucagaagaucauuaccauaggcagcgugucccugacaaucucuacuauuugcuucuuuaugcaaaucgccauucucgucacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugcuuaaaacuggcugaguacaggaauuggaguaagccccagugugacaucacaggguucgcaccuuuuagcaaagauaacuccauacggcuaucugccggaggugacauuugggugacccgcgagccauaugucucgugcgaucccgacaaguguuaccaauucgcgcucggccaggggacgacucugaauaacgugcauucaaauaacaccguucgagaucguacaccuuauagaacucuucugaugaaugaauugggagugccauuucaccucggcaccaagcaggucugcaucgcuuggagcaguuccucuugucaugacgguaaagccuggcugcacgugugcauuacaggggaugacaagaacgcaaccgccagcuucaucuacaauggaaggcugguagauuccguugugucauggaguaaagacauccuccggacgcaggagagcgaaugugucugcauuaacggcacuuguacaguggugaugaccgauggcucugcuuccgggaaggcagacacuaaaauauuauuuaucgaggagggaaagauuguccauacaucaacccugagcgguagugcccaacacguugaagagugcucuugcuauccccgcuacccuggcgugagauguguaugcagggauaacuggaagggguccaaucggccaaucguggacauaaacauuaaagaccacagcaucgucucgucuuacguguguuccggacuuguuggcgauacgccgcgcaagaaugacucaaguagcuccucucauugcuuggaucccaacaaugaagagggugggcacggagugaaaggcugggcuuucgacgauggcaacgacgucuggauggggcgaaccaucagcgaaaagucaagacugggauaugagacauuuaaagugauugaggguuggaguaauccuaaguccaaacuacagaucaacaggcagguaauuguugaucggggcaaucguagcggguacucuggaauauucucaguggaaggcaagaguuguaucaaccgcugcuuuuaugucgagcucauuagagguaggaaggaagagacugaagugcuguggaccagcaauuccaucgucguguucugugggacaucuggcacuuacggaaccggcucguggccagacggggccaacaucaaucuuaugcccauuuga

SEQ ID NO: 141298 - RNA, 1410 nt, Artificial Sequence; identical to SEQ ID NO: 141289
  derived and/or modified sequence opt3 from neuraminidase__InfluenzaA__ADK99187

SEQ ID NO: 141299 - RNA, 1410 nt, Artificial Sequence; identical to SEQ ID NO: 140500
  derived and/or modified sequence opt3 from neuraminidase__InfluenzaA__ADK99198

SEQ ID NO: 141300 - RNA, 1410 nt, Artificial Sequence; identical to SEQ ID NO: 141139
  derived and/or modified sequence opt3 from neuraminidase__InfluenzaA__ADK99220

SEQ ID NO: 141301 - RNA, 1410 nt, Artificial Sequence
  derived and/or modified sequence opt3 from neuraminidase__InfluenzaA__ADK99231
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaauuguuaccaauucgcgcuaggccaggggacgacucucaacaauguccauucaaacaauaccgugcgagaucguacaccauauagaacucugcuuaugaacgaacugggaguucccuuucacuugggcaccaaacaggugugcauugcuuggagcaguuccucuugucaugacgguaaggccuggcuccacgucugcaucacaggggaugacaagaaugcaaccgccagcuucaucuacaacggaaggcugguggauuccguaguuucauggaguaaggagauucugcggacgcaggaaagcgagugugugugcauaaacggcacuuguacagucgugaugaccgacggcucugcuuccgggaaagcagauacuaagauccucuuuauugaggaaggaaaaaucgugcauacaucaaccuuaagcgguagugcccaacacgucgaggaaugcucuugcuauccucgcuacccaggcguuagaugugugugcagggacaauuggaagggguccaaccggccgauaguagauauuaauaucaaggaccacagcaucgugucgucuuaccuguguuccggacuugucggcgacacgccccgcaaaaacgauucaaguagcuccucucauugcuuggacccuaauaacgaggaaggugggcacggagugaagggcugggcuuucgaugacggcaaugauguuuggauggggcgaaccauuagcgagaaaucaagacugggauaugagacauuuaaggugaucgaagguuggaguaacccaaaauccaagcuacagauuaauaggcaggucauaguggaccggggcaaccguagcggguacucuggaaucuucucaguagagggcaaaaguuguauuaaucgcugcuuuuauguugaacucaucagagguaggaaggaggaaacugaggugcuguggaccagcaacuccaucgucguguucugugggacaucuggcacuuacggaaccggcucguggcccgauggggccgacauuaaucuuaugccuauauga

SEQ ID NO: 141302 - RNA, 1410 nt, Artificial Sequence
  derived and/or modified sequence opt3 from neuraminidase__InfluenzaA__ADK99242
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagacauucugcggacgcaggagagcgaaugugugugcauaaacggcacuuguacagucgugaugaccgauggcucugcuuccgggaaggcagacacuaaaauccucuuuauugaggagggaaagaucgugcauacaucaaccuuaagcgguagugcccaacacgucgaagagugcucuugcuauccucgcuacccaggcguuagaugugugugcagggauaacuggaagggguccaaucggccgauaguagacauuaacaucaaagaccacagcaucgugucgucuuacgucuguuccggacuggugggcgauacgccccgcaagaaugacucaaguagcuccucucauugccuugauccuaacaaugaagagggugggcacggaguuaaaggcugggcuuucgacgauggcaacgacguguggauggggcgaaccauuagcgaaaagucaagauugggauaugagacauuuaaagucaucgaggguuggaguaauccaaaguccaaacugcagauuaacaggcaagugauaguagaucggggcaaucguagcggguacucuggaaucuucucaguugaaggcaagaguuguauuaaccgcugcuuuuauguggagcuaaucagagguaggaaggaagagacugaaguccucuggaccagcaauuccaucauuguguucugugggacaucuggcacuuacggaaccggcucguggcccgacggggccgauauaaaccugaugccuaucuga

SEQ ID NO: 141303 - RNA, 1410 nt, Artificial Sequence
  derived and/or modified sequence opt3 from neuraminidase__InfluenzaA__ADK99253
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaaucauaaguccaaacugcagauuaacaggcaagugauaguagaccggggccaccguagcggguacucuggaaucuucucaguugagggcaagaguuguauuaaucgcugcuuuuauguggaacuaaucagagguaggaaggaggaaacugagguccucuggaccagcaacuccaucguggucuucugugggacaucuggcacuuacggaaccggcucguggccagauggggccgaccugacacuuaugcccauuuga

SEQ ID NO: 141304 - RNA, 1410 nt, Artificial Sequence
  derived and/or modified sequence opt3 from neuraminidase__InfluenzaA__ADK99264
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuaccuguguuccggacuugucggcgacacgccccgcaagaaugauucaaguagcuccucucauugcuuggacccuaacaaugaggaaggugggcacggagugaaaggcugggcuuucgaugacggcaacgauguuuggauggggcgaaccauuagcgagaagucaagacugggauaugagacauuuaaagugaucgaagguuggaguaauccaaaguccaaacuacauauuaacaggcaggucauaguggaccggggcaaucguagcggguacucuggaaucuucucaguagagggcaagaguuguauuaaccgcugcuuuuauguugaacucaucagagguaggaaggaggaaacugaggugcuguggaccagcaauuccaucgucguguucugugggacaucuggcacuuacggaaccggcucguggcccgauggggccgacauuaaccuuaugccuauauga

SEQ ID NO: 141305 - RNA, 1410 nt, Artificial Sequence
  derived and/or modified sequence opt3 from neuraminidase__InfluenzaA__ADK99275
augaaccccaaucagaagaucauuaccauaggcagcgugucccugacaaucucuacuauuugcuucuuuaugcaaaucgccguccucauuacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcuggguacaggaauuggaguaagccucagugugacaucacaggauucgcaccauuuagcaaagauaacuccauacggcugucugccgguggcgacauuugggugacccgcgagcccuaugucucgugcgauccugacaaguguuaccaauucgcgcuagggcagggaacgacucucaauaacgugcauucaaaugauaccguucgagaccguacaccauauagaacucugcuuaugaacgagcugggcgugcccuuucacuuggguaccaagcaggucugcaucgcuuggagcaguuccucuugucaugaugggaaagccuggcuccacgugugcauuacaggagacgauaagaaugcaaccgccagcuucaucuacaacggcaggcugguagacuccguugugucauggaguaaagaaauccugcggacgcaggagagcgaaugugucugcauuaauggcacuuguacaguggugaugaccgaugggucugcuuccggaaaggcagacacuaaaauacucuuuaucgaggaggguaagauuguccauacaucaaccuuaagcggcagugcccaacacguugaagagugcucuugcuauccucgcuacccaggggugagauguguaugcagggauaacuggaagggauccaaccggccgaucguggacauaaauauuaaagaccacagcaucgucucgucuuacguguguuccggccugguuggugauacgccccgcaagaacgacucaaguagcuccucucauugccuugauccuaauaacgaagaagggggacacggcgugaaaggcugggcuuucgacgaugggaaugacgucuggaugggacgaaccaucaacgagacaagcagauuggguuaugagacuuuuaaggugauugagggcuggucaaauccaaaaaguaagcugcagaucaacaggcagguaauuguugaucgggggaaucguuccggauacagcggcauauucucuguggaagguaaaucauguaucaaccgcugcuuuuaugucgagcuaauuagagggaggaaggaagagaccgaagugcucuggacaaguaauagcaucgucguguucuguggcacuuccggaaccuacggcacagggucuuggcccgacggagccgaucugaaccuuaugccuaucuga

SEQ ID NO: 141306 - RNA, 1410 nt, Artificial Sequence
  derived and/or modified sequence opt3 from neuraminidase__InfluenzaA__ADK99286
augaaccccaaucagaagaucauuaccauaggcagcgugucccugacaaucucuacuauuugcuucuuuaugcaaaucgccauucucaucacgaccgucacacuucacuucaaacaguacgaguuuaacccuccaccgaauaaccagguuacucccagagaaccuaccauaaucgagaggaauauuacagaaaucguguaucugaccaacacuacaauugagaaggaaaucuguccaaaauuggcugaguaccggaauuggucaaagccccagugcgacauaaccggguucgcaccuuuuaguaaagauaacagcauucgcuuauccgccggaggugacaucuggguaacgcgagagccauaugugucuugugaucccgacaagugcuaccaauucgcgcugggccaggggacuacccuaaauaacauucauucgaauaacacaguccgugauagaacuccuuauaggacccuccugaugaaugaacuuggagugccauuucaccugggcacaaagcagguuuguaucgcuuggucaagcaguuccugccaugacgguaaagccugguugcacguguguaucaccggggaugacaagaacgcaacggccucuuucauuuacaauggacggcucgucgauagcgugguauccuggucaaaagagauacugcgcacucaggaaagugagugcguuuguaucaacggcacaugcaccguggucaugacugacggcagcgcuucugggaaggcagauacaaaaauucuguuuaucgaggaaggaaagauagugcauaccuccacgcucucagguagcgcccaacacguggaggaauguaguugcuauccgagauaccccggcgucaggugcguuugucgggacaacuggaaggggucuaaucgcccuauuguggauaucaacaucaaagaccacuccauuguaagcucguacgugugcucuggauuagucggcgacaccccacgaaagaaugauuccucaaguagcucccauugucuggaccccaacaaugaggaaggugggcacggagugaaaggcugggcuuucgaugacggcaacgauguuuggauggggagaacaaucucugaaaagagcaggcuuggauaugagacuuuuaaagugauugaggguuggucaaauccuaagaguaaauugcagauaaaccggcaggucaucguggaccguggcaaucgcuccggguacagcggaauuuucucuguagagggcaagucaugcaucaacagauguuuuuauguugaacugaucaggggucggaaggaggaaaccgaggugcuauggacaaguaauagcauugucguguucugcgggacuuccggcaccuacggaacaggcucuuggccagauggggccgacauaaaccucaugcccaucuga

SEQ ID NO: 141307 - RNA, 1410 nt, Artificial Sequence; identical to SEQ ID NO: 139608
  derived and/or modified sequence opt3 from neuraminidase__InfluenzaA__ADK99297

SEQ ID NO: 141308 - RNA, 1410 nt, Artificial Sequence
  derived and/or modified sequence opt3 from neuraminidase__InfluenzaA__ADK99308
augaaccccaaucagaagaucauuaccauaggcagcgugucccugacaaucucuacuauuugcuucuuuaugcagaucgccauucucgucacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggaauccccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagacauucugcggacgcaggagagcgaaugugugugcauaaacggcacuuguacagucgugaugaccgauggcucugcuuccgggaaggcagacacuaaaauccucuuuauugaggagggaaagaucgugcauacaucaaccuuaagcgguagugcccaacacgucgaagagugcucuugcuauccucgcuacccaggcguuagaugugugugcagggauaacuggaagggguccaaucggccgauaguagacauuaacaucaaagaccacagcaucgugucgucuuacgucuguuccggacuggugggcgauacgccccgcaagaaugacucaaguagcuccucucauugccuugauccuaacaaugaagagggugggcacggaguuaaaggcugggcuuucgacgauggcaacgacguguggauggggcgaaccauuagcgaaaagucaagauugggauaugagacauuuaaagucaucgaggguuggaguaauccaaaguccaaacugcagauuaacaggcaagugauaguagaucggggcaaucguagcggguacucuggaaucuucucaguugaaggcaagaguuguauuaaccgcugcuuuuauguggagcuaaucagagguaggaaggaagagacugaaguccucuggaccagcaauuccaucguggucuucugugggacaucuggcacuuacggaaccggcucguggcccgacggggccaacauuaaucugaugccuauauga

SEQ ID NO: 141309 - RNA, 1413 nt, Artificial Sequence; identical to SEQ ID NO: 139477
  derived and/or modified sequence opt3 from neuraminidase__InfluenzaA__ADL14590

SEQ ID NO: 141310 - RNA, 1410 nt, Artificial Sequence; identical to SEQ ID NO: 140500
  derived and/or modified sequence opt3 from neuraminidase__InfluenzaA__ADL27992

SEQ ID NO: 141311 - RNA, 1410 nt, Artificial Sequence; identical to SEQ ID NO: 141139
  derived and/or modified sequence opt3 from neuraminidase__InfluenzaA__ADL28003

SEQ ID NO: 141312 - RNA, 1410 nt, Artificial Sequence; identical to SEQ ID NO: 141284
  derived and/or modified sequence opt3 from neuraminidase__InfluenzaA__ADL28014

SEQ ID NO: 141313 - RNA, 1410 nt, Artificial Sequence
  derived and/or modified sequence opt3 from neuraminidase__InfluenzaA__ADL28025
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaagaaaaucugccccaaguuagcugaauacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugagcugggaguucccuuucacuugggcaccaaacaggugugcauugcuuggagcaguuccucuugucaugacgguaaggccuggcuccacgucugcaucacaggggaugacaaaaacgcaaccgccagcuucaucuacaauggaaggcugguggauuccguaguuucauggaguaaggaaauucugcggacgcaggagagcgaaugugugugcauaaacggcacuuguacagucgugaugaccgacggcucugcuuccgggaaagcagauacuaagauccucuuuauugaggagggaaagaucgugcauacaucaaccuuaagcgguagugcccaacacgucgaagagugcucuugcuauccucgcuacccaggcguuagaugugugugcagggacaacuggaaaggguccaaucggccgauaguagauauuaacaucaaggaccacagcaucgugucgucuuaccuguguuccggacuugucggcgacacgccccgcaaaaaugauucaaguagcuccucucauugcuuggacccuaacaaugaagagggugggcacggagugaagggcugggcuuucgaugacggcaacgauguuuggauggggcgaaccauuagcgaaaaaucaagacugggauaugagacauuuaaggugaucgaggguuggaguaauccaaaauccaagcuacagauuaacaggcaggucauaguggaccggggcaaucguagcggguacucuggaaucuucucaguagaaggcaagaguuguauuaaccgcugcuuuuauguugagcucaucagagguaggaaagaagagacugaagugcuguggaccagcaauuccaucgucguguucugugggacaucuggcacuuacggaaccggcucguggcccgauggggccgacauuaaccuuaugccuauauga

SEQ ID NO: 141314 - RNA, 1410 nt, Artificial Sequence; identical to SEQ ID NO: 140500
  derived and/or modified sequence opt3 from neuraminidase__InfluenzaA__ADL28036

SEQ ID NO: 141315 - RNA, 1410 nt, Artificial Sequence; identical to SEQ ID NO: 138615
  derived and/or modified sequence opt3 from neuraminidase__InfluenzaA__ADL28047

SEQ ID NO: 141316 - RNA, 1410 nt, Artificial Sequence; identical to SEQ ID NO: 139921
  derived and/or modified sequence opt3 from neuraminidase__InfluenzaA__ADL28058

SEQ ID NO: 141317 - RNA, 1410 nt, Artificial Sequence; identical to SEQ ID NO: 141292
  derived and/or modified sequence opt3 from neuraminidase__InfluenzaA__ADL28069

SEQ ID NO: 141318 - RNA, 1410 nt, Artificial Sequence; identical to SEQ ID NO: 141139
  derived and/or modified sequence opt3 from neuraminidase__InfluenzaA__ADL28080

SEQ ID NO: 141319 - RNA, 1410 nt, Artificial Sequence; identical to SEQ ID NO: 140500
  derived and/or modified sequence opt3 from neuraminidase__InfluenzaA__ADL28091

SEQ ID NO: 141320 - RNA, 1410 nt, Artificial Sequence
  derived and/or modified sequence opt3 from neuraminidase__InfluenzaA__ADL28102
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagacauucugcggacgcaggagagcgaaugugugugcauaaacggcacuuguacagucgugaugaccgauggcucugcuuccgggaaggcagacacuaaaauccucuuuauugaggagggaaagaucgugcauacaucaaccuuaagcgguagugcccaacacgucgaagagugcucuugcuauccucgcuacccaggcguuagaugugugugcagggauaacuggaagggguccaaucggccgauaguagacauuaacaucaaagaccacagcaucgugucgucuuacgucuguuccggacuggugggcgauacgccccgcaagaaugacucaaguagcuccucucauugccuugauccuaacaaugaagagggugggcacggaguuaaaggcugggcuuucgacgauggcaacgacguguggauggggcgaaccauuagcgaaaagucaagauugggauaugagacauuuaaagucaucgaggguuggaguaauccaaaguccaaacugcagauuaacaggcaagugauaguagaucggggcaaucguagcggguacucuggaaucuucucaguugaaggcaagaguuguauuaaccgcugcuuuuauguggagcuaaucagagguaggaaggaagagacugaaguccucuggaccagcaauuccaucguggucuucugugggacaucuggcacuuacggaaccggcucguggcccgacggggccgauauuaaccugaugccuauauga

SEQ ID NO: 141321 - RNA, 1410 nt, Artificial Sequence; identical to SEQ ID NO: 138615
  derived and/or modified sequence opt3 from neuraminidase__InfluenzaA__ADL28113

SEQ ID NO: 141322 - RNA, 1410 nt, Artificial Sequence
  derived and/or modified sequence opt3 from neuraminidase__InfluenzaA__ADL28129
augaaccccaaucagaagaucauuaccauaggcagcgugucccugacaaucucuacuauuugcuucuuuaugcaaaucgccauucucgucacgaccguuacacuucacuucaaacaguacgaguuuaacucaccuccaaauaaccaggugaugcugugugaaccgacuaucauagagagaaauaucaccgaaauuguauauuugacaaacaccacuaucgagaaggaaauuugccccaaauuagcugaguacaggaauuggaguaagccucagugugacaucacaggguucgcaccauuuagcaaagauaacuccauacggcugucugccggaggugacauuugggugacccgcgagcccuaugucucgugcgauccugacaaguguuaccaauucgcgcuaggccaggggacgacucucaauaacgugcauucaaauaacaccguucgagaucguacaccauauagaacucugcuuaugaaugaacugggagugcccuuucacuugggcaccaagcaggucugcaucgcuuggagcaguuccucuugucaugacgguaaagccuggcuccacgugugcauuacaggggaugacaagaacgcaaccgccagcuucaucuacaauggaaggcugguagauuccguugugucauggaguaaagacauccugcggacgcaggagagcgaaugugucugcauuaacggcacuuguacaguggugaugaccgauggcucugcuuccgggaaggcagacacuaaaauacucuuuaucgaggagggaaagauuguccauacaucaaccuuaagcgguagugcccaacacguugaagagugcucuugcuauccucgcuacccaggcgugagauguguaugcagggauaacuggaagggguccaaucggccgaucguggacauaaacauuaaagaccacagcaucgucucgucuuacguguguuccggacugguuggcgauacgccccgcaagaaugacucaaguagcuccucucauugccuugauccuaacaaugaagagggugggcacggagugaaaggcugggcuuucgacgauggcaacgacgucuggauggggcgaaccaucagcgaaaagucaagauugggauaugagacauuuaaagugauugaggguuggaguaauccaaaguccaaacugcagaucaacaggcagguaauuguugaucggggcaaucguagcggguacucuggaauauucucaguggaaggcaagaguuguaucaaccgcugcuuuuaugucgagcuaauuagagguaggaaggaagagacugaaauccucuggaccagcaauuccaucguggucuucugugggacaucuggcacuuacggaaccggcucguggcccgacggggccaacauuaaucugaugccuauauga

SEQ ID NO: 141323 - RNA, 1410 nt, Artificial Sequence
  derived and/or modified sequence opt3 from neuraminidase__InfluenzaA__ADL28140
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaaacugguggauuccguaguuucauggaguaaggagauucugaggacgcaggaaagcgagugugugugcauaaacggcacuuguacagucgugaugaccgacggcucugcuuccgggaaagcagauacuaagauccucuuuauugaggaaggaaagaucgugcauacaucaaccuuaagcgguagugcccaacacgucgaggaaugcucuugcuauccucgguacccaggcguucgcugugugugcagagacaacuggaaaggguccaauaggccgauaguagauauuaacaucaaggaccacagcaucgugucgucuuacgucuguuccggacuggugggcgacacgccccggaaaaaugauucaaguagcuccucucauugccuugacccuaacaaugaggaaggugggcacggaguuaagggcugggcuuucgaugacggcaacgauguguggauggggcgcaccauuagcgagaaaucacgauugggauaugagacauuuaaggucaucgaagguuggaguaauccaaaauccaagcugcagauuaacagacaggugauaguagacaggggcaaucggagcggguacucuggaaucuucucaguugagggcaagaguuguauuaaccguugcuuuuauguggaacuaauccgcgguagaaaagaggaaacugagguccucuggaccagcaauuccaucguggucuucugugggacaucuggcacuuacggaaccggcucguggcccgauggggccaacauuaaucugaugccuauauga

SEQ ID NO: 141324 - RNA, 1410 nt, Artificial Sequence; identical to SEQ ID NO: 140500
  derived and/or modified sequence opt3 from neuraminidase__InfluenzaA__ADL28151

SEQ ID NO: 141325 - RNA, 1410 nt, Artificial Sequence; identical to SEQ ID NO: 139921
  derived and/or modified sequence opt3 from neuraminidase__InfluenzaA__ADL28162

SEQ ID NO: 141326 - RNA, 1410 nt, Artificial Sequence; identical to SEQ ID NO: 141139
  derived and/or modified sequence opt3 from neuraminidase__InfluenzaA__ADL28173

SEQ ID NO: 141327 - RNA, 1410 nt, Artificial Sequence; identical to SEQ ID NO: 140500
  derived and/or modified sequence opt3 from neuraminidase__InfluenzaA__ADL28184

SEQ ID NO: 141328 - RNA, 1410 nt, Artificial Sequence
  derived and/or modified sequence opt3 from neuraminidase__InfluenzaA__ADL28195
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcgucaacggcacuuguacaguggugaugaccgacggcucugcuuccgggaaggcagauacuaaaauacucuuuaucgaggaaggaaagauuguccauacaucaaccuuaagcgguagugcccaacacguugaggaaugcucuugcuauccucgcuacccaggcgugagauguguaugcagggacaacuggaagggguccaaucggccgaucguggauauaaacauuaaagaccacagcaucgucucgucuuacguguguuccggacugguuggcgacacgccccgcaagaaugauucaaguagcuccucucauugccuugacccuaacaaugaggaaggugggcacggagugaaaggcugggcuuucgaugacggcaacgaugucuggauggggcgaaccaucagcgagaagucaagauugggauaugagacauuuaaagugauugaagguuggaguaauccaaaguccaaacugcagaucaacaggcagguaauuguugaccggggcaaucguagcggguacucuggaauauucucaguggagggcaagaguuguaucaaccgcugcuuuuaugucgaacuaauuagagguaggaaggaggaaacugaggugcucuggaccagcaauuccaucgucguguucugugggacaucuggcacuuacggaaccggcucguggcccgauggggccgacaucaaccugaugccuauuuga

SEQ ID NO: 141329 - RNA, 1410 nt, Artificial Sequence; identical to SEQ ID NO: 141289
  derived and/or modified sequence opt3 from neuraminidase__InfluenzaA__ADL28206

SEQ ID NO: 141330 - RNA, 1410 nt, Artificial Sequence; identical to SEQ ID NO: 139608
  derived and/or modified sequence opt3 from neuraminidase__InfluenzaA__ADL28217

SEQ ID NO: 141331 - RNA, 1410 nt, Artificial Sequence; identical to SEQ ID NO: 140500
  derived and/or modified sequence opt3 from neuraminidase__InfluenzaA__ADL28228

SEQ ID NO: 141332 - RNA, 1410 nt, Artificial Sequence; identical to SEQ ID NO: 141139
  derived and/or modified sequence opt3 from neuraminidase__InfluenzaA__ADL28239

SEQ ID NO: 141333 - RNA, 1410 nt, Artificial Sequence; identical to SEQ ID NO: 139921
  derived and/or modified sequence opt3 from neuraminidase__InfluenzaA__ADL28250

SEQ ID NO: 141334 - RNA, 1410 nt, Artificial Sequence; identical to SEQ ID NO: 141139
  derived and/or modified sequence opt3 from neuraminidase__InfluenzaA__ADL28261

SEQ ID NO: 141335 - RNA, 1410 nt, Artificial Sequence; identical to SEQ ID NO: 140500
  derived and/or modified sequence opt3 from neuraminidase__InfluenzaA__ADL28373

SEQ ID NO: 141336 - RNA, 1410 nt, Artificial Sequence; identical to SEQ ID NO: 138619
  derived and/or modified sequence opt3 from neuraminidase__InfluenzaA__ADL28387

SEQ ID NO: 141337 - RNA, 1410 nt, Artificial Sequence
  derived and/or modified sequence opt3 from neuraminidase__InfluenzaA__ADL28391
augaaccccaaucagaagaucauuaccauaggcagcgugucccugacaaucucuacuauuugcuucuuuaugcagaucgccauucucaucacgaccgucacacuucacuucaaacaguacgaguuuaacucaaguccuaauaaccagguuaugcugugugaaccaacuauaaucgagagaaauauuaccgaaaucguguauuugacaaacaccacuauugagaaggaaaucugcccgaaauuagcugaguacaggaauuggagcaagccccagugugacauaacaggguucgcaccuuuuuccaaagauaacucuauucggcugucggccggaggugacaucuggguaacccgcgugccauaugucucaugcgaucccgacaaguguuaccaauucgcgcuaggccaggggacgacucucaauaacgugcauagcaauaacaccguucgagaucguacaccuuauagaacucugcuuaugaaugagcugggagugccauuucacuugggcaccaagcaggucugcauugcuuggaguuccucuagcugucaugacgguaaagccuggcuccacgugugcaucacaggggaugacaagaacgcaaccgccuccuucaucuacaauggaaggcugguagauucaauuguuaguuggagcaaagaaauacugcggacgcaggagucugaaugugugugcaucaacggcacuuguacagucgugaugaccgacggcuccgcuucagggaaggcagauacuaaaauucucuuuaucgaggagggaaagauagugcauacaagcaccuuaagugguucugcccaacacgucgaagagugcuccugcuauccccgcuacccuggcguuagaugugugugcagggacaacuggaaggggagcaaucggccaauuguagauaucaacaucaaagaccacucgauugugucuuccuacgucuguucaggacuggugggcgacacgccgcgcaagaaugauaguagcuccucuagccauugccuugaccccaacaaugaagagggugggcacggaguuaaaggcugggcuuucgaugacggcaacgauguguggauggggcgaaccaucucagaaaagaguagauugggauaugagacauuuaaagucauugaggguugguccaauccuaagagcaaacugcagauaaacaggcaagugaucguagaccggggcaaucguucuggguacucaggaauuuucaguguugaaggcaagagcuguaucaaccgcugcuuuuauguggagcuaaucagagguaggaaggaagagacugaaguccucuggaccuccaauucuauuguggucuucugugggacaucgggcacuuacggaaccggcagcuggccagauggggccgacauaaaccugaugcccaucuga

SEQ ID NO: 141338 - RNA, 1410 nt, Artificial Sequence
  derived and/or modified sequence opt3 from neuraminidase__InfluenzaA__ADL28395
augaaccccaaucagaagaucauuaccauaggcagcgugucccugacaaucgccacuauuugcuuccucaugcaaaucgcuauucuugucacgaccguuacacugcacuuuaaacaguacgaguguaacucuccuccaaauaaccaggugauguugugcgaaccggcaaucauagagagaaauaucacugaaauuguauauuuaaccaacacaaccaucgagaaggaaauuugucccaaacuggccgaguacaggaauuggucaaagccucagugcaacaucacuggguucgcgccauuuaguaaagacaauagcauacggcuauccgcuggaggugauauuugggugacacgcguccccuaugugucuugugacccugauaagugcuaccaauucgcccucggccaggggaccacgcugaacaauggacauucgaacgacacuguucacgaucgaaccccauaucguacacuucugaugaaugaguugggcgugcccuuucaucucgguacuagacaggucuguaucgcauggucaagcaguuccugccacgacgggaaggccuggcugcauguguguguaaccggagaugacgaaaacgcuacagcaucuuucauuuacaauggcaggcugguugauagcaucggcuccuggaguaaaaagauccuccggacccaggagucagaaugcguguguauuaacgggacgugcacugucgugaugacagacggaagcgccucugguaaagcugauaccaagauauuauuuaucgaggagggcaaaauugugaacaucuccacucugucagggagcgcccaacacgucgaagagugcaguuguuauccucgcuacccaggaguuagaugcguguguagggacaauuggaagggcucuaaccggccgauaguagauauuaaugugaaggacuacuccaucgucagcucguaugugugcucuggucuuguuggggacacaccccgcaaaaacgauuccuucucaaguagccacuguuuggacccuaauaacgaagagggaggccauggcgugaaggggugggcguuugaugacggaaaugaugucuggaugggucgaaccaucuccgaaaaauucagaucuggcuacgagacguuuaaggugauugagggguggagcaaaccaaacucaaagcugcagaucaauaggcagguaauuguugaacggggaaaccguaguggcuauuccgguauauucagcguggaggggaaaucuugcaucaaucgcuguuuuuacgucgaacuaauuagaggcaggaaggaggaaaccgaggugugguggacaucaaacaguaucgucguguucugcggaacuagcggcaccuaugggacaggauccuggcccgacggugcagauaucaaucucaugccuauuuga

SEQ ID NO: 141339 - RNA, 1410 nt, Artificial Sequence; identical to SEQ ID NO: 138754
  derived and/or modified sequence opt3 from neuraminidase__InfluenzaA__ADL29675

SEQ ID NO: 141340 - RNA, 1410 nt, Artificial Sequence; identical to SEQ ID NO: 138754
  derived and/or modified sequence opt3 from neuraminidase__InfluenzaA__ADL29685

SEQ ID NO: 141341 - RNA, 1410 nt, Artificial Sequence
  derived and/or modified sequence opt3 from neuraminidase__InfluenzaA__ADL29695
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacaucgucggcugguccuggcccgauggugcagaguuaccguucacuauugacaaguga

SEQ ID NO: 141342 - RNA, 1410 nt, Artificial Sequence; identical to SEQ ID NO: 138754
  derived and/or modified sequence opt3 from neuraminidase__InfluenzaA__ADL29705

SEQ ID NO: 141343 - RNA, 1410 nt, Artificial Sequence; identical to SEQ ID NO: 141341
  derived and/or modified sequence opt3 from neuraminidase__InfluenzaA__ADL29733

SEQ ID NO: 141344 - RNA, 1410 nt, Artificial Sequence; identical to SEQ ID NO: 138754
  derived and/or modified sequence opt3 from neuraminidase__InfluenzaA__ADL29743

SEQ ID NO: 141345 - RNA, 1410 nt, Artificial Sequence
  derived and/or modified sequence opt3 from neuraminidase__InfluenzaA__ADL29753
augaaccccaaucagaagaucauuaccauaggcagcgugugcauggccaucgggauggcuaaccugauucuccaaaucggaaauauuaucuccauauggaucucucacucaauucagcuugguaaccagaaucagaucgagacauguaaccaaagugucauuacuuacgaaaauaacacguggguuaaucagaccuaugugaacaucagcaauacaaacuucgcagccggccaguccguagugucugucaaacuggcgggaaauucgucauugugcccugugagcggaugggcuauauacaguaaggacaacuccauuagaaucggcucuaaaggugauguuuuugugauuagggagccauucaucagcuguuccccguuagaaugccggaccuuuuuccugacucagggggcccuacucaaugacaagcauucaaacggaacaaucaaagaucgcagucccuaucgaacccugaugagcuguccuauuggcgaggucccaucucccuacaacucccguuuugaaucaguggcauggagcgccagugcuugccacgacggcauaaauuggcuuacuaucgggauuucuggaccugauaacggugcaguagccguucugaaguauaauggcaucauaacagacaccauuaaguccuggagaaacaauaucuugaggacgcaagagagcgagugugcuugcgugaacgggucguguuucacugucaugaccgauggaccaucugacggccaggccuccuacaaaaucuuucggauugaaaaggguaaaaucgugaagucaguggagaugaaugcgcccaacuaucauuacgaagagugcaguuguuacccugauagcuccgagauuacaugcgucugccgcgacaauuggcacgggucuaacagaccauggguuagcuucaaucagaaccucgaauaucagauaggauacaucuguucaggcauuuuuggcgauaauccgaggcccaacgacaaaacugggaguugcggaccuguguccagcaauggugcaaacggcguaaagggguucucuuuuaaguauggaaacggcguguggaucggucggaccaaaucaaucaguagccgcaauggguucgagaugauuugggauccaaacggcuggacaggaaccgacaauaacuuuuccauaaagcaagacaucgucggcauuaaugaauggucuggguacucggggagcuucgugcagcaucccgagcugacgggucuggauuguauccgaccuugcuucuggguugaacucauuagaggcaggccaaaagagaacacuaucuggacauccgggucaaguauaucuuuuuguggagugaauagcgacaucgucggcugguccuggcccgauggugccgaguuaccguucaccauugacaaguga

SEQ ID NO: 141346 - RNA, 1410 nt, Artificial Sequence; identical to SEQ ID NO: 138754
  derived and/or modified sequence opt3 from neuraminidase__InfluenzaA__ADL29763

SEQ ID NO: 141347 - RNA, 1410 nt, Artificial Sequence; identical to SEQ ID NO: 141341
  derived and/or modified sequence opt3 from neuraminidase__InfluenzaA__ADL29773

SEQ ID NO: 141348 - RNA, 1410 nt, Artificial Sequence; identical to SEQ ID NO: 138754
  derived and/or modified sequence opt3 from neuraminidase__InfluenzaA__ADL29783

SEQ ID NO: 141349 - RNA, 1410 nt, Artificial Sequence; identical to SEQ ID NO: 141341
  derived and/or modified sequence opt3 from neuraminidase__InfluenzaA__ADL29882

SEQ ID NO: 141350 - RNA, 1410 nt, Artificial Sequence
  derived and/or modified sequence opt3 from neuraminidase__InfluenzaA__ADL32020
augaaccccaaucagaagaucauuaccauaggcagcgugugcaugacaaucgggauggccaaccugauucuccaaaucggaaauauuaucuccacuuggauaucucacucaauccagcuugguaaccagaaucagauugagacguguaaccaaagugucaucaccuacgaaaauaacacauggguuaaucagacuuaugugaacauuagcaauaccaacuucgcugcaggccaguccguagugucugucaaacuggccggaaauucgucauugugcccugugagcggaugggcgaucuacaguaaggacaacuccauaagaauuggcucuaaaggugauguuuuugugaucagggagccauucauuagcuguuccccguuagaaugccggacauuuuuccugacccagggggcucuacucaaugacaagcauucaaacggaacuaucaaagaucgcagucccuaucgaacacugaugagcuguccuaucggcgaggucccaucucccuacaacucccguuuugaaucaguggccuggagcgcaagugccugccacgacggcauuaauuggcuuaccauagggaucucuggaccugauaacggugcuguagcaguucugaaguauaauggcauuaucacggacacuauaaaguccuggagaaacaauauuuugaggacccaagagagcgagugugccugcgugaacgggucguguuucacagucaugacugauggaccaucugacggccaggcuuccuacaaaaucuuucggaucgaaaaggguaaaauugugaagucaguggagaugaaugcccccaacuaucauuacgaagagugcaguuguuacccugauagcuccgagauuaccugcgucugccgcgacaauuggcacgggucuaacagaccauggguuagcuucaaucagaaccucgaauaucagaucggauacauauguucaggcaucuuuggcgauaauccgaggcccaacgacaaaacagggaguugcggaccuguguccagcaauggugcgaacggcguaaagggguucucuuuuaaguauggaaacggcguguggauuggucggaccaaaucaaucaguagccgcaauggguucgagaugaucugggauccaaacggcuggacgggaacugacaauaacuuuuccauuaagcaagacauagucggcaucaaugaauggucuggguacucggggagcuucgugcagcaucccgagcugacaggucuggauuguauucgaccuugcuucuggguugaacucaucagaggcaggccaaaagagaacaccauuuggacuuccgggucaaguaucucuuuuuguggagugaauagcgacacagucggcugguccuggcccgauggugcagaguuaccguucaccauagacaaguga

SEQ ID NO: 141351 - RNA, 1410 nt, Artificial Sequence; identical to SEQ ID NO: 141341
  derived and/or modified sequence opt3 from neuraminidase__InfluenzaA__ADL32030

SEQ ID NO: 141352 - RNA, 1410 nt, Artificial Sequence; identical to SEQ ID NO: 138754
  derived and/or modified sequence opt3 from neuraminidase__InfluenzaA__ADL32040

SEQ ID NO: 141353 - RNA, 1410 nt, Artificial Sequence; identical to SEQ ID NO: 138754
  derived and/or modified sequence opt3 from neuraminidase__InfluenzaA__ADL32050

SEQ ID NO: 141354 - RNA, 1410 nt, Artificial Sequence; identical to SEQ ID NO: 138754
  derived and/or modified sequence opt3 from neuraminidase__InfluenzaA__ADL32060

SEQ ID NO: 141355 - RNA, 1410 nt, Artificial Sequence; identical to SEQ ID NO: 138754
  derived and/or modified sequence opt3 from neuraminidase__InfluenzaA__ADL32093

SEQ ID NO: 141356 - RNA, 1410 nt, Artificial Sequence; identical to SEQ ID NO: 138754
  derived and/or modified sequence opt3 from neuraminidase__InfluenzaA__ADL32117

SEQ ID NO: 141357 - RNA, 1410 nt, Artificial Sequence; identical to SEQ ID NO: 138754
  derived and/or modified sequence opt3 from neuraminidase__InfluenzaA__ADL32347

SEQ ID NO: 141358 - RNA, 1410 nt, Artificial Sequence
  derived and/or modified sequence opt3 from neuraminidase__InfluenzaA__ADL32357
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaacacaaucuggaccuccgggucaaguauaucuuuuuguggagugaauagcgacacugucggcugguccuggcccgauggugcagaguuaccguucacaguggacaaguga

SEQ ID NO: 141359 - RNA, 1410 nt, Artificial Sequence; identical to SEQ ID NO: 138754
  derived and/or modified sequence opt3 from neuraminidase__InfluenzaA__ADL32367

SEQ ID NO: 141360 - RNA, 1410 nt, Artificial Sequence; identical to SEQ ID NO: 138754
  derived and/or modified sequence opt3 from neuraminidase__InfluenzaA__ADL32377

SEQ ID NO: 141361 - RNA, 1410 nt, Artificial Sequence; identical to SEQ ID NO: 138754
  derived and/or modified sequence opt3 from neuraminidase__InfluenzaA__ADL32387

SEQ ID NO: 141362 - RNA, 1410 nt, Artificial Sequence; identical to SEQ ID NO: 138754
  derived and/or modified sequence opt3 from neuraminidase__InfluenzaA__ADL32397

SEQ ID NO: 141363 - RNA, 1410 nt, Artificial Sequence; identical to SEQ ID NO: 138754
  derived and/or modified sequence opt3 from neuraminidase__InfluenzaA__ADL32407

SEQ ID NO: 141364 - RNA, 1410 nt, Artificial Sequence; identical to SEQ ID NO: 138754
  derived and/or modified sequence opt3 from neuraminidase__InfluenzaA__ADL32417

SEQ ID NO: 141365 - RNA, 1410 nt, Artificial Sequence
  derived and/or modified sequence opt3 from neuraminidase__InfluenzaA__ADL32427
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcaauggugcgaacggcguaaagggguucucuuuuaaguauggaaacggcguguggaucggucggacaaaaucaaucaguagccgcaauggguucgagaugauuugggauccaaacggcuggaccggaacggacaauaacuuuuccauaaagcaagacaucgucggcauuaaugaauggucuggguacucggggagcuucgugcagcaucccgagcugacuggucuggauuguauccgaccuugcuucuggguugaacucauuagaggcaggccaaaagagaagacaaucuggaccuccgggucaauaaucaguuuuuguggagugaacucugacacugucggcuggagcuggcccgauggugcagaguuaccguucacaauugacaaauga

SEQ ID NO: 141366 - RNA, 1410 nt, Artificial Sequence; identical to SEQ ID NO: 138754
  derived and/or modified sequence opt3 from neuraminidase__InfluenzaA__ADL32447

SEQ ID NO: 141367 - RNA, 1410 nt, Artificial Sequence
  derived and/or modified sequence opt3 from neuraminidase__InfluenzaA__ADL32457
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaaauccauuagaaucggcucuaagggugauguuuuugugauuagggagccauucaucagcuguuccccguuagaaugccggaccuuuuuccugacacagggggcucuacucaacgacaaacauucaaauggaaccaucaaggaucgcagucccuaucgaacucugaugagcuguccuauuggcgaggucccaucucccuacaacucccguuuugaaucaguggccuggagcgcaagugccugccacgacggcauaucuuggcuuacaaucgggauuuccggaccugauaacggugcuguagcaguucugaaguauaauggcaucauaaccgacacgauuaaaagcuggagaaacaauaucuugaggacucaagagucggagugugccugcgugaacgggucuuguuucaccgucaugacagauggaccauccgacggccaggcuucauacaagaucuuucggauugaaaaagguaagaucgugaaaaguguggagaugaaugcccccaacuaucauuacgaagagugcagcuguuacccugauuccucugagauuacuugcgucugccgcgacaauuggcacgggagcaacagaccauggguuucauucaaucagaaccucgaauaucagauaggauacaucuguaguggcauuuuuggcgauaauccgaggcccaacgacaagaccggguccugcggaccugugagcucuaauggugcgaacggcguaaagggguucucauuuaaauauggaaauggcguguggaucggucggacaaagaguaucagcucccgcaacggguucgagaugauuugggauccaaacggcuggaccggaacggacaauaacuuuucuauaaaacaagacaucgucggcauuaaugaauggucgggguacagcggauccuucgugcagcaucccgagcugacuggucuggauuguauccgaccuugcuucuggguugaacucauuagaggcaggccaaaggagaacacaaucuggaccucagggaguucuauaucguuuuguggaguguccucagacacugucggcuggagcuggcccgauggugcagaguuaccguucacaaucgacaaauga

SEQ ID NO: 141368 - RNA, 1410 nt, Artificial Sequence; identical to SEQ ID NO: 139931
  derived and/or modified sequence opt3 from neuraminidase__InfluenzaA__ADL32487

SEQ ID NO: 141369 - RNA, 1410 nt, Artificial Sequence; identical to SEQ ID NO: 138754
  derived and/or modified sequence opt3 from neuraminidase__InfluenzaA__ADL32497

SEQ ID NO: 141370 - RNA, 1410 nt, Artificial Sequence; identical to SEQ ID NO: 138754
  derived and/or modified sequence opt3 from neuraminidase__InfluenzaA__ADL32507

SEQ ID NO: 141371 - RNA, 1410 nt, Artificial Sequence; identical to SEQ ID NO: 140216
  derived and/or modified sequence opt3 from neuraminidase__InfluenzaA__ADL32517

SEQ ID NO: 141372 - RNA, 1410 nt, Artificial Sequence; identical to SEQ ID NO: 139931
  derived and/or modified sequence opt3 from neuraminidase__InfluenzaA__ADL32527

SEQ ID NO: 141373 - RNA, 1410 nt, Artificial Sequence; identical to SEQ ID NO: 138754
  derived and/or modified sequence opt3 from neuraminidase__InfluenzaA__ADL32537

SEQ ID NO: 141374 - RNA, 1410 nt, Artificial Sequence; identical to SEQ ID NO: 139641
  derived and/or modified sequence opt3 from neuraminidase__InfluenzaA__ADL32547

SEQ ID NO: 141375 - RNA, 1410 nt, Artificial Sequence; identical to SEQ ID NO: 140105
  derived and/or modified sequence opt3 from neuraminidase__InfluenzaA__ADL32673

SEQ ID NO: 141376 - RNA, 1410 nt, Artificial Sequence; identical to SEQ ID NO: 138754
  derived and/or modified sequence opt3 from neuraminidase__InfluenzaA__ADL32683

SEQ ID NO: 141377 - RNA, 1410 nt, Artificial Sequence; identical to SEQ ID NO: 138744
  derived and/or modified sequence opt3 from neuraminidase__InfluenzaA__ADL32693

SEQ ID NO: 141378 - RNA, 1410 nt, Artificial Sequence; identical to SEQ ID NO: 139977
  derived and/or modified sequence opt3 from neuraminidase__InfluenzaA__ADL32703

SEQ ID NO: 141379 - RNA, 1410 nt, Artificial Sequence; identical to SEQ ID NO: 138744
  derived and/or modified sequence opt3 from neuraminidase__InfluenzaA__ADL32713

SEQ ID NO: 141380 - RNA, 1410 nt, Artificial Sequence; identical to SEQ ID NO: 138754
  derived and/or modified sequence opt3 from neuraminidase__InfluenzaA__ADL32723

SEQ ID NO: 141381 - RNA, 1410 nt, Artificial Sequence; identical to SEQ ID NO: 140435
  derived and/or modified sequence opt3 from neuraminidase__InfluenzaA__ADL32733

SEQ ID NO: 141382 - RNA, 1410 nt, Artificial Sequence; identical to SEQ ID NO: 140435
  derived and/or modified sequence opt3 from neuraminidase__InfluenzaA__ADL32743

SEQ ID NO: 141383 - RNA, 1410 nt, Artificial Sequence
  derived and/or modified sequence opt3 from neuraminidase__InfluenzaA__ADL39139
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugagugaaccgacuauaaucgagagaaauauuaccgaaaucguguauuugacaaacaccacuauugagaaggaaaucugucccaaauuagcugaguacaggaauuggagcaagccucagugcgacauaacaggguucgcaccauuuuccaaagauaacucuauucggcugucggccggaggugacaucuggguaacccgcgagcccuaugugucaugugauccugacaagugcuaccaauucgcgcuaggccaggggacgacucucaauaacguccauagcaauaacaccgugcgagaacguacaccauauagaacucugcuuaugaaugagcugggaguucccuuucacuugggcaccaaacagguguguauugcuuggaguuccucuagcugccaugaugguaaggccuggcuccacgucuguaucacaggggacgauaagaacgcaaccgccuccuucaucuacaauggaaggcugguggacucaguaguuaguuggagcaaagaaauucugcggacgcaggagucugagugcguguguauaaacggcacuugcacagucgugaugaccgauggcuccgcuucagggaaggcagacacuaaaauccucuuuauugaagagggaaagaucgugcauacaagcaccuuaagugguucugcccaacacgucgaagaguguuccugcuauccucgcuacccaggcguuagaugcguguguagggauaacuggaaggggagcaaucggccgauaguagacauuaacaucaaagaucacucgaucgugucuuccuacgucugcucaggacuggugggcgacacgccccgcaagaaugacaguagcuccucuagccauugucuugauccuaacaaugaagagggugggcacggaguuaaaggcugggcuuucgacgauggcaacgacguguggauggggcgaaccauuucagagaagaguagauugggauaugaaacauuuaaagucaucgaggguugguccaauccaaagagcaaacugcagauuaacaggcaagugauaguagaucggggcaaucguucuggguacucaggaaucuucaguguugaaggcaagagcugcauuaaccgcuguuuuuauguggagcuaaucagagguaggaaggaagagacugagguccucuggaccuccaauucuaucguggucuucugcgggacaucgggcacuuacggaaccggcagcuggcccgacggggccgauauuaaccugaugccuauauga

SEQ ID NO: 141384 - RNA, 1413 nt, Artificial Sequence
  derived and/or modified sequence opt3 from neuraminidase__InfluenzaA__ADL39150
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacugagaccaucaaaagcuggaagaaacagaucuugagaacacaggagucggaaugcguguguaugaacggcucuugcuuuacuauuaugaccgauggucccuccaauaaggccgcgucauacaaaaucuucaagauugagaaggggaaaguaacaaagaguauagaacucaacgcaccuaauuuuuauuacgaggaguguagcugcuacccagacaccggaaucguuaugugugugugcagggauaacuggcauggcuccaaucggcccugggucucuuucaaccagaaucuggacuaucaaauuggcuacaucugcagcgggguguuuggagauaacccucgcccagaagacggugagggcucauguaauccggugacggucgauggggccaacggaguuaaaggcuucaguuauaaguacgguaaugggguguggaucggcagaacuaaauccaacaggcugcggaagggauuugaaaugauuugggaccccaauggcuggacaaacaccgacagcgauuucucuguaaaacaggacguggucgcuauaacugauuggucaggguauagugguagcuuugugcagcacccugagcucacaggauuagacugcauccgcccauguuucuggguugaacuggugcgaggccuucccagagagaacaccacgauuuggaccuccgggucuucgaucagcuucugcggagucaauuccgauacagccaacuggucauggccugacggcgcagaguugccauuuacuauugauaaguga

SEQ ID NO: 141385 - RNA, 1410 nt, Artificial Sequence
  derived and/or modified sequence opt3 from neuraminidase__InfluenzaA__ADL39172
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccggggaggcagauacuaagauccucuuuauugaagagggaaaaaucgugcauacaucaaccuuaagcgguagugcccaacacgucgaagagugcucuugcuauccucgcuacccaggcguuagaugugugugcagggacaacuggaagggguccaaucggccgauaguagauauuaacaucaaggaccacagcaucgugucgucuuacgucuguuccggacuggugggcgacacgccccgcaaaaaugauucaaguagcuccucucauugccuugacccuaacaaugaagagggugggcacggaguuaagggcugggcuuucgaugacggcaacgauguguggauggggcgaaccauuagcgagaaaucaagauugggauaugaaacauuuaaggucaucgaggguuggaguaauccaaaauccaagcugcagauuaacaggcaagugauaguagaccggggcaaucguagcggguacucuggaaucuucucaguugaaggcaaaaguuguauuaaccgcugcuuuuauguggagcuaaucagagguaggaaggaagagacugagguccucuggaccagcaauuccaucguggucuucugugggacaucuggcacuuacggaaccggcucguggcccgauggggccgacauuaaccugaugccuauauga

SEQ ID NO: 141386 - RNA, 1410 nt, Artificial Sequence; identical to SEQ ID NO: 138615
  derived and/or modified sequence opt3 from neuraminidase__InfluenzaA__ADL39183

SEQ ID NO: 141387 - RNA, 1413 nt, Artificial Sequence; identical to SEQ ID NO: 140946
  derived and/or modified sequence opt3 from neuraminidase__InfluenzaA__ADL39194

SEQ ID NO: 141388 - RNA, 1410 nt, Artificial Sequence; identical to SEQ ID NO: 138615
  derived and/or modified sequence opt3 from neuraminidase__InfluenzaA__ADL39205

SEQ ID NO: 141389 - RNA, 1413 nt, Artificial Sequence; identical to SEQ ID NO: 139477
  derived and/or modified sequence opt3 from neuraminidase__InfluenzaA__ADL39227

SEQ ID NO: 141390 - RNA, 1413 nt, Artificial Sequence; identical to SEQ ID NO: 140946
  derived and/or modified sequence opt3 from neuraminidase__InfluenzaA__ADL39238

SEQ ID NO: 141391 - RNA, 1413 nt, Artificial Sequence; identical to SEQ ID NO: 140946
  derived and/or modified sequence opt3 from neuraminidase__InfluenzaA__ADL39249

SEQ ID NO: 141392 - RNA, 1413 nt, Artificial Sequence; identical to SEQ ID NO: 139477
  derived and/or modified sequence opt3 from neuraminidase__InfluenzaA__ADL39260

SEQ ID NO: 141393 - RNA, 1410 nt, Artificial Sequence
  derived and/or modified sequence opt3 from neuraminidase__InfluenzaA__ADL39282
augaaccccaaucagaagaucauuaccauaggcagcgugucccugacaaucucuacuauuugcuucuuuaugcaaaucgccauucucaucacgaccgucacacuucacuucaaacaguacgaguuuaacucaccuccaaauaaccagguuaugcugugugaaccgacuauaaucgagaagaauauuaccgaaaucguguauuugacaaacaccacuauugagaaagaaaucugccccagauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaaggugcgagaucguaccccauauagaacacugcuuaugaaugaacugggaguucccuuucacuugggcacuaaacaggugugcauugcuuggagcaguuccucuugucaugacgguaaggccuggcuccacgucugcaucaccggggaugacaaaaacgcaacagccagcuucaucuacaauggaaggcugguggauuccguaguuucauggaguaaggagauucugcggacccaggaaagcgagugugugugcauaaacggcacguguacugucgugaugacagacggcucugcuuccgggaaagcagauaccaagauccucuuuauugaggaaggaaagaucgugcauacuucaacauuaagcgguagugcccaacacgucgaggaaugcucuugcuauccucgcuacccaggcguuagaugugugugcagggacaacuggaaaggguccaaucggccgauaguagauauuaacaucaaggaccacagcaucgugucgucuuacgucuguuccggacuggugggcgacacccccaggaaaaaugauucaaguagcuccucucauugccuugacccuaacaaugaggaaggugggcacggaguuaagggcugggcuuucgaugacggcaacgauguguggauggggcgaacgauuagcgagaaaucaagauugggauaugagaccuuuaaggucaucgaagguuggaguaauccaaaauccaagcugcagauuaaccgccaggugauaguagaccggggcaaucguagcggguacucuggaaucuucucaguugagggcaagaguuguauuaaccgcugcuuuuauguggaacuaaucagagguaggaaagaggaaacagagguccucuggacuagcaauuccaucguggucuucugugggaccucuggcacauacggaacuggcucguggcccgauggggccgacauuaaccugaugccuauauga

SEQ ID NO: 141394 - RNA, 1413 nt, Artificial Sequence; identical to SEQ ID NO: 139477
  derived and/or modified sequence opt3 from neuraminidase__InfluenzaA__ADL39293

SEQ ID NO: 141395 - RNA, 1410 nt, Artificial Sequence
  derived and/or modified sequence opt3 from neuraminidase__InfluenzaA__ADL39304
augaaccccaaucagaagaucauuaccauaggcagcgugucccugacaaucucuacuauuugcuucuuuaugcagaucgccauucucaucacgaccgucacacuucacuucaaacaguacgaguuuaacuucccuccaaauaaccagguuaugcugugugaaccgacuauaaucgagagaaauauuaccgaaaucguguauuugacaaacaccacuauugagaaggaaaucugccccaaauuagcugaguacaggaauuggucaaagccucagugugacauaacaggguuugcaccauucaguaaagauaacagcauucggcuguccgccggaggugacaucuggguaacccgcgagcccuaugugucuugcgauccugacaaguguuaccaauuugcgcuaggccaggggacgacucucaauaacguccauucgaauaacaccgugcgagaucguacaccauauagaacucugcuuaugaaugaacugggaguucccuuccacuugggcaccaaacaggugugcauugcuuggucaagcaguuccugucaugacgguaaggccuggcuccacgucugcaucacaggggaugacaagaacgcaaccgccucuuuuaucuacaauggaaggcugguggauagcguaguuuccuggucaaaagagauucugcggacgcaggaaagugagugugugugcauaaacggcacuuguacagucgugaugaccgacggcagcgcuucugggaaggcagauacuaaaauccucuucauugaggaaggaaagaucgugcauacauccaccuuaucagguagcgcccaacacgucgaggaaugcaguugcuauccucgcuacccaggcguuagaugugugugcagggacaacuggaaggggucuaaucggccgauaguagauauuaacaucaaagaccacuccaucgugagcucguacgucuguucuggacuggugggcgacacgccccgcaagaaugauuccucaaguagcucccauugccuugacccuaacaaugaggaaggugggcacggaguuaaaggcugggcuuuugaugacggcaacgauguguggauggggcgaaccauuucugaaaagagcagauugggauaugagacauucaaagucaucgaggguuggucaaauccaaagaguaaacugcagauuaacaggcaagugauaguagaccggggcaaucguuccggguacagcggaaucuuuucuguugagggcaagucauguauuaaccgcugcuucuauguggaacuaaucagagguaggaaggaggaaacugagguccucuggaccaguaauagcaucguggucuucugugggacauccggcacuuacggaaccggcucuuggcccgauggggccgacauuaaccugaugccuauauga

SEQ ID NO: 141396 - RNA, 1410 nt, Artificial Sequence; identical to SEQ ID NO: 138615
  derived and/or modified sequence opt3 from neuraminidase__InfluenzaA__ADL39326

SEQ ID NO: 141397 - RNA, 1413 nt, Artificial Sequence; identical to SEQ ID NO: 140946
  derived and/or modified sequence opt3 from neuraminidase__InfluenzaA__ADL39392

SEQ ID NO: 141398 - RNA, 1410 nt, Artificial Sequence
  derived and/or modified sequence opt3 from neuraminidase__InfluenzaA__ADL39403
augaaccccaaucagaagaucauuaccauaggcagcgugucccugacaaucucuacuauuugcuucuuuaugcagaucgccauucucaucacgaccgucacacuucacuucaaacaguacgaguuuaacccuccaccgaauaaccagguuaugcugugugaacccacuauaaucgagagaaauauuaccgaaaucguguauuugacaaacaccacuauugagaaggaaaucugcccuaaauuagcugaguacaggaauuggucaaagccacagugugacauaacaggguucgcacccuuuaguaaagauaacagcauucggcuguccgccggaggugacaucuggguaacccgcgagccuuaugugucuugcgauccagacaaguguuaccaauucgcgcuaggccaggggacgacucucaauaacguccauucgaauaacaccgugcgagaucguacacccuauagaacucugcuuaugaaugaacugggaguuccuuuucacuugggcaccaaacaggugugcauugcuuggucaagcaguuccugucaugacgguaaggccuggcuccacgucugcaucacaggggaugacaagaacgcaaccgccucuuucaucuacaauggaaggcugguggauagcguaguuuccuggucaaaagagauucugcggacgcaggaaagugagugugugugcauaaacggcacuuguacagucgugaugaccgacggcagcgcuucugggaaggcagauacuaaaauccucuuuauugaggaaggaaagaucgugcauacauccaccuuaucagguagcgcccaacacgucgaggaaugcaguugcuauccacgcuacccgggcguuagaugugugugcagggacaacuggaaggggucuaaucggcccauaguagauauuaacaucaaagaccacuccaucgugagcucguacgucuguucuggacuggugggcgacacgccucgcaagaaugauuccucaaguagcucccauugccuugacccaaacaaugaggaaggugggcacggaguuaaaggcugggcuuucgaugacggcaacgauguguggauggggcgaaccauuucugaaaagagcagauugggauaugagacauuuaaagucaucgaggguuggucaaaucauaagaguaaacugcagauuaacaggcaagugauaguagaccggggcaaucguuccggguacagcggaaucuucucuguugagggcaagucauguauuaaccgcugcuuuuauguggaacuaaucagagguaggaaggaggaaacugagguccucuggaccaguaauagcaucguggucuucugugggacauccggcacuuacggaaccggcucuuggcccgauggggccgaccugaaccuuaugccuauuuga

SEQ ID NO: 141399 - RNA, 1413 nt, Artificial Sequence; identical to SEQ ID NO: 139477
  derived and/or modified sequence opt3 from neuraminidase__InfluenzaA__ADL39425

SEQ ID NO: 141400 - RNA, 1413 nt, Artificial Sequence
  derived and/or modified sequence opt3 from neuraminidase__InfluenzaA__ADL39447
augaaccccaaucagaagaucauuaccauaggcagcaucuccauugccaucgggauuaucucucugaugcuccaaauaggaucaaucauuaguaucugggcuagccacuccauucagacagguucucagaacaauacuggcaucugcaaccagagaauaauuacguacgaaaauucgaccugggugaaccauacauaugucaauaucaacaauacuaacguuguggcaggggaggacaaaaccucaguaacacuuaccggaaauagcagucuguguuccauuucuggcugggccaucuacacuaaggauaacagcaucaggauugguuccaaaggggacguguucgucauacgggagccuuuuaucucaugcagucacuuggaaugucgcacauucuuuuuaacccaaggagcgcugcuaaaugauaagcauagcaacggcacggugaaagaccgaucuccauaucgugcucucauguccugcccgcugggcgaggcccccucaccuuacaauagcaaguucgaaaguguugcauggucugccuccgcuugucacgaugggaugggauggcuuacuauugguaucagcggcccagacaacggggcaguggccguccugaaguauaacggaauaauuaccggcacaaucaaaucguggaagaaacagaucuugagaacucaggagucugagugcguguguaugaaugguuccugcuuuaccauuaugacagaugggcccucaaacaaggcugccaguuacaaaaucuucaagauugaaaagggaaaaguaaccaagagcauagagcucaaugcgccuaacuuuuauuacgaagaguguuccugcuacccagacacgggcaucguuaugugugugugcagggauaauuggcauggcucuaaccggcccugggucagcuucaaucagaaccuggacuaucaaauuggguacaucugcucaggaguguuuggugauaauccucgcccagaggacggcgaagggaguuguaacccggugacugucgauggagcaaauggcguuaaagguuucuccuauaaguacgggaacggcguguggaucggaagaacaaaaagcaauaggcugcggaagggcuuugagaugauuugggaccccaacggguggaccaauacugacucugauuucucaguaaaacaggacguggucgccauaacagauuggaguggauauagcgguuccuuugugcagcacccugaacucaccggcuuagacugcauccgcccauguuucuggguugagcuggugcgagggcuucccagagaaaacacgaccauuuggacaucuggaucgagcaucuccuucugcggcgucaacucagauacugcuaauuggaguuggccugacggugccgaguugccauuuaccauugauaaguga

SEQ ID NO: 141401 - RNA, 1413 nt, Artificial Sequence; identical to SEQ ID NO: 139477
  derived and/or modified sequence opt3 from neuraminidase__InfluenzaA__ADL39458

SEQ ID NO: 141402 - RNA, 1413 nt, Artificial Sequence
  derived and/or modified sequence opt3 from neuraminidase__InfluenzaA__ADL39469
augaaccccaaucagaagaucauuaccauaggcagcaucuccauugccaucgggauuaucucucugaugcuccaaauaggaucaaucauuaguaucugggcuagccacuccauucagacagguucucagaacaauacuggcaucugcaaccagagaauaauuacguacgaaaauucgaccugggugaaccauacauaugucaauaucaacaauacuaacguuguggcaggggaggacaaaaccucaguaacacuugccggaaauagcagucuguguuccauuucuggcugggcgaucuacaccaaggauaacagcaucaggauugguuccaaaggggacguguucgucauacgggagccuuuuaucucaugcagucacuuggaaugucgcacuuucuuuuuaacacaaggagcucugcuaaaugauaagcauagcaacggcaccgugaaagaccgaucuccauaucgugcccucauguccugcccgcugggcgaggcacccucaccuuacaauagcaaguucgaaaguguugccuggucugcuuccgcaugucacgaugggaugggauggcuuacgauugguaucagcggcccagacaacggggccguggcuguccugaaguauaacggaauaauuacuggcaccaucaaaucguggaagaaacagaucuugagaacacaggagucugagugcguguguaugaaugguuccugcuuuacuauuaugaccgaugggcccucaaacaaggccgcgaguuacaaaaucuucaagauugaaaagggaaaaguaacaaagagcauagagcucgacgcaccuaauuuuuauuacgaagaguguuccugcuacccagauaccggcaucguuaugugugugugcagggacaacuggcauggcucuaaucggcccugggucagcuucaaccagaaucuggauuaucaaauuggguacaucugcucaggaguguuuggugacaacccucgcccagaggauggcgaagggaguuguaauccggugacggucgacggagccaacggcguuaaagguuucuccuauaaguacgggaauggcguguggaucggaagaacuaaaagcaacaggcugcggaagggcuuugagaugauuugggaccccaauggguggacaaacaccgauucugacuucucaguaaaacaggauguggucgcuauaacugacuggaguggauauagcgguuccuuugugcagcacccugaacucacaggcuuagauugcauccgcccauguuucuggguugagcuggugcgagggcuucccagagaaaauaccacgauuuggaccucuggaucgagcaucuccuucugcggcgucaacucagacacagccaacuggaguuggccugauggugcagaguugccauuuacuauugacaaguga

SEQ ID NO: 141403 - RNA, 1413 nt, Artificial Sequence
  derived and/or modified sequence opt3 from neuraminidase__InfluenzaA__ADL39480
augaaccccaaucagaagaucauuaccauaggcagcaucuccauugccaucgggauuaucucucugaugcuccaaauaggaucaaucauuaguaucugggcuagccacuccauucagacagguucucagaacaauacuggcaucugcaaccagagaauaauuacguacgaaaauucgaccugggugaaccauacauaugucaauaucaacaauacuaacguuguggcaggggaggacaaaaccucaguaacacuugccggaaauagcagucuguguuccauuucuggcugggcgaucuacaccaaggauaacagcaucaggauugguuccaaaggggacguguucgucauacgggagccuuuuaucucaugcagucacuuggaaugucgcacuuucuuuuuaacacaaggagcucugcuaaaugauaagcauagcaacggcaccgugaaagaccgaucuccauaucgugcccucauguccugcccgcugggcgaggcacccucaccuuacaauagcaaguucgaaaguguugccuggucugcuuccgcaugucacgaugggaugggauggcuuacgauugguaucagcggcccagacaacggggccguggcuguccugaaguauaacggaauaauuacuggcaccaucaaaucguggaagaaacagaucuugagaacacaggagucugagugcguguguaugaaugguuccugcuuuacuauuaugaccgaugggcccucaaacaaggccgcgaguuacaaaaucuucaagauugaaaagggaaaaguaacaaagagcauagagcucaaugcaccuaacuuuuauuacgaagaguguuccugcuacccagacaccggcaucguuaugugugugugcagggauaauuggcauggcucuaaccggcccugggucagcuucaaucagaaccuggacuaucaaauuggguacaucugcucaggaguguuuggugauaauccucgcccagaggacggcgaagggaguuguaacccggugacggucgauggagccaauggcguuaaagguuucuccuauaaguacgggaacggcguguggaucggaagaacuaaaagcaauaggcugcggaagggcuuugagaugguaugggaccccaacggguggacaaauaccgacucugauuucucagugaaacaggacgucguggcuauuacugauuggaguggauauagcgguuccuuuguucagcacccugaacucacaggcuuagacugcauacgcccauguuucuggguggagcugguccgagggcuucccagagaaaacaccacgaucuggaccucuggaucgagcauuuccuucugcggcgugaacucagauacagccaauuggaguuggccugacggugcagaguugccauuuacuaucgauaaguga

SEQ ID NO: 141404 - RNA, 1410 nt, Artificial Sequence
  derived and/or modified sequence opt3 from neuraminidase__InfluenzaA__ADL39491
augaaccccaaucagaagaucauuaccauaggcagcgugucccugacaaucucuacuauuugcuucuuuaugcaaaucgccauucucaucacgaccgucacacuucacuucaaacaguacgaguuuaacucaaguccuaauaaccagguuaugcugugugaaccaacuauaaucgagagaaauauuaccgaaaucguguauuugacaaacaccacuauugagaaggaaaucugcccgaaauuagcugaguacaggaauuggagcaagccccagugugacauaacaggguucgcaccuuuuuccaaagauaacucuauucggcugucggccggaggugacaucuggguaacccgcgagccauaugugucaugcgaucccgacaaguguuaccaauucgcgcuaggccaggggacgacucucaauaacguccauagcaauaacauugugcgagaucguaccccuuauagaacacugcuuaugaaugaacugggaguuccauuucacuugggcacuaaacaggugugcaucgcuuggaguuccucuagcugucaugacgguaaggccuggcuccacgucugcaucaccggggaugacaagaacgcaacagccuccuucauuuacaauggaaggcugguggauucaauaguaaguuggagcaaagagauccugcggacccaggaaucugaguguguuugcauuaacggcacguguacuguggucaugacagacggcuccgcuucagggaaggcagauaccaaaauccucuuuauagaggaaggaaagauugugcauacuagcacauuaagugguucugcccaacacguggaggaaugcuccugcuauccccgcuacccuggcgucagauguguuugcagggacaacuggaaggggagcaaucggccaaucguggauaucaacauuaaagaccacucgaucguaucuuccuacguguguucaggacuggucggcgacaccccgcgcaagaaugauaguagcuccucuagccauugccuugaccccaacaaugaggaaggugggcacggagugaaaggcugggcuuucgaugacggcaacgauguuuggauggggcgaacgauuucagagaagaguagauugggauaugagaccuuuaaagugauagaagguugguccaauccuaagagcaaacugcagaucaacaggcaggucauuguggaccggggcaaucguucuggguacucaggaaucuucaguguagagggcaagagcuguaucaaccgcugcuuuuauguugaacuaauuagagguaggaaggaggaaacagaggugcucuggacuuccucuucgauagucguguucugugggaccagcggcacauacggaacuggcuccuggccagauggggccgacaucaaucugaugcccauuuga

SEQ ID NO: 141405 - RNA, 1410 nt, Artificial Sequence; identical to SEQ ID NO: 138754
  derived and/or modified sequence opt3 from neuraminidase__InfluenzaA__ADL41165

SEQ ID NO: 141406 - RNA, 1410 nt, Artificial Sequence
  derived and/or modified sequence opt3 from neuraminidase__InfluenzaA__ADL41175
augaaccccaaucagaagaucauuaccauaggcagcgugugcaugacaaucgggauggccaaccugauucuccaaaucggaaauauuaucuccacuuggauaucucacucaauccagcuugguaaccagaaucagauugagacguguaaccaaagugucaucaccuacgaaaauaacacauggguuaaucagacuuaugugaacauuagcaauaccaacuucgcugcaggccaguccguagugucugucaaacuggccggaaauucgucauugugcccugugagcggaugggcgaucuacaguaaggacaacuccguuagaauaggcucuaaaggugauguguuugucauuagggagccauucaucagcuguuccccguuagaaugccggacauuuuuccugacccagggggcucuacucaaugacaagcauucaaacggaacuauuaaagaucgcagucccuaucgaacacugaugagcuguccuaucggcgaggugccaucucccuacaacucccguuuugaaucaguagccuggagcgcaagugccugccacgacggcaucaauuggcuuaccauugggauaucuggaccugauaacggugcuguugcagugcugaaguauaauggcaucauuacggacacuaucaaguccuggagaaacaauauauugaggacccaagagagcgagugugccugcgucaacgggucguguuucacagugaugacugauggaccaucuaauggccaggcuuccuacaaaauuuuucggaucgaaaaggguaaaaucgugaagucagucgagaugaacgcccccaauuaucauuacgaagagugcaguuguuacccugacagcuccgagauuaccugcguuugccgcgauaacuggcacgggucuaauagaccaugggugagcuucaaccagaaucucgaauaucagaucggauacauuuguucaggcauauuuggcgacaacccgaggcccaaugauaaaacagggaguugcggaccuguauccagcaacggugcgaacggcgugaagggguucucuuuuaaguauggaaauggcgucuggaucggucggaccaaaucaauuaguagccgcaacggguucgagaugaucugggacccaaauggcuggacgggaacugauaacaauuuuuccaucaagcaagacauugugggcauaaacgaauggucuggguacucggggagcuucguucagcaucccgagcugacaggucuggacuguauccgaccuugcuucuggguggaacucauuagaggcaggccaaaagagaauaccaucuggacuuccgggucaaguauuucuuuuuguggagucaacagcgauacagugggcugguccuggcccgacggugcagaguuaccguucaccaucgauaaguga

SEQ ID NO: 141407 - RNA, 1413 nt, Artificial Sequence
  derived and/or modified sequence opt3 from neuraminidase__InfluenzaA__ADL60255
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaauuauacauacgucaacaucaauaacacuaauguuguggcaggggaagacaaaaccucgguaacacuugccggaaacucaagccuguguaguauuuccggcugggcgaucuauaccaaggauaauucuaucaggauugguagcaaaggggacguguucgucauacgggagccuuuuaucuccugcucacauuuggaaugucgcacuuucuuuuuaacacaaggagcucugcuaaacgauaagcacaguaauggcaccgugaaagaccgaagcccauaccgugcccucaugucuugcccgcugggcgaggcacccuccccuuauaacucaaaguucgaaagcguugccuggagugcuucugcaugucaugaugggaugggauggcuuacgauugguaucuccggcccagacaacggggccguggcuguccugaaguacaauggaauaauuacuggcaccaucaaaagcuggaagaaacagaucuugagaacacaggagucggagugcguguguaugaacgguucuugcuuuacuauuaugaccgaugggcccuccaauaaggccgcgucauauaaaaucuucaagauugaaaagggaaaaguaacaaagaguauagagcucaacgcaccuaauuuucacuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccaaaagacggcagagggucauguaauccggugacggucgauggagccaacggcguuaaggguuucaguuauaaauacgacaaugggguguggaucggcaggacuaaguccaaccggcugcgcaaaggauuugagaugauuugggaccccaauggcuggacaaacaccgauagcgacuucucuguaaagcaggauguggucgcuauaacugacuggucaggguauagugguagcuuugugcagcacccugaacucacaggauuagauugcauccgaccauguuucuggguugagcuggugagaggccuucccagggaaaacaccacgauuuggaccuccgggucuucgaucagcuucugcggagucaauuccgacacagccaacuggucauggccugauggcgcagaguugccauuuacuauugacaaguga

SEQ ID NO: 141408 - RNA, 1413 nt, Artificial Sequence
  derived and/or modified sequence opt3 from neuraminidase__InfluenzaA__ADL60277
augaaccccaaucagagaaucauuaccauaggcagcaucuccauugccaucgggauuaucucucugaugcuccaaauaggaaacaucauuucaaucugggcuagucacagcauucagaucgguucccagaauaacacaggcauaugcaaucagaggauuaucacuuacgagaacucuacgugggugaaucauaccuaugucaacauuaauaacacaaauguuguggcaggggaagacaagacuccuguaacccuugccggaaacucgucacuguguagcaucaguggcugggcgaucuacacaaaagauaauuccauucggauagguucuaagggggacguguucgucauccgcgagccauuuauuagcugcucccacuuggaaugucgaaccuucuuuuuaacucaaggagcucugcuaaacgauaaacauucaaauggcacagccaaggaccguaguccguauagagcacucaugagcugcccccugggcgaggccccuucuccauacaacuccaaauucgaaucaguggcuuggagcgcaagugccugucacgaugggaugggauggcuuaccaucgguauaucuggccccgacaacggggcuguugccgugcugaaguauaauggaauuaucacgggcacuaucaaguccuggaaaaagcagauuuugaggacccaggagagcgagugcgucuguaugaacgguucgugcuuuacaaucaugacugaugggccuucuaauaaagcggcauccuacaagauuuucaaaauagaaaagggaaaggugaccaaaucaaucgagcucaacgccccaaauuuuuauuacgaagaguguaguugcuaccccgacacaggcauuguaauguguguuugccgggauaacuggcauggcagcaaucgcccuuggguguccuucaaccagaaucuggacuaucaaaucggguacaucugcucuggagucuuuggugauaacccaagaccggaggacggcgaagggagcuguaaucccgugaccguggauggagcuaacggcgucaaggguuucucauauaaauacgggaauggcguuuggauuggaaggacgaagaguaaccggcugcgcaaaggcuuugagaugauaugggacccuaauggguggacuaacacagacuccgauuucagcgugaagcaggacguaguggccaucaccgauuggucuggauauucagguaguuuuguccagcacccagaacucacuggcuuagacugcauucgacccuguuucuggguggagcugguuagagggcuuccuagggaaaacacaaccaucuggacgagcggauccucuauuucguucugcggcgugaauagcgauaccgcaaacugguccuggccagacggugcugaguugcccuuuacaaucgauaaauga

SEQ ID NO: 141409 - RNA, 1413 nt, Artificial Sequence
  derived and/or modified sequence opt3 from neuraminidase__InfluenzaA__ADL60288
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuuuauuacgaagaguguagcugcuacccagacaccggcaucguuaugugugugugcagggauaacuggcauggcuccaaucggcccugggucucuuucaaccagaaucuggacuaucaaauuggguacaucugcagcggaguguuuggugauaacccucgcccaaaagacggcaaggggucauguaauccggugacggucgauggagccaacggcguuaaagguuucaguuauaaguacgggaauggcguguggaucggaagaacuaaauccaacaggcugcggaagggcuuugagaugauuugggaccccaauggguggacaaacaccgacagcgauuucucuguaaagcaggacguggucgcuauaacugauuggucaggauauagugguagcuuugugcagcacccugaacucacaggcuuagacugcauccgcccauguuucuggguugagcuggugcgagggcuucccagagaaaacaccacgauuuggaccuccggaucuucgaucagcuucugcggcgucaauuccgauacagccaacuggucauggccugacggugcagaguugccauuuacuauugauaaauga

SEQ ID NO: 141410 - RNA, 1413 nt, Artificial Sequence
  derived and/or modified sequence opt3 from neuraminidase__InfluenzaA__ADL60299
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucucgaucaacaauacuaacguuguggcagggaaagacaagaccucaguaacacuugccggaaauagcagucuguguuccauuucuggcugggcgaucuacaccaaagauaacagcaucaggauugguuccaagggggacguguucgucauacgggaaccuuuuaucucaugcagucacuuggagugucgcacuuucuuuuuaacacaaggagcucugcuaaaugauaaacauagcaacggcaccgugaaggaccgaucuccauaucgugcccucauguccugcccgcugggcgaagcacccucaccuuacaauagcaaguucgagaguguugccuggucugcuuccgcaugucacgaugggaugggauggcuuacgauugguaucagcggcccagacaacggggccguggcuguccugaaauauaacggaauaauuacuggcaccaucaagucguggaaaaagcagaucuugagaacacaggaaucugagugcguguguaugaaugguuccugcuuuacuauuaugaccgaugggcccucaaacaaagccgcgaguuacaagaucuucaagauugagaaaggaaagguaacaaaaagcauagaacucaaugcaccuaacuuuuauuacgaggaauguuccugcuacccagacaccggcaucguuaugugugugugcagggauaauuggcauggcucuaaccggcccugggucagcuucaaucaggaccuggauuaucaaauuggguacaucugcucaggaguguuuggugacaacccucgcccaaaggauggcaaagggaguuguaauccggugacggucgacggagccaacggcguuaaggguuucuccuauaaauacgggaauggcguguggaucggaagaacuaagagcaacaggcugcggaagggcuuugagaugauuugggaccccaauggguggacaaacaccgauucugacuucucaguaaaacaggauguggucgcuauaacugacuggaguggauauagcgguuccuuugugcagcacccugagcucacaggcuuagauugcauccgcccauguuucuggguugaacuggugcgagggcuucccagagagaauaccacgauuuggaccucuggaucgagcaucuccuucugcggcgucaacucagacacagccaacuggaguuggccugauggugcagaauugccauuuacuauugacaaguga

SEQ ID NO: 141411 - RNA, 1413 nt, Artificial Sequence; identical to SEQ ID NO: 138648
  derived and/or modified sequence opt3 from neuraminidase__InfluenzaA__ADL60310

SEQ ID NO: 141412 - RNA, 1413 nt, Artificial Sequence
  derived and/or modified sequence opt3 from neuraminidase__InfluenzaA__ADL60321
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuucauuaugaagaguguagcugcuacccagacaccggcaugguuaugugugugugcagggauaacuggcacggcuccaaucggcccugggucucuuucaaccagaaucuggacuaccaaaucggguauauuugcagcggaguguuuggugauaacccucgcccagaggacggcgaagggucauguaauccggugacggucgauggagccaacggcguuaaagguuucaguuacaaguaugacaaugggguguggaucggcagaacuaaauccaacaggcugcggaagggauuugagaugaucugggaccccaauggcuggacaaacaccgauagcgacuucucuguaaaacaggauguggucgcuauuacugacuggucaggguacagugguagcuuugugcagcacccugaacucacaggauuagauugcauacgcccauguuucuggguugagcuggugcgaggccuucccagagaaaacaccacgaucuggaccuccgggucuucgauuagcuucugcggagucaauuccgacacagccaacuggucauggccugauggcgcagaguugccauuuacuaucgacaaguga

SEQ ID NO: 141413 - RNA, 1413 nt, Artificial Sequence
  derived and/or modified sequence opt3 from neuraminidase__InfluenzaA__ADL60332
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugucaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccgugaaagaccgaagcccauaucgugcccucaugucuugcccgcugggcgaggcacccuccccuuacaacucaaaguucgaaagcguugccuggagugcuucugcaugucacgaugggaugggauggcuuacgauugguaucuccggcccagacaacggggccguggcuguccugaaguauaauggaauaauuacuggcaccaucaaaagcuggaagaaacagaucuugagaacacaggagucggagugcguguguaugaacgguucuugcuuuacuauuaugaccgaugggcccuccaauaaggccgcgucauacaaaaucuucaagauugaaaagggaaaaguaacaaagaguauagagcucaacgcaccuaauuuucauuaugaagaguguagcugcuacccagacaccggcaucguuaugugugugugcagggauaacuggcacggcuccaaucggcccugggucucuuucaaccagaaucuggacuaccaaauuggguauaucugcagcggaguguuuggugauaacccucgcccaaaagacggcagagggucauguaauccggugacggucgauggagccaacggcguuaaggguuucaguuacaaauaugacaaugggguguggaucggcaggacuaaguccaaccggcugcgcaaaggauuugagaugauuugggaccccaauggcuggacaaacaccgauagcgacuucucuguaaagcaggauguggucgcuauaacugacuggucaggguacagugguagcuuugugcagcacccugaacucacaggauuagauugcauccgaccauguuucuggguugagcuggugagaggccuucccagggaaaacaccacgauuuggaccuccgggucuucgaucagcuucugcggagucaauuccgacacagccaacuggucauggccugauggcgcagaguugccauuuacuauugacaaguga

SEQ ID NO: 141414 - RNA, 1413 nt, Artificial Sequence; identical to SEQ ID NO: 138648
  derived and/or modified sequence opt3 from neuraminidase__InfluenzaA__ADL60343

SEQ ID NO: 141415 - RNA, 1413 nt, Artificial Sequence
  derived and/or modified sequence opt3 from neuraminidase__InfluenzaA__ADL60354
augaaccccaaucagagaaucauuaccauaggcagcaucuccauugccaucgggauuaucucucugaugcuccaaauaggaaacaucauuucaaucugggcuagucacagcauucagaucgguucccagaauaacacaggcauaugcaaucagaggauuaucacuuacgagaacucuacgugggugaaucauaccuaugugaacauuaauaacacaaauguuguggcaggggaagacaagacuucgguaacccuugccggaaacucaagccuguguaguaucuccggcugggcgaucuacacaaaagauaauucuauucggauagguagcaagggggacguguucgucauccgcgagccuuuuauuuccugcucacacuuggaaugucgaaccuucuuuuuaacucaaggagcucugcuaaacgauaaacauaguaauggcacagccaaggaccguagcccauauagagcacucaugucuugcccgcugggcgaggcccccuccccuuacaacucaaaauucgaaagcguggcuuggagugcaucugccugucacgaugggaugggauggcuuaccaucgguauauccggcccagacaacggggcuguugccgugcugaaguauaauggaauuaucacgggcacuaucaagagcuggaaaaagcagauuuugaggacccaggagucggagugcgucuguaugaacgguucuugcuuuacaaucaugacugaugggcccuccaauaaagcggcaucauacaagauuuucaaaauagaaaagggaaaggugaccaaaaguaucgagcucaacgccccuaauuuuuauuacgaagaguguagcugcuacccagacacaggcauuguaauguguguuugccgggauaacuggcauggcuccaaucgccccugggugucuuucaaccagaaucuggacuaucaaaucggguacaucugcagcggagucuuuggugauaacccuagaccaaaggacggcaaagggucauguaauccggugaccguggauggagcuaacggcgucaaggguuucaguuauaaauacgggaauggcguuuggauuggaaggacgaaguccaaccggcugcgcaaaggcuuugagaugauaugggaccccaauggguggacuaacacagacagcgauuucucugugaagcaggacguaguggccaucaccgauuggucaggauauagugguagcuuuguccagcacccugaacucacuggcuuagacugcauucgaccauguuucuggguggagcugguuagagggcuucccagggaaaacacaaccaucuggacguccggaucuucgauuagcuucugcggcgucaauuccgauaccgcaaacuggucauggccugacggugcugaguugccauuuacaaucgauaaguga

SEQ ID NO: 141416 - RNA, 1410 nt, Artificial Sequence
  derived and/or modified sequence opt3 from neuraminidase__InfluenzaA__ADL60365
augaaccccaaucagaagaucauuaccauaggcagcgugucccugacaaucucuacuauuugcuucuuuaugcaaaucgccauucucaucacgaccgucacacuucacuucaaacaguacgaguuuaacucaaguccuaauaaccagguuaugcugugugaaccaacuauaaucgagagaaauauuaccgaaaucguguauuugacaaacaccacuauugagaaggaaaucagcccgaaauuagcugaguacaggaauugguccaagccccagugcgacauaacaggguucgcaccuuuuucuaaagauaacucgauucggcugucagccggaggugacaucuggguaacccgcgagccauaugugagcugugaucccgacaagugcuaccaauucgcgcuaggccaggggacgacucucaauaacguccauaguaauaacauugugcgagaucguaccccuuauagaacacugcuuaugaaugaacugggaguuccauuucacuugggcacuaaacagguguguaucgcuugguccucuagcuccugccaugacgguaaggccuggcuccacgucuguaucaccggggaugacaagaacgcaacagccucauucauuuacaauggaaggcugguggauaguauaguaagcuggucuaaagagauccugcggacccaggaauccgagugcguuuguauuaacggcacgugcacuguggucaugacagacggcucagcuagcgggaaggcagauaccaaaauccucuuuauagaggaaggaaagauugugcauacaaguacuuuaucugguuccgcccaacacguggaggaauguagcugcuauccccgcuacccuggcgucagaugcguuuguagggacaacuggaaggggucgaaucggccaaucguggauaucaacauuaaagaccacucuaccguauccucauacgugugcaguggacuggucggcgacacgccgcgcaagaaugauagcuccucuagcucacauugucuugaccccaacaaugaggaaggugggcacggagugaaaggcugggcuuucgaugacggcaacgauguuuggauggggcgaaccaucagugagaaguccagauugggauaugagacauuuaaagugauugaagguuggagcaauccuaagucuaaacugcagauaaacaggcaggucaucguggaccggggcaaucguucaggguacaguggaauuuucagcguagagggcaaguccugcaucaaccgcuguuuuuauguugaacuaaucagagguaggaaggaggaaacugaggugcucuggaccucuaauucgauugucguguucugcgggacaagcggcacuuacggaaccggcuccuggccagauggggccgacauaaaccugaugcccaucuga

SEQ ID NO: 141417 - RNA, 1413 nt, Artificial Sequence
  derived and/or modified sequence opt3 from neuraminidase__InfluenzaA__ADL60376
augaaccccaaucagaagaucauuaccauaggcagcaucuccauugccaucgggauuaucucucugaugcuccaaauaggaaacaucauuucaaucugggcuagucacagcauucagacagguucccagaauaacacuggcaucugcaaucagagaauaauuacguacgagaacucuaccugggugaaucauacauaugugaacaucaauaacacuaauguuguggcaggggaagacaaaaccucgguaacacuugccggaaacucaagccuguguaguauuuccggcugggcgaucuacaccaaggauaauucuaucaggauugguagcaaaggggacguguucgucauacgggagccuuuuaucuccugcucacacuuggaaugucgcacuuucuuuuuaacacaaggagcucugcuaaacgauaagcauaguaauggcaccggcaaagaccgaagcccauaucgugcccucaugucuugcccgcugggggaggcacccuccccuuacaacucaaaguucgaaagcguggccuggagugcuucugcaugucacgauggaauggguuggcuuacgauuggcaucuccgggccagacaacggagccguugcugugcugaaguauaauggcauaauuacugguaccaucaaaagcuggaagaaacagaucuugagaacacaggagucggagugcgucuguaugaacgggucuugcuuuacuauuaugaccgauggacccuccaauaaggccgcgucauacaaaaucuucaagauugaaaagggcaaagugacaaagaguauagagcucaacgcaccuaauuuucauuaugaagaguguagcugcuacccagacaccggcaucguaauguguguuugcagggauaacuggcacggguccaaucggcccugggugucuuucaaccagaaucuggacuaccaaauuggauauaucugcagcggugucuuuggcgauaacccucgcccaaaagacgggaagggaucauguaauccggugacgguggauggcgccaacggugucaaaggguucaguuacaaguaugacaauggcguuuggaucggaagaacuaaauccaacaggcugcggaagggcuuugagaugauuugggaccccaauggguggacaaacaccgauagcgacuucucugugaagcaggauguaguggcuauaacugacuggucaggauacagugguagcuuuguccagcacccugaacucacaggcuuagauugcauccgcccauguuucuggguggagcugguucgagggcuucccagagaaaacaccacgauuuggaccuccggaucuucgaucagcuucugcggcgucaauuccgacacagccaacuggucauggccugauggugcagaguugccauuuacuauugacaaauga

SEQ ID NO: 141418 - RNA, 1410 nt, Artificial Sequence; identical to SEQ ID NO: 138754
  derived and/or modified sequence opt3 from neuraminidase__InfluenzaA__ADM07137

SEQ ID NO: 141419 - RNA, 1410 nt, Artificial Sequence; identical to SEQ ID NO: 138754
  derived and/or modified sequence opt3 from neuraminidase__InfluenzaA__ADM07146

SEQ ID NO: 141420 - RNA, 1410 nt, Artificial Sequence; identical to SEQ ID NO: 138754
  derived and/or modified sequence opt3 from neuraminidase__InfluenzaA__ADM07156

SEQ ID NO: 141421 - RNA, 1410 nt, Artificial Sequence; identical to SEQ ID NO: 138754
  derived and/or modified sequence opt3 from neuraminidase__InfluenzaA__ADM07165

SEQ ID NO: 141422 - RNA, 1413 nt, Artificial Sequence; identical to SEQ ID NO: 139477
  derived and/or modified sequence opt3 from neuraminidase__InfluenzaA__ADM07474

SEQ ID NO: 141423 - RNA, 1413 nt, Artificial Sequence; identical to SEQ ID NO: 139477
  derived and/or modified sequence opt3 from neuraminidase__InfluenzaA__ADM07485

SEQ ID NO: 141424 - RNA, 1410 nt, Artificial Sequence
  derived and/or modified sequence opt3 from neuraminidase__InfluenzaA__ADM07496
augaaccccaaucagaagaucauuaccauaggcagcgugucccugacaaucucuacuauuugcuucuuuaugcagaucgccauucucaucacgaccgucacacuucacuucaaacaguacgaguuuaacucaccuccaaauaaccagguuaugcugugugaaccgacuauaaucgagagaaauauuaccgaaaucguguauuugacaaacaccacuauugagaaggaaaucugccccaaauuagcugaguacaggaauuggaguaagccucagugugacauaacaggguucgcaccauuuagcaaagauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugaacugggaguucccuuucacuugggcaccaaacaggugugcauugcuuggagcaguuccucuugucaugacgguaaggccuggcuccacgucugcaucacaggggaugacaagaacgcaaccgccagcuucaucuacaauggaaggcugguggauuccguaguuucauggaguaaagagauucugcggacgcaggaaagcgagugugugugcauaaacggcacuuguacagucgugaugaccgacggcucugcuuccgggaaggcagauacuaaaauccucuuuauugaggaaggaaagaucgugcauacaucaaccuuaagcgguagugcccaacacgucgaggaaugcucuugcuauccucgcuacccaggcguuagaugugugugcagggacaacuggaagggguccaaucggccgauaguagauauuaacaucaaagaccacagcaucgugucgucuuacgucuguuccggacuggugggcgacacgccccgcaagaaugauucaaguagcuccucucauugccuugacccuaacaaugaggaaggugggcacggaguuaaaggcugggcuuucgaugacggcaacgauguguggauggggcgaaccauuagcgagaagucaagauugggauaugagacauuuaaagucaucgaagguuggaguaauccaaaguccaaacugcagauuaacaggcaagugauaguagaccggggcaaucguagcggguacucuggaaucuucucaguugagggcaagaguuguauuaaccgcugcuuuuauguggaacuaaucagagguaggaaggaggaaacugagguccucuggaccagcaauuccaucguggucuucugugggacaucuggcacuuacggaaccggcucguggcccgauggggccgacauuaacauaaugccuaucuga

SEQ ID NO: 141425 - RNA, 1410 nt, Artificial Sequence
  derived and/or modified sequence opt3 from neuraminidase__InfluenzaA__ADM07507
augaaccccaaucagaagaucauuaccauaggcagcgugucccugacaaucucuacuauuugcuucuuuaugcagacggccauccucauuaccacagucacucuucacuucaaacaguuugaguucaacucaccuccaaauaaccagguuaugcugugugaaccggcuaucauagagagaaauaucaccgaaauuguguacuugacaaacaccacuaucgagaaggaaauuugccccaaauuagcagaguauaggaauuggaguaagccucagugugacaucacaggguuugccccauucagcaaagauaacuccauacggcugucugcgggaggugacauuuggguaacccgcgagcccuacgugucgugcgauccugacaaguguuaucaauuugcucuaggccaggggacgacucucaauaacguccauucaaauaacaccgugcgagaucguacaccauacagaacucugcuuaugaaugaacugggaguucccuuccacuugggcaccaaacaggugugcaucgccuggagcaguuccucuugucaugacgguaaggcauggcuccacgucugcauuacaggggaugacaagaacgccaccgcuagcuuuaucuauaauggaaggcugguggauuccguaguuucauggaguaaagagauccugcggacgcaggaaagcgagugugugugcauuaacggcacuuguacagucgugaugaccgacggcucugcauccgggaaggccgauacuaaaauacucuucaucgaggaaggaaagauugugcauacaucaaccuuaagcgguagugcucaacacgucgaggaaugcucuugcuacccucgcuauccaggcguuagaugugugugcagggacaacuggaagggguccaaucggccgaucguagauauaaacauuaaagaccacagcaucgugucgucuuacgucuguuccggacuggugggcgacacgccccgcaagaaugauucaaguagcuccucucauugccuugacccuaacaaugaggaaggugggcacggaguuaaaggcugggccuuugaugacggcaacgauguguggauggggcgaaccaucagcgagaagucaagauugggauacgagacauucaaagucauugaagguuggaguaauccaaaguccaaacugcagaucaacaggcaagugauuguagaccggggcaaucguagcggguauucuggaauauuuucaguugagggcaagaguuguaucaaccgcugcuucuacguggaacuaauuagagguaggaaggaggaaacugagguccucuggaccagcaauuccaucguggucuucugugggacaucuggcacuuauggaaccggcucguggcccgauggggcggacaucaaccugaugccuauuuga

SEQ ID NO: 141426 - RNA, 1410 nt, Artificial Sequence
  derived and/or modified sequence opt3 from neuraminidase__InfluenzaA__ADM12820
augaaccccaaucagaagaucauuaccauaggcagcgugucccugacaaucucuacuauuugcuucuuuaugcagaucgccauucucaucacgaccgucacacuucacuucaaacaguacaaguuuaacucaccuccaaauaaccagguuaugcugugugagccgacuauaaucgaaagaaauauuaccgagaucguguauuugacaaacaccacuauugaaaaagagaucugccccaaguuagcugaauacaggaauuggaguaaaccucagugugacauaacaggguucgcaccauuuagcaaggauaacuccauucggcugucugccggaggugacaucuggguaacccgcgagcccuaugugucgugcgauccugacaaguguuaccaauucgcgcuaggccaggggacgacucucaauaacguccauucaaauaacaccgugcgagaucguacaccauauagaacucugcuuaugaaugagcugggaguucccuuucacuugggcaccaaacaggugugcauugcuuggagcaguuccucuugucaugacgguaaggccuggcuccacgucugcaucacaggggaugacaaaaacgcaaccgccagcuucaucuacaauggaaggcugguggauuccguaguuucauggaguaaggaaauucugcggacgcaggagagcgaaugugugugcauaaacggcacuuguacagucgugaugaccgacggcucugcuuccgggaaagcagauacuaagauccucuuuauugaggagggaaagaucgugcauacaucaaccuuaagcgguagugcccaacacgucgaagagugcucuugcuauccucgcuacccaggcguuagaugugugugcagggacaacuggaaaggguccaaucggccgauaguagauauuaacaucaaggaccacagcaucgugucgucuuacgucuguuccggacuggugggcgacacgccccgcaaaaaugauucaaguagcuccucucauugccuugacccuaacaaugaagagggugggcacggaguuaagggcugggcuuucgaugacggcaacgauguguggauggggcgaaccauuaaugaaacaagcagauugggauaugagacuuuuaaagucaucgaggguuggucaaacccaaagaguaaacugcagauuaauaggcaagugauaguagaccggggcaaccguuccggguacagcggaaucuucucuguugaaggcaagucauguauuaaucgcugcuuuuauguggagcuaaucagagguaggaaggaagagaccgaaguccucuggacaaguaacagcaucguggucuucugugggacuuccggcaccuacggaacaggcucuuggcccgauggggccgaccugaaucuuaugccuauuuga

SEQ ID NO: 141427 - RNA, 1410 nt, Artificial Sequence; identical to SEQ ID NO: 141426
  derived and/or modified sequence opt3 from neuraminidase__InfluenzaA__ADM12831

SEQ ID NO: 141428 - RNA, 1410 nt, Artificial Sequence; identical to SEQ ID NO: 141426
  derived and/or modified sequence opt3 from neuraminidase__InfluenzaA__ADM12842

SEQ ID NO: 141429 - RNA, 1410 nt, Artificial Sequence; identical to SEQ ID NO: 141426
  derived and/or modified sequence opt3 from neuraminidase__InfluenzaA__ADM12853

SEQ ID NO: 141430 - RNA, 1410 nt, Artificial Sequence; identical to SEQ ID NO: 138754
  derived and/or modified sequence opt3 from neuraminidase__InfluenzaA__ADM12864

SEQ ID NO: 141431 - RNA, 1410 nt, Artificial Sequence; identical to SEQ ID NO: 138754
  derived and/or modified sequence opt3 from neuraminidase__InfluenzaA__ADM12874

SEQ ID NO: 141432 - RNA, 1410 nt, Artificial Sequence; identical to SEQ ID NO: 138754
  derived and/or modified sequence opt3 from neuraminidase__InfluenzaA__ADM12884

SEQ ID NO: 141433 - RNA, 1410 nt, Artificial Sequence
  derived and/or modified sequence opt3 from neuraminidase__InfluenzaA__ADM12894
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaguccucauacaaaaucuuucggauugaaaaggguaaaaucgugaagaguguggagaugaaugcucccaacuaucauuacgaagagugcagcuguuacccugauuccucugagauuacuugcgucugccgcgacaauuggcacgggagcaacagaccauggguuucauucaaucagaaccucgaauaucagauaggauacaucuguaguggcauuuuuggcgauaauccgaggcccaacgacaaaaccggguccugcggaccugugagcucuaauggugccaacggcguaaagggguucucauuuaaguauggaaacggcguguggaucggucggacaaaaaguaucagcucccgcaauggguucgagaugauuugggauccaaacggcuggaccggaacggacaauaacuuuucuauaaagcaagacaucgucggcauuaaugaauggucgggguacagcggauccuucgugcagcaucccgagcugacuggucuggauuguauccgaccuugcuucuggguugaacucauuagaggcaggccaaaagagaacacaaucuggaccucagggaguucuauaucguuuuguggagucaauuccgacacugugggcuggucauggcccgauggugcggaguuaccguucacaaucgacaaguga

SEQ ID NO: 141434 - RNA, 1410 nt, Artificial Sequence; identical to SEQ ID NO: 138754
  derived and/or modified sequence opt3 from neuraminidase__InfluenzaA__ADM12904

SEQ ID NO: 141435 - RNA, 1410 nt, Artificial Sequence
  derived and/or modified sequence opt3 from neuraminidase__InfluenzaA__ADM12914
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaguugcggaccuguguccagcuauggugcgaauggcguaaagggguucucuuuuaaguacggaaacggcguguggaucggucggacaaaaucaaucaguagccgcaacggguucgagaugauuugggauccaaauggcuggaccggaacggacaacaauuuuuccauaaagcaagacaucgucggcauuaacgaauggucuggguauucggggagcuucgugcagcaucccgagcugacuggucuggauuguauccgaccuugcuucuggguugaacucauuagaggcaggccaaaagagaauacaaucuggaccuccgggucaaguauaucuuuuuguggagugaacagcgacacugucggcugguccuggcccgauggugcagaguuaccguucacaaucgacaaguga

SEQ ID NO: 141436 - RNA, 1410 nt, Artificial Sequence; identical to SEQ ID NO: 138754
  derived and/or modified sequence opt3 from neuraminidase__InfluenzaA__ADM12924

SEQ ID NO: 141437 - RNA, 1410 nt, Artificial Sequence; identical to SEQ ID NO: 138754
  derived and/or modified sequence opt3 from neuraminidase__InfluenzaA__ADM12934

SEQ ID NO: 141438 - RNA, 1410 nt, Artificial Sequence; identical to SEQ ID NO: 138754
  derived and/or modified sequence opt3 from neuraminidase__InfluenzaA__ADM12944

SEQ ID NO: 141439 - RNA, 1410 nt, Artificial Sequence; identical to SEQ ID NO: 138754
  derived and/or modified sequence opt3 from neuraminidase__InfluenzaA__ADM12954

SEQ ID NO: 141440 - RNA, 1410 nt, Artificial Sequence; identical to SEQ ID NO: 138754
  derived and/or modified sequence opt3 from neuraminidase__InfluenzaA__ADM12964

SEQ ID NO: 141441 - RNA, 1410 nt, Artificial Sequence; identical to SEQ ID NO: 140042
  derived and/or modified sequence opt3 from neuraminidase__InfluenzaA__ADM12974

SEQ ID NO: 141442 - RNA, 1410 nt, Artificial Sequence
  derived and/or modified sequence opt3 from neuraminidase__InfluenzaA__ADM12984
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuagauccuggaggaacaauaucuugcggacucaagagagcgagugugccugcgugaacgggucguguuucaccgucaugacagauggaccaucugacggccaggcuuccuacaagaucuuucgcauugaaaaagguaagaucgugaaaucaguggagaugaaugcccccaacuaucauuacgaagagugcaguuguuacccugauagcuccgagauuacuugcgucugcagagacaauuggcacgggucuaacaggccauggguuagcuucaaucagaaccucgaauaucagauaggauacaucuguucaggcauuuuuggcgauaauccgcggcccaacgacaagaccgggaguugcggaccuguguccagcaauggugcgaacggcguaaaaggguucucuuuuaaguauggaaacggcguguggaucggucgcacaaagucaaucaguagccgaaauggguucgagaugauuugggauccaaacggcuggaccggaacggacaauaacuuuuccauaaaacaagacaucgucggcauuaaugaauggucuggguacucggggagcuucgugcagcaucccgagcugacuggucuggauuguaucagaccuugcuucuggguugaacucauuaggggccggccaaaggagaacacaaucuggaccuccgggucaaguauaucuuuuuguggagugaauagcgacacugucggcugguccuggcccgauggugcagaguuaccguucacaaucgacaaauga

SEQ ID NO: 141443 - RNA, 1410 nt, Artificial Sequence; identical to SEQ ID NO: 138754
  derived and/or modified sequence opt3 from neuraminidase__InfluenzaA__ADM12994

SEQ ID NO: 141444 - RNA, 1410 nt, Artificial Sequence; identical to SEQ ID NO: 138754
  derived and/or modified sequence opt3 from neuraminidase__InfluenzaA__ADM13004

SEQ ID NO: 141445 - RNA, 1410 nt, Artificial Sequence; identical to SEQ ID NO: 138754
  derived and/or modified sequence opt3 from neuraminidase__InfluenzaA__ADM13014

SEQ ID NO: 141446 - RNA, 1410 nt, Artificial Sequence
  derived and/or modified sequence opt3 from neuraminidase__InfluenzaA__ADM13034
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcgggugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauaucuugaggacucaagagagcgagugugccugcgugaacgggucguguuucaccgucaugacagauggaccaucugacggccaggcuuccuacaaaaucuuucggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuucaaucagaaccucgaauaucagauaggauacaucuguucaggcauuuuuggcgauaauccgaggcccaacgacaaaaccgggaauugcggaccugugaguuccaacggugcgaacggcguaaagggguucagcuuuaaguauggaaauggcguguggaucggucggacaaaaucuaucucaagucgcaacggguucgagaugauuugggauccaaauggcuggaccggaacggacaacaauuuuagcauaaagcaagacaucgucggcauuaacgaaugguccggguacucuggaucguucgugcagcaucccgagcugacuggucuggauuguauccgaccuugcuucuggguugaacucauuagaggcaggccaaaagagaauacaaucuggaccagcggguccucaauaaguuuuuguggagugaacucugacacugucggcuggagcuggcccgauggugcagaguuaccguucacaaucgacaaguga

SEQ ID NO: 141447 - RNA, 1410 nt, Artificial Sequence; identical to SEQ ID NO: 140667
  derived and/or modified sequence opt3 from neuraminidase__InfluenzaA__ADM13044

SEQ ID NO: 141448 - RNA, 1410 nt, Artificial Sequence; identical to SEQ ID NO: 139580
  derived and/or modified sequence opt3 from neuraminidase__InfluenzaA__ADM13054

SEQ ID NO: 141449 - RNA, 1410 nt, Artificial Sequence; identical to SEQ ID NO: 139931
  derived and/or modified sequence opt3 from neuraminidase__InfluenzaA__ADM13064

SEQ ID NO: 141450 - RNA, 1410 nt, Artificial Sequence
  derived and/or modified sequence opt3 from neuraminidase__InfluenzaA__ADM13074
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaaccuggcugcaggccaguccguagugucugucaaauuggccggaaauucgucauuaugcccugugagcggaugggcgauauacaguaaggacaacuccauuagaaucggcucuaaaggugauguuuucgugauuagggagccauuuaucagcuguuccccgcuggaaugccggaccuucuuucuaacacagggggcucuccugaaugacaagcauucaaacggaaccaucaaagaucgcagucccuaucgaacucuuaugagcuguccuauuggcgaggucccaucucccuacaacucccguuucgaaucaguggccuggagcgcaagugccugccacgacggcauaaauuggcugacaaucgggauuucuggaccugauaacggugcuguagcaguuuugaaguauaauggcaucauaaccgacacgauuaaguccuggagaaacaauauccucaggacucaagagagcgagugugccugcgugaacgggucguguuuuaccgucaugacagauggaccaucugacggccaggcuuccuacaaaaucuuccggauugaaaaggguaaaaucgugaagucaguggagaugaaugcccccaacuaucauuacgaagagugcaguuguuacccugauagcuccgagauuacuugcgucugccgcgacaauuggcacgggucuaacagaccauggguuagcuuuaaucagaaccuggaauaucagauaggauacaucuguucaggcauuuucggcgauaauccgaggcccaacgacaaaaccgggaguugcggaccuguguccagcaauggugcgaacggcguaaagggguuuucuuucaaguauggaaacggcguguggaucggucggacaaaaucaaucaguagccgcaauggguuugagaugauuugggauccaaacggcuggaccggaacggacaauaaguucuccauaaaacaagacaucgucggcauuaacgaauggucuggguacucggggagcuuugugcagcaucccgagcugacuggucucgauuguauccgaccuugcuucuggguugaauuaauuagaggcaggccaaaggagaauacaaucuggaccuccgggucaaguauaucuuucuguggagugaacagcgacacugucggcugguccuggcccgauggugcagagcugccguuuacaaucgacaaauga

SEQ ID NO: 141451 - RNA, 1410 nt, Artificial Sequence; identical to SEQ ID NO: 139931
  derived and/or modified sequence opt3 from neuraminidase__InfluenzaA__ADM13084

SEQ ID NO: 141452 - RNA, 1410 nt, Artificial Sequence
  derived and/or modified sequence opt3 from neuraminidase__InfluenzaA__ADM13094
augaaccccaaucagaagaucauuaccauaggcagcgugugcaugacaaucgggauggccaaccugauucuccaaaucggaaauacuauuuccaucuggauaucucacucaauccagcuugguaaccagaaucagauugagacguguaaccaaagugucaucaccuacgaaaauaacacauggguuaaucagacuuaugugaacauuagcaauaccaacuucgcugcaggccaguccguagugucugccaaacuggcgggaaauucgucauugugcccugucagcggaugggcuaucuacaguaaggacaacuccauaagaauuggcucuaaaggugauguguuuguuaucagggagccauucauuagcuguuccccguuagaaugccggacauuuuuccugacccagggggcccuacucaaugacaagcauucaaacggaacuaucaaagaucgcagucccuaucgaacacugaugagcuguccuaucggcgaggugccaucucccuacaacucccguuuugaaucagucgcauggagcgccagugcuugccacgacggcauuaauuggcuuaccauagggaucucuggaccugauaacggugcaguggccguacugaaguauaauggcauuaucacggacacuauaaaguccuggagaaacaauauuuugaggacccaagagagcgagugugcuugcguuaacgggucguguuucacagugaugacugauggaccaucugacggccaggccuccuacaaaaucuuucggaucgaaaaggguaaaauugucaagucaguggagaugaaugcgcccaacuaucauuacgaagagugcaguuguuacccugauagcuccgagauuaccugcgugugccgcgacaauuggcacgggucuaacagaccaugggucagcuucaaucagaaccucgaauaucagaucggauacauauguucaggcaucuuuggcgauaauccgaggcccaacgacaaaacagggaguugcggaccuguuuccagcaauggugcaaacggcgugaagggguucucuuuuaaguauggaaacggcguauggauuggucggaccaaaucaaucaguagccgcaauggguucgagaugaucugggauccaaacggcuggacgggaacugacaauaacuuuuccauuaagcaagacauagugggcaucaaugaauggucuggguacucggggagcuucguccagcaucccgagcugacaggucuggauuguauucgaccuugcuucuggguggaacucaucagaggcaggccaaaagagaacaccauuuggacuuccgggucaaguaucucuuuuuguggaguuaauagcgacacagugggcugguccuggcccgauggugccgaguuaccguucaccauagacaaguga

SEQ ID NO: 141453 - RNA, 1410 nt, Artificial Sequence; identical to SEQ ID NO: 139931
  derived and/or modified sequence opt3 from neuraminidase__InfluenzaA__ADM13104

SEQ ID NO: 141454 - RNA, 1410 nt, Artificial Sequence; identical to SEQ ID NO: 140656
  derived and/or modified sequence opt3 from neuraminidase__InfluenzaA__ADM13124

SEQ ID NO: 141455 - RNA, 1410 nt, Artificial Sequence
  derived and/or modified sequence opt3 from neuraminidase__InfluenzaA__ADM13134
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuaaguccuggagaaacaauacuuugaggacccaagagagcgagugugccugcgugaacgggucguguuucacagucaugacugauggaccaucugacggccaggcuuccuacaaaaucuuucggaucgaaaaggguaaaauugugaagucaguggagaugaaugcccccaacuaucauuacgaagagugcaguuguuacccugauagcuccgagauuaccugcgucugccgcgacaauuggcacgggucuaacagaccauggguuagcuucaaucagaaccucgaauaucagaucggauacauauguucaggcaucuuuggcgauaauccgaggcccaacgacaaaaaggggaguugcggaccuguguccagcaauggugcgaacggcguaaagggguucucuuuuaaauauggaaacggcguguggauuggucggacaaagucaaucaguagccgcaauggguucgagaugaucugggauccaaacggcuggaccggaacggacaauaacuuuuccauuaaacaagacauagucggcaucaaugaauggucuggguacucggggagcuucgugcagcaucccgagcugacuggucuggauuguauucgaccuugcuucuggguugaacucaucagaggcaggccaaaggagaacacaauuuggaccuccgggucaaguaucucuuuuuguggagugaauagcgacacugucggcugguccuggcccgauggugcagaguuaccguucacaauagacaaauga

SEQ ID NO: 141456 - RNA, 1410 nt, Artificial Sequence
  derived and/or modified sequence opt3 from neuraminidase__InfluenzaA__ADM13154
augaaccccaaucagaagaucauuaccauaggcagcgugugcaugacaaucgggauggccaaccugauucuccaaaucggaaauauuaucuccauauggaucucucacucaauucagcuugguaaccagaaacagaucgagacuuguaaucaaagugucuucacguacgaaaacaauaccuggguuaaccagacauaugugaauauuagcaacacuaauuuugcugcaggccaguccguagugucugucaagcuggccgggaacucgucauugugcccugugagcggaugggcgaucuacaguaaagacaauuccauaagaauuggcucuaagggugauguuuucgugaucagggagccauuuauuagcuguuccccguuagaaugccggaccuucuuucugacacagggggcucuacucaacgacaaacauucaaauggaaccaucaaggaucgcagucccuaucgaacucugaugagcuguccuaucggcgaggucccaucucccuacaacucccguuucgaaucaguggccuggagcgcaagugccugccacgacggcauuaacuggcuuacaauagggaucucuggaccugauaauggugcuguagcaguucugaaguauaacggcauuaucaccgacacgauaaaauccuggagaaauaacauuuugaggacucaagagagcgagugugccugcgugaaugggucguguuuuaccgucaugacagauggaccaucugacggccaggcuuccuacaagaucuucaaaaucgaaaaggguaaaauugugaagucaguggagaugaacgcccccaauuaucauuacgaagagugcaguuguuacccugauagcuccgagaucacuugcgucugccgggacaacuggcacgggucuaaucgcccauggguuagcuuuaaccagaaucucgaauaucagauuggauacauauguucaggcaucuucggcgauaacccgagacccaaugacaagaccgggaguugcggaccuguguccagcaacggugcgaauggcguaaaaggguuuucuuucaaguauggaaacggcguguggauugguaggacaaaaucaaucaguagccggaacggguuugagaugaucugggauccaaauggcuggaccggaacggacaacaauuucuccauuaagcaagacauagucggcaucaacgaauggucuggguacucggguagcuucgugcagcaucccgagcugacuggacuggauuguauucgcccuugcuuuuggguugaacucauccgaggcagaccaaaagagaauacaauuuggaccuccgggucaaguaucucuuucuguggagugaacagcgacacugucggcugguccuggcccgauggugcagaguuaccguuuacaauagacaaguga

SEQ ID NO: 141457 - RNA, 1410 nt, Artificial Sequence; identical to SEQ ID NO: 140184
  derived and/or modified sequence opt3 from neuraminidase__InfluenzaA__ADM13164

SEQ ID NO: 141458 - RNA, 1410 nt, Artificial Sequence; identical to SEQ ID NO: 138754
  derived and/or modified sequence opt3 from neuraminidase__InfluenzaA__ADM13174

SEQ ID NO: 141459 - RNA, 1410 nt, Artificial Sequence; identical to SEQ ID NO: 138754
  derived and/or modified sequence opt3 from neuraminidase__InfluenzaA__ADM13184

SEQ ID NO: 141460 - RNA, 1410 nt, Artificial Sequence; identical to SEQ ID NO: 138754
  derived and/or modified sequence opt3 from neuraminidase__InfluenzaA__ADM13194

SEQ ID NO: 141461 - RNA, 1410 nt, Artificial Sequence; identical to SEQ ID NO: 138754
  derived and/or modified sequence opt3 from neuraminidase__InfluenzaA__ADM13204

SEQ ID NO: 141462 - RNA, 1410 nt, Artificial Sequence; identical to SEQ ID NO: 139931
  derived and/or modified sequence opt3 from neuraminidase__InfluenzaA__ADM13214

SEQ ID NO: 141463 - RNA, 1410 nt, Artificial Sequence
  derived and/or modified sequence opt3 from neuraminidase__InfluenzaA__ADM13224
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccggaaauucgucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgaacucugaugagcuguccuauuggcgaggucccaucucccuacaacucccguuuugaaucaguggccuggagcgcaagugccugccacgacggcauaaauuggcuuacaaucgggauuucuggaccugauaacggugcuguagcaguucugaaguauaauggcaucauaaccgacacgauuagauccuggaggaacaauaucuugcggacucaagagagcgagugugccugcgugaacgggucguguuucaccgucaugacagauggaccaucugacggccaggcuuccuacaagaucuuucgcauugaaaaagguaagaucgugaaaucaguggagaugaaugcccccaacuaucauuacgaagagugcaguuguuacccugauagcuccaagauuacuugcgucugcagagacaauuggcacgggucuaacaggccauggguuagcuucaaucagaaccucgaguaucagauaggauacaucuguucaggcauuuuuggcgauaauccgcggcccaacgacaaaaccgggaguugcggaccuguguccagcaauggugcgaacggcguaaagggguucucuuuuaaguauggaaacggcguguggaucggucgcacaaaaucaaucaguagccgaaauggguucgaaaugauuugggauccaaacggcuggaccggaacggacaauaacuuuuccauaaagcaagacaucgucggcauuaaugaguggucuggguacucggggagcuucgugcagcaucccgaacugacuggucuggauuguaucagaccuugcuucuggguugagcucauuaggggccggccaaaagaaaacacaaucuggaccuccgggucaaguauaucuuuuuguggagugaauagcgacacugucggcugguccuggcccgauggugcagaguuaccguucacaaucgacaaguga

SEQ ID NO: 141464 - RNA, 1410 nt, Artificial Sequence; identical to SEQ ID NO: 138754
  derived and/or modified sequence opt3 from neuraminidase__InfluenzaA__ADM13234

SEQ ID NO: 141465 - RNA, 1410 nt, Artificial Sequence; identical to SEQ ID NO: 140042
  derived and/or modified sequence opt3 from neuraminidase__InfluenzaA__ADM13244

SEQ ID NO: 141466 - RNA, 1410 nt, Artificial Sequence; identical to SEQ ID NO: 139108
  derived and/or modified sequence opt3 from neuraminidase__InfluenzaA__ADM13254

SEQ ID NO: 141467 - RNA, 1410 nt, Artificial Sequence; identical to SEQ ID NO: 139931
  derived and/or modified sequence opt3 from neuraminidase__InfluenzaA__ADM13264

SEQ ID NO: 141468 - RNA, 1410 nt, Artificial Sequence; identical to SEQ ID NO: 138754
  derived and/or modified sequence opt3 from neuraminidase__InfluenzaA__ADM13274

SEQ ID NO: 141469 - RNA, 1410 nt, Artificial Sequence; identical to SEQ ID NO: 138754
  derived and/or modified sequence opt3 from neuraminidase__InfluenzaA__ADM13284

SEQ ID NO: 141470 - RNA, 1410 nt, Artificial Sequence
  derived and/or modified sequence opt3 from neuraminidase__InfluenzaA__ADM13294
augaaccccaaucagaagaucauuaccauaggcagcgugugcaugacaaucgggauggccaaccugauucuccaaaucggaaauauuaucuccauauggaucucucacucaauucagcuugguaaccagaaucagaucgagacuuguaaccaaagugucauuacguacgaaaauaacaccuggguuaaucagacauaugugaacaucagcaauacuaacuucgcugcaggccaguccguagugucugucaaacuggccgggaauagcucauugugcccugugagcggaugggcgauauacaguaaggacaacuccauuagaaucggcucuaaaggugauguuuuugugauuagggagccauucaucagcuguuccccguuagaaugccggaccuuuuuccugacacagggggcucuacucaaugacaagcauucaaacggaaccaucaaagaucgcagucccuaucgagcccugaugagcuguccuauuggcgaggucccaucucccuacaacucccguuuugaaucaguggcauggagcgccagugcuugccacgacggcauaaauuggcuuacuaucgggauuucuggaccugauaacggugcaguagccguucugaaguauaauggcaucauaacagacaccauuaaguccuggagaaacaauaucuugaggacgcaagagagcgagugugcuugcgugaacgggucguguuucacugucaugaccgauggaccaucugacggccaggccuccuacaaaaucuuucggauugaaaaggguaaaaucgugaagucaguggagaugaaugcgcccaacuaucauuacgaagagugcaguuguuacccugauagcuccgagauuacaugcgucugccgcgacaauuggcacgggucuaacagaccauggguuagcuucaaucagaaccucgaauaucagauaggauacaucuguucaggcauuuuuggcgauaauccgaggcccaacgacaaaacugggaguugcggaccuguguccagcaauggugcaaacggcguaaagggguucucuuuuaaguauggaaacggcguguggaucggucggaccaaaucaaucaguagccgcaauggguucgagaugauuugggauccaaacggcuggacaggaaccgacaauuccuuuucuauaaagcaagacaucgucggcauuaacgaauggucgggguacagcggauccuucgugcagcaucccgagcugacgggucuggauuguauccgaccuugcuucuggguugaacucauuagaggcaggccaaaagagaauacuaucuggacaucagggaguucuauaucguuuuguggagugaacuccgacaccgucggcuggucauggcccgauggugccgaguuaccguucacuaucgacaaguga

SEQ ID NO: 141471 - RNA, 1410 nt, Artificial Sequence; identical to SEQ ID NO: 138754
  derived and/or modified sequence opt3 from neuraminidase__InfluenzaA__ADM13304

SEQ ID NO: 141472 - RNA, 1410 nt, Artificial Sequence; identical to SEQ ID NO: 140216
  derived and/or modified sequence opt3 from neuraminidase__InfluenzaA__ADM13314

SEQ ID NO: 141473 - RNA, 1410 nt, Artificial Sequence; identical to SEQ ID NO: 138754
  derived and/or modified sequence opt3 from neuraminidase__InfluenzaA__ADM13324
